United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 7

SEQ ID NO: 4972 - DNA, 7091 bp, Homo sapiens
agactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagaggtaccggcgaccgctgtcggaggcgcggactcggggcagggccaggagtcgcccggaagcccggcggtgggaatgggtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggaggacctgaagacgtgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcaggtcatgtcctccaggtttctgcacgttgctgcagatgacatgatttcatgaatttctgcggccgaagaggattccactgcgtgctgcagtttctttatccctttatctgtgcatgaacagtgcaggccaaggccccctgcccatggaggtgtgctgcagacagcagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaaggtgagtgaagctctggcaagaagagcctaggggatgtgcagggtccaggccagagatacagatgccgatcctgaaagccgatggaggagaagaggaagttccccatttttaaagagggaatccccaggcccaaccatagcttaccctggccaccttgatccagtgctccaccaccctggccctgtcccgggccctcatgctgtggtccccgaggcaggaggtggtgatgcagttggtgagcctgttgaagtgtgcgatggtggcacgaactgtgggtgccatgtgctcattccccttcagatgtccttggccccagatgcagcccaagcattcgtggagcaccaccttcttgaacagctcctttgggggaggaggagagtgtcacggacacagcacactgcagctcagagtcacccacagtcccaggcagggactgagctcacagtcatccacggtctctggcaggaaccaagctggagctcagaaagctttaaaatgggctccagacttgtgggagtccctgggtttggttttctgcccccgagggacctgaatgcatcatggcctagaacccaacaagggtgggaagagagagtgacattttctcccaggccatccacactctaagaactagaaggtggctcaggcctgcccatcctgaggcctcgtcttcctcccatcccaatcagccctctactactcctctccgtaccggtgcactttccttgtggcagctgcaactatgggctctgtttgggtgtctaccatagaatccagtatgcatcaggtacctaataagtgctgagggtagtgaggctcctgagcagctgggtgagtgacccatggccctgcctgccccacagtgagcacctgccctgccctgctttctgtccatctcctgtcactcagtctgcacagtcactctgtgcagctggcgctggtgatgtcccatctctgccgtccacatgcagacagggaaggcttgtgggtgaggaaactcatccagatcccacggttggtaagaagtggggctgaaattggaccgagggcattggctgctcctcagggagaggctggtctgagacagctggtgccagagacacagcctgcaaagctcagctgctcaccgcatccatgagggtcagctgctctgccagcagcctgggagggaaggtcgtcatgtcaggcagctcctcactgggttggttctttacagacccacgacagggacaggaggactctggggctgactgtggctccagcactgtccctggagggggcccttcccctggtgctggtgctggccctggtgctgaatgtagatatcctggtggacccagggctgcaggtgactctggctccagagcaggccccaggtccgccagcagtggtggtgctggctccagggccggcattgttaatgcgtgttgcccaggacgtggagcaggatctggaaaaggagaaaaggtcaccacaccagtcatttttcactgggttttccaagcacagaaatgaccgggtggaatttaagggaattgtagccccaaaacaccacccccggaaagtcttgcagactgcaagccccctcaccatctggcttggcctcgttgggctccggaagcaccaactggcctaggacaatttcctgatggtcctccaagcccagtccaggccaggagaggttcctgaaggccagctttatccggaaagatgaccgttgcgggggctgatagtaaactgaagtgttttcggggggccagttgaacaaaatggaggtgatggtgctggtgatggagtagacagctgagtcagaggcctggccttctcccacacaaccctccagggcacccctgcgtggttctgggtccctggcctgttgctgccagtgtggaggacagccccaccctaccgtaagccatcagtgctgtcctggaaggggcagacctggccatacagcagggctgtacagaccctcgtgcgccctggcgtcccacagacattctcttcccaaaggccctggagcacagcactgtacacctgggcactcaagactgcagctgcaggcagatttgtgagcagcttcctcatcaaagctccagatctgggtcccctggtcctggggttaggagggaaggggcagatgtcggggggaggaggacagggagagctgggaagccacggtgctgagggggatgggtctctcagtggccagctgtgaccccagcctcccctctgctttgcaggggacctaagtctccatttacagaactcactatttgcctcttgtgggggaagtccccagatgtcagccttctcgtgggaattataagaagtatgagccccagagctcctttagtctctccccagccagagtccacatattttcccccatgttttgtgggtgaaaaggcccttcagaaccctaaatccacccagtttatatttgttgctgggctgcgtcattctagtcagaatctgggaggatgccaccatacgtagaggaggccatgagggtctcacctgtaacattctgtagatatgacttgtttattctgtctactgtgagtgcctgactctgagtagaatcaaggccgggggattgtcatctgctttgtttatgaaattatgccaagccccaagaagagcgatgcacaaatgaggtgttttgaatgtatgtgttgaatgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccacccacaggggcctggagctgcaggatcccaggggaggggtctctctctgcatcccaagccattcagcccttctcgctgtacccagtaaaccctcaataaatatctttgtcagccagaaatcctgc

SEQ ID NO: 4973 - DNA, 562 bp, Homo sapiens
ggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtaaggtgactttttcaccatgtatggcatcttagctctgtcatctcacaggtgttaagatcagccacaggtgtggtgagacgtttgactttatccttcttttttcattggcatgtttgtcacccactggctcttgcatgtgtgtttcaaccttgtaaacaagccgttcaattctgtgtgcctgccagaagaacagcattggtgctgctcaccataagaaaatgccctttgttattttattaggtggcagggactcagctcggaattctgtatagaaaaagcacctggatc

SEQ ID NO: 4974 - DNA, 2406 bp, Homo sapiens
ggtacagacaggtctttattgttgacatattttctcatttaatccttgaagcaaccctgaggtaggttttattatccccacttcgcagatgagtaaactgatgtccctaggttaggttacttgccgaagatcacacatttactagtggcaaagccactgataattccaaacccaaggggactcttttgagtagttcacaggctgctgccaaggaaagtagagcagaaaacttcaaaggggaaggactggatcattgactggagcttgaggggctcaagcaccagggatgaacgaggcacattcacaggccaagaccaggactcagcaggagaagcctagagccatgtgcgagtggtcaagcaggaagaggtcttgacgtttggtaagagctgacaatgtcatcaaatacacatagagctcagcttccagggactggagaaacaagaaggcctccagcagctaccagtccagggactggccacagtcagtcagactcaaagagaactgagaggccacaacagtcttccagacccagcaacctttggcatctcagtggtaactccattccagcaaatcaccctgttccaggcagggcaagtccagggagagctgccacagagtgatgccatcctaacttggcctcagtgcagtaacctcagggcagtggtcctttaactttgttaaggccttgaaaatctgacaaaagccataaaacctccccacagagacatacagacacacatgtacaaacaacattttgcatacaatttcagggagtccatggaccccaggtaggggggactcctgctttagggcaagggtgtcaccctgagtagtcactgattgcaaacgtatctttatactgctcgtatatcctatgactgttccccttctgttgttccctaatcattagaatgttgttgatttttaatgggagccaaggaaatggggtacagcctacactccagccagagaaagcagctgtgacatggcagtggtggcagccagggggtaaaaacaaagaaaaggatggggtcatgtgtactgctgcccttcccacccggaaggtcactttaggagcttttctctactcaaatttagagtaaggttgtggggcaatggggagaggggcagtgtttcagttccttttagaaaggaacgccattccctctatggctacagggtctaaagttctgcaggcaacgcccccattccaattgtctccctccccatccctcataaatattcctaagcatcggcccagtcattcatgcacatgtggccaggtctcttatgaacactatgtatttacacgtactctttcatggaaggaaaactgagatggggaagatctcagggcagagactccatattgcaacatggggatcatgcactccccacagattcagataaacttgaagaataagcagaaccaccccaaggactcagggcacatttgcccccaaccacctccagggctcttccttccggccaggctccaaccagaaagcaaagtcatagctatgccctgtgccccatccccaaaactaatgggcccaagatagggggccagggatgaaggtttacaggagttcagatgttagggggaagccctgatttgctgcagaaagcagttctgatttctcatgggaatcaggaatcaggcaaaggtctggccccaagcccatccaggctcagagagaacagatactaaaatccaagtaatcactcatactcaaagagaactcagaggctgggatggtcttccaggcccagtgacccccagcatctcagtggtcactccgttccagtgatcacttatacactagtggtcatttgcccagctctagatggatgtttcatcacatgtggctagaggagccccagttagccgaatgtgggctgggcttgggcaaggatcaagcaggaagggtggtgagaatccaccaaagccactgcccctcttggccagggccagcggcaaccgctcatcttcaggagagggggagggagggtcttggctgtagcttgtggtcccagaaggtggagcccccaggtccaggcccaccttgtctctagccagaagttccctctgtcgccgtcgctgctgacgccgaccaatcagaatgagagtcagggatgctgcgagaatccccaagaagaagccagccagtcccgcccccactgtgtgggcccggctcggagcatctcgctggctgccccataccaagctgtaaggctgcccgggacccgggcggggccgcgcagcagaggccggcatctttggctccgcctggccgcgggtgcggcgcaagctacggcctctgctcagggccccggggctactggcctcggccccactcgggtcctctcggctcggtccggctcagcctgaggctgagggat

SEQ ID NO: 4975 - DNA, 708 bp, Homo sapiens
gggaacaatctcctcgttccagaagggcagggcccgggcaatggtgtccttgaggctctcgcaggtggggagttccccgggcttcaggcctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcgccaggctaggaggcggccctcagcaggcagaggaggagagccagaggagctggtgcagaccacagctttgtggagaggagtctggccttgtggaaggt

SEQ ID NO: 4976 - DNA, 2517 bp, Homo sapiens
ttatggtgaagaccaccttttcagatgtgacatggctcacagtaagagcacttttcagttcatgcacagcaaaattcataagtgagaggactcaagggccaggcatttgtgaaggctttccagggtaactacccccttccagcactggagtaccagaataatgagaagctcaaaagagaatgtggaaaggccttcctttctccatcaccagagtactcatggcacagggaagccatgaagaagagctgagtgagaagatgctgccacacagctctaacatcagataacaccgggcaggccatgatagggagaagcccttcaagagcagtggctatgggaagacatgaagacttttgccctcttcaaccacctaagaacccacactgaagagagatctttaaatacttggtatgaagaaagaccctcaagaagaaatcgattcttatctataaccaaaaaattcacagtagagaaaacccctgcatctaaggaatgtgggatggtcttcagtcacctctcctatgtgagaaagctatataaagtacctatgggaaaaaggcattacaaatgcagtgaaaatgggaaagccttcagctatagacacccccttttaagaaaaatcaccagagaattcacaagagagttatgggcaacaaatgtgggaaagccacagctcccagaatcttaggcggcactgtattactgctattgcagaagccatctgtattagttacctattgctgtgtaacaaattactcaaaacctagtggcttaaaacaatagtcactatttcacagtctctataggtcaggaactttggtgcagctagctgactcctctttagggtttctcacaaggctaacatcaagatgtcagctgggggtgtatcatctgaaggcttgactagggaaggctctgcttccaagcaaactcatgtaattggcagcattcagttttttgtgggctgctggactgaggacccgtctgttggtctgagacctcctccagttctctgccacatgggcctctccaaaatggcagcttgtcaatcaaagcttgcaagctgatcatgcagtggagaataccaacaagtcagtcatttgtaacctaataacagaagtgagatcccatcatctttgctaaatttagttagaagcaagtcacttggtccagcccacagtcaaggggagagcattacacaagagcatgaataccagagggcagagatcattggaagccatgtccaaagctgcctgccatactgtctcatctctgccacctggcaagatctcatgatatgtatcagtctccctcactgtgctaagggaaagcagactatactcccttttccattctctagagagaattacataggctttgagtaccttcattttctttcccactgatggctttagattttggtatgacaattcttgctaagatctgagctggtgtcttctggagctttccagaaaaggtttcttggccgggcacagtggctcatgcctataatcccagcactttgggaagctgaggcaggcagatcatgaggtcaggagatcgagaccatcctggctaacatggtgaaaacccacctctactaaaaatacaaaaaattagccaggtgtggtggcgggtgcctgtagtcccagctacttaggaggctgaggcaggagaatggtgtgaacctgggaggcagggtgtgcagtgagccgagatcgtgccactgcactccagcctgggcgacagtgtgagactccatctaaaatagaagaaaaggtttctcttcatggacattgtttgcatctacatgtgacacttaggaatgatctgtttagtctcaatcactcactcctggatctgcctgtctctctctgagataacaaaggccttaatgtttagccacctgcatcagagttggtgaggtggtttgaaacaattcatcctaatataaaaagaacagcttttgtaagggggcactgagtgtctcaaacagccgcatgggcaggaagagtgctcagtccagttttggttgaatttgtcttgttgccctaaggcctcctatgaaagactgacaggcttggactgaatcttgtgatctggacaccaagggtcacctgtgggcccagagctagctctgaagaatggggtagtttctttgagaacctccacagcaaaagtttggtcctctgttcccaatgcatgtcccactttaccagctacatcccccagtacctgcccatggctcatgactcatgaaatataaaactcagtaggcaggcataactggttcagacctgccagggctatgtgggaactatcattggtacaaaaactctaagtgtggagaagactgtggtagacaagaggggacatgtctgttctaaacgcacatcagaaacttccaatgactatggccaagtgagataagggtgtacagaacttctcaggacatgcagacctatgtgtcactcataactgaaattcaaataaatattttgtggatttcctgtggac

SEQ ID NO: 4977 - DNA, 21107 bp, Homo sapiens
agaaccaacgcgctgtcccgaaggagtagcaacggctcgcacgggctgtcctagcaggggctacggcggccgacaagtcccatgagcagcacctccgcttctgcacgcgcttcccaggccggaatgctcggcgctctcgcgaggaggggtaccgactggggcgggagtacttcggcgagacttcctcctctttcggcccgacttcctcctctttcggccccgcctcttggcgcggggtcgcaattgggcgggaggttctcgcgatctccccgtccacgcctgcgccgcgagaggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcctgatcggtgaaaactaggcgagacgcgcacactgaccctgcagtgcatcttgggagttgtagtcataactaatcaatggtcttgttaaaacgtgcttatgttttgaccagatcgcttaagtgtggacacccttcagcagtacactacaacgtgggtcagtgtacagaacacatgctgatagaaataatttcaaaatctggattcatagtttttttttttaatctagagacctcagaaaatgtacttgaagaaaatcatcataatataatacataacaatagagccaattaattgatgtgatgaaagtggacaaaatgtattttgacctcagagaaaataacatttctgtcttggaagagtcagagaatgcttcacacaatttttgagcctgatgttagactctccagccttctgtccaagcctcaccctttggttactccccaggaagactgaacttgggaagaggattgtgcagaccctggagtcaggcttggcgtttgggatagggaatactagagtgcccacagcatggtctggaaaagggaaagtgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatccagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaaaaaaaaaaaaaaaaaggcaaagatatatagtgaaaactaagtcttcttttagtctttgtctcctgccactcatagaattttcctcttggaatcacctctattccattttcctgtgtatgttgccagagcagggctggcttcatggtggtgacctgtacagataggcacttggtttaatgttttgctgtcactaacttgaaattcaggaaagtttctggacaagggccctgcggttttattttgcactgggcccacaaagtatgtatctagtcctattccagagatattctatgcatatacaggtaattatatgtagatatgtatgtagtggtccagtagtggtccagggcctgttaggaactgggcggcacagcagaaggtgagtggcaggggagccagcatttcggcctgagctctgccccctgtcagatgagcaggggcattacattctggtaggagtgagaaccctattgtaaactgcacatgcaagggatctaacctgtgcactccttatgagaatccaactccccctttccatggaaaaattgtcttccacaaaaccagtccctggtgtcaaaaaggttggggacctctgtagtaggctaccatctaggtttgtttaggtacactctatgatgttcacacaacaaaaaatcacctgatgatgcatttttcagaaagcatccccattgttaagggacacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcatctcggctcactgcaacctccgtctcccggattctaacgattctcctgcctcatcctcctgagtagctgggattataggtgtccgccaccacgcccagctaatttttgtatttttagtagagatggggtttcaccatgttggtgaggctggtctcaaactcttgacctcatgtgatccacctgcctcagcctcccaaaatactgggattacaggggtgagccaccgtgcccaggacagccttttttgggtcagtgtgtatatagagctaactcattctacttaatggctacatagtatcccactgtgatagccgcaaaaggcagacaaatcctaggcagacaggggcaggtccctggtgaaacccttcaagctgaggacagtttaaaggctagccacaagaccaggataaatccacagaccagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaactcatttattgtatatttgtgtcatttccaatggttcgtaatttcaaacatatgattgtgcaaaagttgttttatgtgtgccaatatctttgtaggttaatttcctagagcaaagtttttcaacctaagcaccactgacatctggggctggataatttgttgtgaggggctgtcatgtgcgttatacgatgtatcctatccacccctatatgttatgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaatgataagagaatttattggctcacataaatgagaagtctgaagataaggtgaacctcaggttgatttgagtgacttaacagtatcagcaggaacttgatttccttctacctctcaattttctttctgatgtcagattcatcctaaggcttactccttttgtatcataaaatggtggccaggatctcccaaggttatgtagttctttgtccatatcaaaagagagtttctttcacatatttcacagtttcaatgtgattaaattaatttaggtcacatgtccgcccctaaacctagagttttgtggtctagagaatgtcaagcactgattggccagggcaaatcaaggcctatccttggaactggaagttacgttaatcccacctaaatcccatgaatgttactctatgaggtatcggtaaaatcgatgctaggaatacaatcagaatccattatatcctattacacgcttatagcaccatgcacccctccattgtagcacctgtcatacttgtagctttatatttatttgtatgatttctgattaataactgtcttctcatccagatgaaaaacctctattagtccagggaactgcattttttctcaccattgtatctctagtctagcacagggtgtcaaacatagcaggttctcaataactattgaaagaatgaaacttcccttagaagtttactactcaatttgacattccctttagcaggcaatttaatagctaccatatcagacttatattacatatttgaaagtcccagactgagatctctaatttctatctccaggcagtcagttcttgacacaccactgagtaagattcatggaataaatctgaccatattatattcccttgacatctttcaagttcctgatttcttttaggataaagttctttatgatgccattcaaagctcttcatggtttggcccctatctggctttctattctcaagagcaaaactatagacttctggccttcttcagggtgatctttctctttcaatcatagtccctccccaaccactcaccaaatatcagtttttagaagtcttgtctcttgcagggagtagagagggggcagtaatagtttattcagggattcccccatatctttcctgggtaaaggtattctagaaggaggcagaggaaggaggctagaggtcccactgtttggcattcaggctttcacttaatgctcactttagccctgcttcacagtcccctactacctactgtgactaatattctcaagtcaagagtctctcccattctagaaaataaatcaggctcctgggatgtggtgatggtgttataggggcatgtgtgggtatgagtgtgtgtgtatgtgtgtatgtgtgtggggtggcagtcctttggttatatgggattggggaatagacccaggaatgtaggtgttctttatataggctttcacccttccctaaaattttctgccctgatcctttctaatttttttgtggaaagaattagctcttttaatttatttattttattttattttatttcattttattttatttttttgagatggaatcttgctctgttgcccaggctggagtgcagtggtgtgatcttggctcactgtaacctctgcctcccaggttcaagcgattctcctgtctcagcctactgactagctgggactacaggcatgtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggaatacgatgcctacaaagaaagcagagctggccaactgttactaagacaagtaatgccttgcagatggataatgagaaaccgagagcacttaaacagttaaaggctaagtgtgggagccgggggcttctctggagcttaacaaacttttatttcctgcagtggaagagcagaaatgggattggatggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggactcaagtcatctgcccattttggcctcccaaagtgctgggattacaggcgtgagccaccacatcgggactgttttttttgttttttgagatggagtcttgctcttgttgccaaggctggagtacaatagcaccatctcagcttactccaacctccacctcccgggttcaagcaattctcctgcctcagcctcccgagtagctgggattacaggcacctgccactacacttggctaatttttatatttttagcagagacgggttttcgccatgttggccaggctggtctcaaactcctgactttgtgatccgcccacctcggccacccaaagtgctgggattacaggttttagccaccatgcccggccacctggcctgttttataccaatttaaagtgtttttttaggcttcacatggtggttcatgcctgtaatcccagcactctggaaggccaaggtgggaggatcgcttgagcccaggagtttgagatcagcacctgggcaacagagcgagacctcacctctactaaaaattaaaaaaaaaaaaaaaattaaccaggcatggtagtccatacctgtagtaccagctacttgggaggctgaggcaggaggatcccttgagcctaggagttcaaggttgcagtaagctatgattatgtcactgcactccagcctgagtgacagtaagaccctgtctaaaaaataaatagtggtttttagatgatcatctgcaaatatttttgttctttccctgtatccctttttaatctcatcacattgattaggacatccagaacactggtgattcttgttttgttcctgactttaatggccatgtttccagtgttgtatacatgttcctaatttttgatacataccacttgtgacgttaaggacatttcctgatattctaaactctctaggaaatggatattgaattattaaaaaaaaaagtctctttttagcctgggcaacatagtgagacccagtctctaaaagaacaacaacagcaaaaaatttgctggcatgctggtgcatgctggcagtcccagcacctcagcaggctgaggcaggaggatcacttcagcccaggagtttgaggctacagtgaactatgatcctgccactgcactccagcctgggcaacagagcaagaccctgtctccaaaaaaaaaaaaaaaaaaaaaagaaaaacaggaccattttttgcatctggtgaccatatggttttctcttaatattatgacaatttataactgttctcataaatgataatgatctataaatttttatgtttgcttttttttaatcatctcttctaggttatgagtcctaggcaattgcattaaattttataaccatagtattaaaaaaactatttatagtcaacaactcaagtttggttttcatgaaacactgggtatttttcaatgcttcccatcccatgcaggataaagtcagagtactaaatctcatattctaaactcccacacaatctgacgtctatttactggcttcttcatccattaataaaactgttccttctccacaaagtgcctttccctttataatcgtcctttaaagcccagctcaaatactaactctctatattgaaatccagttcaaattccacttcttagaaaccttcatttttccttctagtttacctcttctctttttatagcatgactttttaaaaactttcattatagtgctcaccaacctgcctttcattaattagtaactctgtattagactatatttaagtccctgaaggaaacaaactattccatagcagagtactgtgctcctaataggtagttttaaagtttttattacattaaaattaattttgtaaatttctgttatattgaagcctcttgcaatgatctgagatatgctttagatggcaaaactgaggttgctttaaatattacctttacaaaagtcacttattaccaaattgccttttagaccattttacctgtctgttggttgatgacttcatactcatatttaatgagtcagacatctctctcttttttgagacacagtctggctctgttgcccaggctggagtacagtgggacaatcatagctcactgcagccttgaattaccgggcccaagtgatcctcctacctgagccctcagcctcccaagtagctgagattacaggtgcgcaccaccatgccaggctaatttttttattttctgtagaacaaggtgtgaccatttggcccaagctggtactgaactcctgggctcatgtgatccacccaccttggcctctcaaagtgctgggattacaagccaccacacccaggccatctttaaactatttaaaactatttaaactctttaaaactattttgtccattggccaggtatggtggctgacgcctgtaatcccagcactttggaggctgaggcgggcagatcacaaggtcaacagattgagaccatcctggccaacatggtgaaaccccgtctctactaaaaatacaaaaattagctgggaatggtggcgtgcagctgtaatcccagctactcgggaggctgaggcaggagaatcgcttgaacctgggaggcggaggttgcagtgagccgagatcacaccactgcactccagcctggcaacagagcgagactccatctcaaaaacaaaaacaaccctattttgtcccttttagtttctatttatgtaacagatcctattgtcctcacaatcctcagcctgaaatccttagtcataactgccgctctcttccctccacttgccactcactccccattttatctgggttaagtccatccattatcccttatatttgctctgcaacatcttggtatgtgcccagcccactttttctgaatacactctcttctcagaagtgagctcttggtaattttctgaccagttgcttataccaggtttagggttaccagatttagcaaataaaaatatagacaattgtctgaccagttgcttatatctggcttatgggtaccagacttagcaaataaaaatataggacattcagttaaattatttgaacttcagataaacaaggaataatcttttagtgttacatgggacctacactgaacatctgtttatctgtaattccaatttaatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgattaaatgctttgaaaatatcatcttaggccaggcgcagtggctcacacctgtaagcccaacactttgggaggctgaggtgggcggatcacttgatgtcatgagttcgagaccagcctggccaatatggtgtaaccccgtctctactaaaaatacaaaacttagctgggtgtagtggcgggcgcctgtagtcccagctactcgggaggctgaggcaggagaatagcttggacccgggaggtggaggttgcagggaggtggaggttgcagggaggtggaggttgcagtgagctgagatcacgccactgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactctatctctttatctagttgtttttctttaaggtacctaccactacctgacatgttgtacagttaagttcttacttaatgtcttcgataggttcttgcaaactgtaactctaagataaactacataaaatgaaaccaaatttaccacaggctaattgatataaacaagagttaagatcctatggcacatttctggtaaaaaaaaaaaattaccaaacttgcaaataaagaccaaaacatttctgatgttaaacactgaagtaaatgtgagctagacaacattcaagaaagatgaataaaacaagatgatttatcaaattacaacagttcagggttttgggtggttggagcccatcctggcagttcagggtgccaggtgggaagtgatactagacaggacagccatcacattgcagggtgcactcacacacacatccacactcactcagactgggcaacaagagcaaaactctgcctcaaaacaaacaacaaacaaaataaaataaattatccagactcaggtatttcttctttcttttttgagatggagtctccctgtgtcacccaggctggagtgcagtggcatgatctcggctcactgcaacctctgcctcccaggttcaagcgattctcctgcctcagcctcctgagtagctgggattacaggcgtgcaccactatggccggctaacgtttgtatttttttttcagtagagacggggtttcaccatgttggccaggctggtctcgaactcctgacctcaggtgatccacctgcctcagcctcccaaagtgttgggattacaagcatgagccaccgcatccaacctcaggtatttctttatagcaatgcaagaatggactaatatactcctgcagacgtgggaaaaagtgcagactccacacagacggtaagcctggccaggaatcaatgttttgtttccttctcaacaacattttaatgcaaatgatgttgaaaaaaaagttattcaaggacctgctgtatcgtaatttgctatcaatttccaaactctagaatatgagcattggaactttagctgttttgtctgtttttgttattttgagatggagtcttgctctgttgcccaggctggagtacagtggcacgatctcggctcactgtaacctctgcctcccgggttcaagtgattctcctgcctcagcctcccgagtagctagaactacaggcatgtgccaccacgcttggctaatttttgtatttctagtagagacggggtttctccatgttggccaggctgttctcaaactcctggcctcaggtgatccacccgcctcagcctccctaagtgctgggattacaagtgtgagccaccgtgcccggcctaacttaggtcttttatttactgacacatcccctgcataccttataatgcctggcacatgttaaatgatgaataaaagaatgctatgcttggctgaactgaactaagaaagatattcatgttttcattttagatccaagaatgtaagatattctgtaatagaagaaaaaatgattatataaaaactgtactgtgatagaacagtaacttatggagtatgtgtgttcctgtatcaaaacaaaagtcatgggaaaaaaagtcttacttttaagtacttgtattgagctaaccaccaaagatggcattcagtttgatctgagtcactataaattagtgtttccagcatataatatagccgtcatagaaaaacttcattggggccaggcgcagcggctcatgcttgtaatcccagcactttgggaggccgaggtgggcagatcacaaggtcaggagatgagaccatcctggctaacatggtgaatccccgtctctactaaaaaatacaaaaaaaaaattagccgggcatattggcaggtgcctgtagtcccagctactggggaggctgagtcaggagaatggtgtgaacccgggaggcggagcttgcagtgagctgagaatgcaccactgcaccccagcctgggcgacagagcaagatgccatctcaaaaaaataagaaaaaataaaataaaaatacaaaaattagccgggtgtagggcacctgtaatcccagctactagggaggctgaggaaggagagttgcttgaacctgggaagtggaggttgcagtgagccaacattgcgccgccgcactccagcctggcaacagagtgagattctgtctcaaaaaaaaaaaaaaaaaaaagaaaagaaagaaagaaagaaagaaaaagaaaaacttcattggaaagtagggaaaactaccaacatttaaatgaagacaaaaataagaaaagttcagacataaagtgtaggctcttggtttaagcagaaatggtgttcttttggtggtttgcagttagtaagctgtatttgtactttgtgtcagttcaggtttctggagtttgtttaagaactggcttcattttccatattattaggagttgggagttcctttgaaaaagaaaacagaaaatttaagaaaaacacaaattgcaattttgaaattctaccattaaggatgatatcttaaaataagaattatgtcttagaaagcagaagtgagaataaaaacttttgttactgttattaaataatagtcgatatcaagtgtagaaagcaaataaatttaatctttcattttcaattaatctttaatatttcagaagtatatcaacattgcctaacatgctattttacacacaatagatatataatcaatgtttattgacttaaaaatctttggtttagccagataaatttgtaatattttatgaactagttaaccctgagtcatgaatttaccttttttttttttttttctggagacggagtcttgctctgtcgcccaggctggagtgcaatggcgcaatctcggctcactgcaacctccatttcccaggctcaagtgattctcctgcctcagcctcccgagtagctaggattacaggtgcctgccaccatgcccagctaatttttgtatttttagtagagatggggttttaccgtgttggccaggctggtcttgaattcctgacctcatgtaatccacccgcctcggcctcccaaagtgctggaattacaggcatgagcttctgtgcccaccatttttttttttgagatggagttttactctttttgcccaggctggagtgcagtggtgcgatctcagctcactgccacctctgcctcccaggttcaagagattctcctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtatcagattagctccctcaactcactatatctgttaacagttctgaagaaataggcactggctttgaatatggcctgttccagtttgtgaaccgttgtaggcaagtaaagttgttgggcacagaggtgacctgtaggatgactgaaggtaaactgtcactactgtatacaaagaagaaaaataagatgtaggaagagatctgttataataacatatgacatattctatctaagtttttcatatatttcagaattgtaaaaacaaaactatgtaattttttctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgtgttaaagaaacagatcttcctttaaagttacagcacattgagtgacatctaaactaatagacatttaaatttacatggtccaaataaggcaatgattgtttttacttgttcactgaaagcattgttcagtgctaagtggacgtatacacttaacacatataagtagtcattataaaagagaaaagagacggggcagttagttgttcaactataatctgccgctgaactcatctgtgcctttttattctcaccaggccaagtccttatactgggggaacagtcacaggcatagtgaatgatcctagacaagggctttgagagcctaattgtgttatatactatagaggattatgcttaggtcacttggattttcactactgctcaaaggaccaacacattagtgtttatttggcttcaccttggaaaatgaaagtcaggggcaaatgcaaaggtttaaagttccttctgatgtgaaaacaacaacaacaacaacaacaacaaataaaccaaaaaatcaaccttatacagagatactatatcttagcactcatcttcccctggaggctacttggacaataagactacacattgggaataaaccagaagccttagttactcaggtcatgcgtattagcgtaagtgaaagacaatgtggtggagcccgaaaaaacagactggcaatgacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaacttcatagatggtgactcttctttcaactttttgaaaaaaacaatggaagcttcaagaacaatttacaacttcaaggctaaaaggtggaatacaaatacctgaatttcttggccaacttctaatcctagggcagtaggatgtttaatctggaaaaaaaaatgttaatctattagttgttgtgcataattatgtagtgtccatggaagtacacattttttcctcaagctttattagtttttctgattaaaaaaatcagttagcggctgggcgcagtggctcaagcctgtaattccagcactttgggaggcagaagcgggcagatcaagaggtcaggagattgagaccatctctggaggtcaggagagtgaaaccccatctctgctaaaaatgcaaaaaattagccgggcatggtggcgggcgcctgtagtcccagctactcaggaggctgaggcaggagaatggcgtgaacccaggaggtggagcttgcagtgagccgagaccacgccattgcactccagcctgggtgacagagagagaatccgtctcaaaaaaaaaaaaaaaaaatcagctgggcatggtggctcacggctgtaatcccagaactttgggaggctggggcaggcagatcacttgagctccggagttcgaaaccagtctgaccaacatggtgaaaccctatctctactaaaaatacaaaaactagctgggtgtcgtggcacacgcctgtagtcccagctacttgggaggctgaggcaggagaattgcctgaatctgggaggcagaggttgcagtaagctgagattatgccactgcattccagcctgggcgacagagtcagactctgtctcagaaaaaaaaaaaaaaatcagttaattataaagatttaaaatacagatgtattaagaacataaaaattatccaaaacaggctgggtacagtggctcacacctgtagtcccagaactttgggaggccgaggtggaaggactgcttaaaccagactgggcaacgtgaagaaaccccatctctacaaaaaatccaaaaaaattagccgggtgtagcggtttgtgcctggggacccagcttctccagaggctaaggtgggagaatcacttgagcctgggaggctgaggctgcagtgagctgtgatcatgccactatactccagcctgggtgacagagcaagaccctgtctcaaaaccctctcaagttgtagataactactgctaacattccaatgagtatcccttcagat

SEQ ID NO: 4978 - DNA, 4419 bp, Homo sapiens
taggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacaggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgtgggattaactttgtttcaattcacagagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaagaaaaaaggaaagaacaattaaaaaaagagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaag

SEQ ID NO: 4979 - DNA, 1188 bp, Homo sapiens
gacagtgcctctgatcttctcatgacttaaacgcgatggaaggctcttgaagacgcatttatattacatattgggaggtacagaagctcaggcagaaaggtgttaaatggtttgcagaattgttgggaaggctaagcttccaggagcagctcccaaagtctccacacacaactggaccaccagggaacctgctccctccaccaggacaggacttggaaacctgccaccgcaattaccagcaccagaaggatcttgtctctgctaagtctctgtcgacatagtgaataccctgtgccctgcctctctctccctgactcaggtcccattccaggtcttgcccaagtctttctgattggtgggacttaaatcacacccaaaattccagctgcaggagagctctgagatttcatctttccaacctctgtgtgctacgtgggggttggagcacttgctgacaagccttgcaaccaccattgacaggatgtcctccaccttttcaatctgatttgctctttgccatgcagacctgtggatgaagagccagagtcctccaaggtgaagctggactgaatatttctgtccataagactattagaatcccccaaagtgggataccagtgaggacctcaccagcagctgctgtctctccaatgcagctccacagggcctgtgagcagggctggctatgagatcctgccctgaagagcagtactgggctgctctgctaggcacctgcatgtcctgcaaagccatctgcaaccatcagagccagcgcacctgtgcagcctcctgcgctctgctgacaagctcaatcacggtgtcattttactgccaccacgcccgaaagtacaccaaatgtaaagcagaggcagacgagacaagatgcaggctccaccagaggccactccagcttcgcgaccaacacccttggctgccaggcagcggtagccaggcaatgggatagaaggcaaagaaaatacgagggacagaacccatcagacaccggcagacactgcatttactccagactgagatgacagacacaccgtatgagctgcagcacaactctcctccgctgcgcccactgccagccaccagcagacaccaaggcacccagaggagccaggcacacagggcgggcagcaacataaacggcacccattaaaaagcaagactcgctcttgagac

SEQ ID NO: 4980 - DNA, 4827 bp, Homo sapiens
ggcgatttctggtctagggtgagagataacagaaagtaacaatggaggctctcgcagtgctcgcaggcactcaaggaacggaaaggaaattgcacatttcacccgtgactgcataggcaaacgagaacagcaagtctctgctttcagctggaatgttatcaacttcggtcacgctgattatctcaggctgatcaggaaggctggtaccaggagtgagtgactaaatgaagaaattactaattaacaaatgcttgggtggacaatccttcaaaatttaggatcaatgggaggagacagaaggagtcttgggaggatttttaaaatatgccagagctggctgggtacagtggctcacacctgtaacctgaggactttgaggtggagacgggcagaccacctgagctcaggagctcaagaccagcctgggcaacatggcaaaaccctgtctctactaacactataaaaagttagctgggcgtgttggtgcatgctgtagtcccagctactcaggaggctgagccacgagaatcgcttgaacctgggagatggaggttgaagtgagccaagatcgcaccattgcactccagcctggggaaaaaaaaaagccaggcctcctaatgtactcatttaaacatcacttgtgtccacctgggttcagaattgcgctggacatgggatacacaaaggtaagacatggacccaccctcaagtctgaaggtggaggtggggaagggcagaggctgtaaagggtcagagggaccttgtggagtggtggaaatgttccagatcacactgtggcggtggtcacatgactgtgcacacttacgacaacccatctaattgtatactgtcagtcaaagggcattatatgtaaatcacacctcaataaagctgaccaaaaagtggccagtcagccaccagcagacccatgggataggggaagaaaaacaagcaatctacagaacgtgggaaaatgcctatattaagaatcctggaatactccatgtgctttttcatgcagcgggagtggaattttcaggaagcagctgtgctgtgggtgacggtcatactttattctctaaaactctccagtttcaattggcctcttggtgccaaagcaccatggcgtgttacacctatcagatcgggcacactgccccttcttcccaacctacgagctgaaatggccagcactgcgccttccagaacccagcgtagatgcacagctgccacggaggtaggaagaatgattcgtttgccaccaaaagcccagtttctccaacaggtaagtcccagcagggtgcgatgtcccaaacctacacaaccgtttccactgcctattcccgggcccctcacttgggtcaaggcagcatttcagaggaagccaggagcgagaactcgtgcatccgaacccttctctgacttggcgggttattggattagctactctcagaagacccaaaaggcataggggagagaagagataaatctggatgcggtggagacaacggccaaacagaaaaaccgcttggagaataaaagtcgggggaagcctgtagtggggacgctagactcaagggaaggctctggaggaaggaagaggctaaaggcatagtttcgtaacccctccctacaaactaccccctttccctctgcccaagtgagcacagggaccgccccgcagcaagacgacggcagatatttaaaatgtgaggaaccccggccacagcgggcggggctccccacccatcacctagtgtcctcactcactgcactccagactttgtcaaagtggtggcagctgagtccagcaccagagattggtgatgctcgggttgatttcattgtcaagtgcatctggcaggactctagtttgtcgacagtattccagacaaggtgtagctggctgaaccgcagtgcctcggcatttgggaccattgaaaaatactctggattctttttttttcttttgcaattgcacaaggatttacttatctctcttcatgggtgaaactgatttggggggaaactgctagactcaatgaccagttggactgtaggcaagaaggcccatgattttgttcctcagataaaagagcagcagggaaacaggaggcctctctcctgcaaagctggtccaaagtgcacacaaggcatggctgagcgcctggtgatgcacagtcagcagacgggcgagacccaggaacgtgtactgtaacaagagagtctagtgcaggttgttgggggggcttgaggctatccgctgacatcttttctccccagtcaggagacagtaggggagatggttctcatagatcaagtcgggctttgagaaggaaggtgaacaggagaaaaaaaaaaatagaggcctcagaaagcccctccctcccaagtctctcctcacaggcgaaccacgacagatggctgcgcggcctgagggccggcctccaggcagccagggaggagcagctgcaagtcctgcagtctgtgagacccccgaagggtctgggccagcatccaaggctaaagccttggctatcctaacgccgcagtggggcacttaaagctcctcacgcccaagcccaggcctggtgggagcacggttctctcccgcgctccccctcctccccactccacggccacccttccttccaatcgtccccctggagttcgtgttggaagatgccagtgagcacgtctcagggctctacgccttgcacggatgagtatggggtgactcagagggaaggggtggtggcagatgcctgcagctggctcccagccaggtttggccatcctgcgtaaatgcctgccttgggtcttggcctaatactaagggcaaatcccaagaggggtgagtgggcttctggaatctgagcaattctgctttcaaaacaggtgaatccctaggccagcccggccccttcccacacacccctaccccgagacgggtgcagaatcagcagcggggatcatccagagactctcgcagtccacggcaggtgtcggagtgggcctcattccagagttgtggtggccgctccacctggcgagcttcgaggggactccggcaggcgctcgctgtggggtcctcccaccagtcttctcagcacaggaacggtgccttcacattggtcttccggggcttaaaagcatatcattcctgcttgctcttcagatgcaaactccccctccaaggatacctccaggttccctgccagctcacttgactcacatggcaatggtcaccgggctgcctgagcccaaatcaagcaccgtttattagggggaagctccgttatccagaaagctcatctttgaagagctacccatttcctgccaaagttgtggcgggaaggccttaggtactagaaaaccttggggaatggcaattaaaggattatcattcttacttatttgtttggataagcagcaatcacccttcggatgcttattggtgagaatatttctaaaagtgtcctgcacatttccctgctttgatgaatggaacggcagggcaggatttaactgtctgatggctacggttttgggaaagtgccagaacctccacgtcagccaccccagagccacaggcagggtatgagccacagcaatgggccccaagaaagagccccacacccaccatggtccacggaagacgctgcttactggccccgggttacctggagtcatgtgcattctccttacatcaagtgaagataatattttgtttccttcccactttttctctaacacaagccaccccagttctcccttctgacaacaggcaagtggaccctagtagaccttccagaaaagccttagagagcacccccaaatgctcacatttgtcagctgtaattccaccctcagttaaaacctgattctcaatgtgacttggccaacgcagcttgcaaagcaagaacgtcttcatctaaggttgaaaacatcagttgtttgggttgtgagaaaagaaaagcccacaaggtttccgaggcttggtgctgtttctcactgtcctcagctcctgattctgcagctggttctctctccaagcactagcaaaaccctgccctaggagcccccagactctgagagcccatgaccaaaaagaaaaggaaagccaagttggggaagaacaggggcccccaactccacagccctccactctgcccagagggcccaccctgggctgcctggaaccccctaaagttgccacccccgcaacacagtagtggggcagttcctggcagcgcctgcagcccatgggctggctctgtacccgcagccccgccaagcgtctgttatcttatttactggaatctgcacagccaggctctagctcaccggtgactaaggagctgcagccattattaccaggcagatggcagactccctaaaagcagacattaaacaataaaatgccaccacataccttgcccacaaaataaaatcaaaacaaacacctaagtctggctttgcttttcttctgctctctccctacctcccctgggtcagagcacagggggagaggtgcacggggcaccgagaaggaaatttacgatcgaggaagaccatacggacatgcccagtgaccttcagaaggtggcagtagcagaaccaccatgggaccccaggtggcggagagggcagaccctgtccatgtgtgacaggtggggcagaaccaccagctaggacaggtgggattggaagaacaaaggaacgacagggaccctgcagaacccacagccctctcgcctcagtcgcctgatgaatagtcaaagtgctaagacctggagaattccatcaaaaactcagttgctccca

SEQ ID NO: 4981 - DNA, 429 bp, Homo sapiens
taaaaaacaaagaacactttattcccttgacagtttctgtacagcgacaccaggctgtgcaaagcccagtgtcgtcttcactgagcacattccccaggacgcctggtgcagccctcctctgccccaggccccaactagccacccctgtgcccactagcaggccctgtgccttcacagggatgaagccctggcactgagaatgcctgggaggcaccgtttgctggggagcagagggactgacctttggcttctttgtggctggaggtgttccaggcctggtgagggggtcccatactgttctctgctgagccctctgcacactttgggggatcctggctggcggtggtaggtgggccggagactcagttgtccgtcagctggccatgtccccattttatggacagggcaggagcacaatgacgtggccag

SEQ ID NO: 4982 - DNA, 265 bp, Homo sapiens
tccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcccacag

SEQ ID NO: 4983 - DNA, 5334 bp, Homo sapiens
actccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatgaaaaattttagaaaatcattttctactcactattttatgcctgccagttatcctttgttagtgataaaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatata

SEQ ID NO: 4984 - DNA, 706 bp, Homo sapiens
agggttggtactcacggttcctttaagggcatccacttcacaggtgagggactgcacctgtctccggtactcagtggactcctgctttgcctggcgcagggcgtcattgttccggttggcagcctcagagaggttcttggcagccacactttcatattgctgacgtacgtcacgcagggcagccgtgaggtcaggcttggaaacatccacatcgatttggacatgctgttcctgaatctgagcctgcagctcctggatttcctgcaaaaagaacagacagacggtcagctctgccaaccgtgggggctgccttaccctcattcattccccgaaagtcactccactaacctcttcgtggagtttcttcaaaaaggcaatctcttcttgcaaagattccactttgcgttcaaggtcaagacgtgccagagacgcattgtcaacatcctattttgaacagagaaaagacaggacatggaggatgtaaaagtgtatggcttatctcatttatttgtcttagattaaccatctgaacctagtctccttactatagaaaagccgttgacacattttatgaccctggaataggtttataaatcattcagtgctataatatgctgtgctttctcctgctcactaatatattttaattgtgactgcttgtgttttactcaaggtggtgatcagacaattttaaaataaataaatg

SEQ ID NO: 4985 - DNA, 2021 bp, Homo sapiens
caaaaaacatctgtttgcctagactcattggttacaaatatgcttcggctaagagctatttgtccattctcctggactgtgtttcaatttcgactcatcagttgtgaaccactcattattcagatgaataagtgtatagatgaggagcaaatatttgattttattgaaagaaacaaaatcatactttcagaaaaacaagtgggatgtacatttaatatactttggaagcttcaaaagcagaagatcagtctattaaaaaatgttgagtatgtcagagaccattctcaatttcttactcttcataatttagctacaaataaattcaaattaatgaatggcaataccctggtgaatgtgttatacatcacacaacagtttgctggtgaggcccacgatccgctagttgaagcactagttacagaagcatggggtaggctagaaaggtttgatattaaactgctgtcagaattttcctcttgcttagcagatcagcatttgtattttagtccattaatgggaaaaatagctgatattgtccataggaacttggaaaccatccagaacttaagttccttgtctgtcttgatggtcaacatatcttctttaatatcacgacattttcaagaacaactggtgaacaaaacggaacttgtttttgacaccacagattcttctgaggtcaacgttgcaaaaagaatggtacagtttcttcgaaactttagatatcattatcaaccactattagaaagctttgtaaagttttttgtagcattgggacccattgcaggacctgaagaaaagaaacaacttaaatcaactatgttattgatgtcagaggagctaaccaacgagtaagccctggtagtgttgggaacaatggaagatatagaaagcagaaattcatgtctgattaaaagagttgcttcagttctgcacaaacatttggataactataaacaattagagttgttgaagataactcaagcattgacttttctgcatttccaaagtagggagtttttttgtgaaacttggagaattattgcttagttatttgaaaattagtttcataccaactgagatgtccattctggcctctgctatttccctgctcccttctcctcatttggacgaagtgggaatatccagaattgaagcagttttaccacagtgtgacccaaataaatccatccatttagaatccttgctattactcttccattcagaatttttaactatgatccacctcaaagggatgaagtttttggaacttgcgtgcaacatcttaatttctacttaggtatattggatcctcttatgttagtgtttcttggtttctctttggccacacttgaatattttcctgaatatctgctaaaggtaattttaatatcaaattcttagctagactggattctcaacttgaaattttatcttcatctctaagtgcaagagtccagttttgtcttatggaactaaatagatcagtctgcttggaatgccctgagtttcagatcccatggtttctcgactgcttctgtcagcaatataataaaggtattgctggcatgaatgtagcacaacagcagatttataaaatgttagcagaggtactaggaggaatcaattgtgtaaaagcctcagttcttactccttattaccatacagtagattttgagtgtatcttggaagaaagaaaaaaatctcttctttatggaagccataatataacattgggacaactaccagaaatgccctgggaatcaaatactgaaatagttggatcaaggctgccaccaggagctgaaaggattgctttggaatttttggattcaaaagcattttgtagaaatatccttcacataaaaggaaaatcttctatgaaaaaatgacatttggaatttttgggctatcatataattcagattccttggtttgaatggaactctatggcactgtcaacaaaggatgcttggatggactacctgagagaacatgcatttagagaagtcgaatcatga

SEQ ID NO: 4986 - DNA, 14927 bp, Homo sapiens
gcctcccaaatgtcaccttgagcgctgtccgcgatcccaaaaagcactgttaaagagaagcggggatacactggggtccttgcgtgggggccgcctgggagaccatgcaccgcccgggagtctctccgggcagggtcggggagggacttttttgccggtggccgtggaggaatcgtcccgttgagcaatgaccccggtgacgcggctgagggctataaaagcaaaagttgtgaccaagggctgtgaacccgcctggggatgaggcctggtcttgtggaactgaacttagctcgacggggctgaccgctctggcccagggtggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcgtcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctctggatgtgagcattgctttgtctgctggtgactgaacatctctaccttgtgtcaattggccatttgtggtgtgtgtgtgtgtgcgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttgtcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctatgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtgtatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattctaggaaagcgtctgtgacatttgtaaaaagtggtatttaatgatcttttattcacttgtctgtttagtttgttgaaatcttaagtggcatcctggtctgggaaggagtgctgtctgcgcctgccctccgctgggcacagcgtggctgcttcaggggctaagcacacactttctgtcttctaaagggccgccacatgccaggagctcaggtgtgagcccggctctggctcttacctcatagggtcactcataggggcacagggagcagaacattgtacacagcgaggcaccacccggcttggcatctgcctcggtggacttactacctctagaaggaaatacctgagttcctctggcctcagctcctagagtgactggtgtgctgtccctgttactcttctgtcaaggtgacaactgtgtgacccatcatctgtgtgtcaaagcaaggccctgcctgggcctctgctcctgtgctgaccccaaaggcaaatgctttgctagtttccttccagttaatttcacctatgaatagatgtgtgaaaactgttcaaagccatacctgcacatgtttgaacttcaaaccctgtgggtgattcagtggcatctttctctaacccccagcctcccttcccacagaggccaccgtcatggccagttgctgcagtttctttccagagaacctgtgtatgtgtaaagctgtacaggcgtgggtacaccacacagcctgtcttgcactgtggactgttgagttactagtacatctagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtg

SEQ ID NO: 4987 - DNA, 3614 bp, Homo sapiens
ttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattgaactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtatgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatatgtggcctttttagattggcttctttcattctgcagtatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaagaaacaagattgcggggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcagttcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccgctgggtcagagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaataaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagccgccgaccttcacgagcgctgattggtgtgttttacagagcatggattggtgcgttttacagagcgctgattggtacatttcacagaactcgtgagacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggagagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcacaa

SEQ ID NO: 4988 - DNA, 13518 bp, Homo sapiens
cacgcctgcaatcctctagcactttgggaggccgaggcgggcggattgcctgaactcaagagttcgagtccagcctggccaacatagcgaaactccgtctctgctaaaaatacaaaaaattagccggcgtggtggcgcctgtagtctcagctactcgggaggctgaggcaagagaatcgcttgaacccgggaggccgagatcgcgccattgcactccagcctgggcaacaaaagcaaaaacgccgtctcaaataaataaatgaaataaacttagtaaactatttttaaataatgttaaaattaacggtgtacgtagtagaactgtgagagatctcatcttggaaatagagtgatatacttgaaggcaagagattgggtcaggtactattaacacgttttacacatgaacaaaccgacactaagaggtaaggtaatttgcttatgattgagttcccaagtacaaagctgatttttgaactaaaatctgactcgaaaatctgctcttttcttatcaggctgcttcctacaaaaatataacctcgcttagcatctgcttgttaagcatccaccctcacagctctttggcattcaaatgtttgttgagtaggggtaatagagcactacgttcgaatcagaaaatgccttatttttccttgcttgcaagagcctattataaataaatgccttgttttcgctgtgtctctttcttgttgtcgagagctcaggctggtcttaatttctgcaaccatagtattatctcccaggtctccttctgccctgtgtattttgcagttatgctttatgtggagatgaagcatcctaagtgtggagaacgatatatggggcccgaacaataggtgctgaagccagattgtgtgactaaagttggtatttgaacaaaccaagtgtttatttttttaaagagcatggtaaaaactaagtttcaaaaatcgatgctggcaaaaatttccttgaaaaaattctcaccaagttcacttgcacggtactacctggggaatgaaacacatttgtcaaggacacgcccaaaactatgttgctgttgtaattttcaaagactgggaactgcggcagggggagttacaattaaagcaaacatcggcgtatcagtttattcattcagcaaacgtttatgaagcaacaaacgtatgcccaatatttcagtcttgctgctcttcctccccaaattcaggaacctttgcaacggaaagcggcctcgggcaggcgccttttgagcagaggagtaaaaccggtaagtcagcagtggaacccgcctccccggaaatccttggagggggcggggccctggggagcgcgctcttcccagcggcagctggggaggcgcatgcgtacttgcgtcatcgttgggtagcagcggggaggcgtgggaggatctgaggcctgcggtgggccttggtcccttctctccccgccccgaagccgcctgctcaacctgagggccaccggcctctatccgtcggtgccgatgctccttgcttcccagccagagcgtctcatctctgggcccggagccccaggctcgttctcctcagcccctgccggcggcggcgctcttgcagccattcctgtgaggtcgtttttcggagcagccgggccggccgaggagtaagtaggcgccagagttctagctcgggcatctgcctcggggccctgtcgccgccgcgccccggatcctgcgttggtcctgtccgataaagcggaggtcggccctgcttgctgacgagaccgtaaaaaccacggcgcttggcgccctgccgccgccacaccacaccaaagtgtacctgcccgaggctggcttcgggcgcgagcttgcatttgtgactttctcttaccgtctttgtttgcttcgttttaagtattacttccagataagggacacattctcgaaatactttgaaaacagttttgaattttgttcctcccgttgaaacggattaaatttggacctttcaagctacactgtgcaatcatcaatctcaataagctcttaataggctcattcttccgtaggctacaaacaaaataaagatcataacatcctgcggaggaagccattggtccatgtagagtcgccagatgtcaattaagagtagatcgcttttcagagaatacttaacgactctggtttagacctagacttggaactttgaggtgtttggaacactgggcagaattttcctttgttacaaaacaaagtttatgagaacgtaatttgtttttgttgtttttgttgttagtattgaagcaattttggtgcaaaccaaaggataacaaagcaaaacaatgaaaatcacccagagttccattacccacactgaaccaacttgaatatattggtttattttggcttttttccatatgaaatgttaaattttcttgtactcacgtgtagaatatgatagtttgctctttcatgtaacatgtctcccaatttttacatacataattctagtttcagtaagcatttttataactacactctttttcctttgttattgtatgtctaggttatttcaactttgcactgttgcttgtaactactatgtgatgaggcagtagctagattagtatttagaacgtgagcattcaagtcaggcagacctgggcttcacaacttactgtgcaatttcaaagagtttaacttttttgagcctcattttacacagtaacatggggataatggttctgattgcatagaattattatgagagtaagatgaaataatgagtggaagtgcctgcagcatgtattgttagtaaatgctgtattactgcaggcaaatttttcttttgttgtggttttttggtgacatgtatgatttatttccagattttgaatatacttaaatactattaaccacagtaggggtatggggtttgatccacagcttttcatatattttatacaatatattgtgtgtttgatacacagcttttcatatactttattataagtaacacatgaattagaaataatttttcacaataggaaaaactttttaaaaattaaaatttataatcctgctaaccgtaggtgaatagtcacattttgggcaatccttttttatgcatatatatgtagtggttttattttattttattttatttttattttttgaaacggagtcttgctctgttgctcaggctagggtgcaatggtgcgacctcggctcactgcaacctccgcctcacgggttcaagcaattctcctgcctcagcctcccgagtagctgggattacaggcgcccgccgctgcgcccggctaatttttatatttttagtagagacggggtttcaccatcttggccaggctggtctcgaactcctgacctcgtgatccactcgcctcagcctcccaaagtgctgggattacaggcatgagccaccgtgctgggcctgtagtgttttctaaaaatagaattatattataaattgggtttatcaacttgctgaaaatggcagaggccagtgcgatgagagtagggtgattaagggagtaggaagtaatgcaggaaagggagtttgtaggatttagatttcactgaaagtgtactggacaggttgggcatagtggctcaggcctgtaattgtgtcactttgggaggctgaagtggaaagatcccttaagcccaggagttcgagccagcctgggcaacatagggaaaccctatctctataaaataaaaataaaaataattattttgaaaaaaaagtttactggacagagtaagttcagggttgaggagtgacctgatttgttttagaaggctcatttggctgccatatggagatagactgcaagggaccaggggaggaagatgcaatccaattaggagagtatttaagtaatctctgtgagagatggtgttagtttcgatcagggtgtaagtagggaaaaatgattgggttctggatatattttgaagggagaagttataggattcactgattgatgggatgtggaattcaagagaaagtgacttaaagaattttggtttgggcagttaaacagatacagttgctacttaccaagatagagactgaaagttgggggaaactaaatagagttctgtttcagtcatgttacctgttgtggagtctaactagttggaacaggagtatgaaagacttaatcttctgttcttgaggtatcaatttgtcccttcatttctgtcagtttttgctacatatattctgttactaggtgcatctatccttgtaaattgttacatcttccttgtgggtttatccttttatcattaaaaatgtttctctttttctctagtaacattgttttaaagtctattttgtctgatattaatgtagctatttcagttctcacgtgattactatttacatgctttgtatcattgactctaaaatgtgtctcctgtagacatatagttggatcttggtttgttttttgtttgtttgtttgttttttgttttgagacagagtcttgccctgcctccttggctggagtacaatggcgtgatctgggctcactgcaacctccacctcccgggttcagacgattctcccacctcagcctccccagtaactgggattacaggggcccgccaccacgcccagctaatttttgtatttttagtagagacggggtttcaccatgttggccaggctggtctcaaactcctgaccttgtgatccacctgcctcggcctcccaaagtgctgggactacaggcatgagccactgtgcctggccggatcttgttttttttaatctgataatttctgccttttgatccaattgtttaatcattcacatttaatgttattgatatagttggatttatgtatgccatcttatttttgttttccttatgtcttgtctttttcttttcctgtctctcctttactgctttgttttggatcaagtgaatatcttctaatgtagcattttaatttcttgaatgattttttacactgttttaagttttttttagagactgtagtggtgctctagggcttaccgtacaattagcttaacttattagaatcagcttcagatttatactaactcaattgcagtgagatatagaaaccttactccaatatagttttattccatgtccctgtttttttgtggttttgttgttgtacatgttatagttgttacaaactcaacaatacattactacaattattacttttacatcatttaaagaaaatgaacaaaggaaagcaaatatatatttgtagcttttgttatagtaaccttatttatcatttcaggttgtttgtttatttttcttgtggattcattaccatctggagtaattttgttttctttttctttcttttttttttttttggagggataacagggtcttgctctgttgcccaggctgctggagtgcagtgtcatgaatatatctcactgtagcgtcaaactcctggactcaaagtgatccttccacctcaacctcctgagtagctgggactacaggcacatgccaccaggcatggctaatatttgtattttctgcacctcagccttctgagtaactatattactctataagcacacatcaccacacccagctaatttttaaattttttatagagacagagtctcactgtgttgctcaggctggtctctaactcctggcctcaagtgatcctccagctctggcctcccaaaagtgctgggattacaggcatgagttctttgtatgagttccttgtatattttggatattaaccccttgttagataaaaggtttttcagtattttctcccattccgtggactgccttttcattttgttgtttcctttgctgtgcagaagcttttttgtttggtttagttccatttgcttatttttgcttttgttgcctgtgcttttggtgtcatttacaaaacaaacaaacaaaattattgccaagactaatgtcatggagcttttccactgttttcttctagttttacagtttcatgtcttacacttaagtcttttcacttttttttttttttgagacagagtctccctctgttgcccaggctggagtgcagtggtgtatgatcttgactcactgcaacctccacctcctgggttcaagtgattctcctgcctcagcctcccgagtaggtgggattataggcatgtgccactgtgcccggtttatttttgtatttttaatagaaatggggtttcaccaggctggtcttgaactcctgacctcaagtgatccacccgcctcagcctctcaagggactaggattacaggcaagagccactgcgcctggcctcttttaaccattttgaattgacttttgtggatggggtaagataagggtccaatttcatttcttggcatgtggttatctagctttttcaacaccatttattaaagagactatcctttctttattgtgtacttttgacacctttgttgatgattagttggccacataaacgaggatttatttctgggattcctattctgttccattggtctatatgtctccttttatgccagtaccatacagttttgattactgtaggtctgtaatataatttgaaatgaagtgtgatgccaccagctttgttcttcttgctcaggatcattttagatattctgggtcttttgggttctgtatggatgttaggaattttttttttttttctgtgaaaaatgtcattggagttttgctagagattgcgttgaatctgtagactactttgtgtattgcagacattttgacaataatgattcttctgatcctgaacatgggatagctttccatttatttgtgtcatctccagttctttcatatatgtattatagcttttagcatacacatctttcccctccttggtaaaacttattcctaagtattttattccttttgatgctattgtaaatgggattgctttcttaatttctttcttggatacttcactgttagtgaagtgtaattgatttttgtatgttgattttgtatcctgaaactttactggattcgtttattcattctaacagtttttagtggcgtatttagggttttctgtatataggatgatgtcacctgcagagacaattttacttcttcctttctgatttggatgccttttatttcttttccttgcctaatttctgtggctaggatttctagtactatgttgaatgtaagtgataagtgtgggcatccttgtctgtccttgtcacattcagttgtatgtgcaatactggaaccatccagctcatagtcacgtaattcctctttgtgcagcctcatgtaaaatcacacccctattcacatttttttctgtctgtctcccacctctccaggtccctgccctgcaactttcagttacttcagactctcagaagactagcctctaaatacctcaatttatctgcactactgtggtctacttgaaattctcttccctcttctgcagtttgtaatggcattcaggccaaaaactgtagtagttttagggctctcttcatttgcttctctgctcctagggatcatagtgctgtgctatctgttgtccagcatctgacacagttggttttatattttgtctggttttctagttattaagcaggttaagtctggttcctgctgttctatatagcaggaagcaaaggttctctcatgaatttttagcataataacataagcgtggattccaaaaattcattacacagatcctggaaatctgtttactatgttttatacattctgtgaaagctggagaatatatatttgttttactatgtgtatcgcaaataaaatatcaatttcatgtgccagagaattgaatacattatcaaagggtcatttcataacgttataatcaccatccatcctgtaagtcctttgaaatttcttcttttctatggatctaacattgatcaataacgaattcctaagcatctatattagttagcccagtgtttctcaaagtccaccgcatgtaaaaatcatctagggaatctttctaaaatgtggattctgatttagtaggtctggggtgaggtcttcccttttgcaattccagcaagttcccatgggatgctggtactggttaatggaagtcacttagagtagcaaggagcctgtttgcctagtatttacaatgagcacgttttgggtatcatcaaaacaagagaatctaaaaatgtatggtgtgggtggaaggttgtgttacttgatatttcaaaaagatcattgaaatcagaaaatctcagagatatgttggatttcatcacatttattctatggcttaatgttgttttattttgaatatataataagagagataccacaaatctttagctattaatatttagggatgttaatgtccttaattcatattgtctcaaatgtgattcattccctctataggtatactaaaacaggcattcatgcctacaaaaccatcttcctaactttctttcctctttttagtctcttcctgaaccagtgacagtggttctcaaacattttggtctgaggacccctttatggccttaaaaatgatcgaagagcttttatttatgaaggtaatacctgctaatacttgttgtaatctattaacattgagaaatgtaaaaatttttattaattcacttaaaatatcaataaacccattatttgctaatataaattgcactttttaatgaaaaataactttagtttctactgtgtgcttctgcattttgaaaatatgtctaggatacggtatgtatttaggagatattttctaaataaatgcatattcattttttaaaatgggacaaatgtagcatagacatatttttgctaacaatatccatatagttgcaaatttcacttttagaatttgctttcaaaaacaggttgtttattcttctttgttatgccttagttagtaaatcatatattataaaacttcttcaatgcaattggtctttggtcagccattgacataggaagagttagaaagagtccagggctccttggtactggctgtgactggataagtaggttgtggcttagtttgtgtttaggtgtcataactaggctaggtttgggtcccagaaagtgctagccttactgtaggagaggaagtggtattgctgggtgtgtcctcaggtcaggaagtgggacgagtgcagtatggaagcccaggggggtccttgtgactggaggaaaggtgaggtttccagtaaaggattcagaattcgggcatggtgcagcatgcctatagccccagctactcaggaggctgaagtgggaggatcacttgagaccaggagttcaaggttgcagtgagctgtcattgcgccactgcaccccagcctgggtgacagagtgagacctgtctcaaaaataaatacataaaaataataattaaaaaaaaaggattcagaattctagaatacatattatctttctatcatgcagatctgttcttaggattgtattttccaaatcatgaataaaataatttccaaaatacttattgggaaattatatatatgtactgtattacttggaataaaaatcaaataaaagtcaaacttcttaatgtggctgtaaagccttgattatttaaaccttgcctatttttcagtttaatctttcagccacactggcccttgtgttaatcctaaaacatgccatgctttttcctacattaaagcttagggtttttgatatttctactgcctggatttctctgttctcactcttcctcttgatcaccatgacttatttttcaagtgttggcttaaatgtccgtctcacagatagcccttatctaaataacagctttccctctggttcctagataaattaggacctgtttttttctataactttcttaaagtatcctattattttccctgataaaaccttgttggactgtttgtcagtatatttatttgcctgtttgtttggtgtcagtttctctttttttcctgtgtgttttgtttgtttgtttttttgagacgcagtttcactctgtcaccaggctggagtgcaatggtgcaatctcggctcaccacaacctccacctcccaggttcaagcaattcttctgcctcagcctcccgagtagctgggattacaggcatgtgccaccatcctggctaattttgtatttttagtagagacagggtttttccatgttggtcaggctggtcgcaaactcccgacctcaggtgatccgcctgtcttggcctcccaaggtgctgagattacaggcgtgaaccaccgcacccggcctgtttgtttgttttcttattagactataaactatatgagatcagaccatgtctcttttgtttatcactctggcctacctgctaacacagtgcttacacataatagtaggtgctcaagaaatacagtgtttgatggatgaacgtaaaattgtaagagcctgaactagtgtaatatcgaaaatagggaggaagacatgaattaggaaagcctttgaaaaattagcatgttctgtgataaagctacatctaggcaatattttttgatacttttaaaaaaaaaactgtaatagctacccaatatttaggaatgatacacatcacacatctcagtgaggtatgtagccttttgtactggtgaagagagccaggtgaagtctaactctaaggatctaaacactccattctagtagagagcctggagaagtgctcttgcataagctcatccatgtaagaccatccataacttagtgaaataattttcattgctgtttagttgcaaaaatcactcactgttttgcctccataagattatcggttttagtgtttaatcgttcacagccttgtcaaaaccaaaatggctagggagagaactatttccctacattaaaacttcgagcaatgctcttcatagattttgttttgaattgtttaggcccatctcagagttcaagacacttagtctcttctaagagaaatcatggtcacaacaaacagagattaaataaagagcaagaaattagaagaaactcaaaccattcacttagattatttgttagattttggccttaaaaagagacaaagttgcttgaaacaagtgattaaactgacatttttagattattattttattcatacctttattgtgaataaattggccacatgataacattttataatgttaaataaatatgatatatataaatctgtataccacaacaattaaattggagggcgatttgccatttaaataatttatcataggatttttataagatcaagcgcttagtgcatatcaaagagacagaaagttttcattgcagttctgcacgttcactgagtaccttttatgtaccagttgcattgttctagaatcttatctatcatgtaaagctaggtacacctgaaatagtttagttatggtggcaaagttagactgcagttattggctgggaattttttgtatatctatgtacatcttccataagagggcagcaaaggaccagcatgattttttccttatcatgaagtcatagcagagattgcctcatattgcaaacttaatagaaatcttctcagagtaagggcaaacagagggcatggttacaagtttacttactgtctagcctgtcttttatatggtctgatatggctttttagtacatagattatctcacatcacagtgatagcctagtgattaaatgttgatcctggggtcagttgtcaggctttaaatcctggaaccataacttaactagcttcgtggtctagaaagactactcagtctttctgagcctcagtttcttcctcaattttttataaaaaggagggcaagggatagtaacaatgccacttcacatggttttaataaacaaaataaaatttgtgtcctgaagaggctaagaacagttaaaaggtggagctagaaaaaccaccctatactagccttaggtgtattgtatttatttaagttaaactcttattaaaaagagtctcataaaggaaaatataggtcattactttctgtaactacttagtatttttagttaactaacatatatatctatgtactgaccaattatttgctcgtacaatttatcaaaccaattaaatatacactgttaaatttatttccctgtcccccgagacagatcctggctacgttgcccaggctggagtgcagtggcgcgattttggctcactgcaacctctgcctcccaggttcaggcaattctcctgcctcagcctcctgagtagctgggattacagaggcctgccaccatgcctggctaatttttgtatttttagtagagatgggatttcaccatgttggccagggtggtctcaaactcctgacctcaggtgatccagccgcctcggcctcccagagtgttgggattacaagcatgagccagcacgcctggcctgaaaatacattttgatgaacaaaaaatttttaatttttttttttttttttttcctgagacagagctttgctctgtcacccaggctggagtgcaatggcgtgatcttgcctcactgcaacctatgcctcctgggttcaagcaattctcctgcctcagcctcccgagtagctaggattacaggcatgggccaccatgcccggctaattttttgtatttttagtagagacgggatttcaccatgtttgccaggctggtctcaaactcctgaccttgtgatccgcccccgtggcctcccaaagtgctgagattgcgggcgtgagccaccactcccagccaaaaattttttaattttaaaagtcaatgtatatcatttgtattttatagttagtgctttttttgtattgtttaaatttttaaaattcttccattaatctaaaatattttcatgtgtgctttctactaagagaatttaagttttgtttttgacattatagtttttaatacatttggatttggatcttatatcttgtatgatacagaactctaattttcgcctttaactacatgcataatcattttttccacctccacttattgaatagttcctaattttcccatcaatatcatgtgtttcttctggcatagccaaagtcccataaatgtgtgggtctgttgtagtttcctatttaattcagttaatttgtccaatttgttttattatgccttaattaccacagcttcacagtaagtctttatgtctgatagggcagcttcctctagtgtcttcagaaatttcctgactttaaaaaaaatccttattgttcatgcttttttaaagaattagctttacatgatgcaagaaaaagatctgttggaattttgattgtaattttgttaaatctataggtcaactaattacaatattgaatcttcttatgcacaaacatggtatatttctccatttattcaggtctttatttaatgtctcctaatgtctttttgtagtttttacttagagatcttacatatttgttattatatttactcctaggtacttggtattctctaagattattgaaaatgctg

SEQ ID NO: 4989 - DNA, 956 bp, Homo sapiens
caggcactgaagtacttgatactaattggatattatgaccacttttcagcaattgtattactgtaatggtgggatccataaaggaaatggtaaacctgtcttatatgggtagttgtgtgaattgcaaaacttacatcaaataatttttttgcctcgtcttttgaacaagtcatgacatcattctagttcctttttcaacttagtgagatgtctgctctgtgttaatattataatgtgtataatctacaacagaattgtcctccaaattgcaagttttcctttttgaatctaatatatcaggctcatttttagatgacttagatgcataaggattttatcgtagcttgatgttagctctctgtaacctttcaggtatattaatcaaaaaagccaaacttaataaagcatctaatttaaaatggattgatctcaaatattttatagccactatcttttcacaatagtaaaacataaaagagtttaagctatgccaatttagagagtgcttaacaatgtgtaattactttattttcacttaatagatttttacctgtgccttgtttcagatctgaataggtttcctttgacctcaaaatcactaatgcagggaaaattaccatatcatgagagtatttttcctctttcttttttttgcctgatgcttagaataataaatactcccaaggcttaggagtagacatggcctgagagaaagcctattaaatgctattttctaatggttttaaaaaacaacttaaacaaatcatgctactcaaactgattttcttgctaaaacagaactagttttagagtatattttagacatctttttttctcaattactagttaaacttgaagttgggctctatctggatttgctttatagatctgcttcatttcatgccagatttgggcaaaccatgaacaacccccaactccaggaaaaaaaaaaaaaa

SEQ ID NO: 4990 - DNA, 4001 bp, Homo sapiens
gtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgctcctcacctttgacctgaaccgccaacttcccatcctccacttttggagagcgcgcctgatagctgctgcccacctgggcactgacatcctccttccgaccgggtgcggagaaagcacaaaggaagtagaccaaggagactgaaggtggttatgaagactgtgcatctctgaggacatcttaaacaaagatgacccaaatctttgatcttcaaatagtcgatgtgaactgcttaacaaaatgccctgggaaaactctgtctgaaacaagcagcttgggggtttgatttcattagttactggacaagaactggaatggagtgaaaaatcttcattcatttcttggtcagatggagagaggagaaaaaaagaagtgggtttccattcacttccattttctaactgatcattagttagagaacctttggaaaggtttagctcagttttttcttccaacttatcaggttcctcaagaaattcactgccttgagatgactttgataacccatccaaatccagtgacttaaaaccgttattacaagggctcttgctgttgtctgactctgacatcattgaatccaactcagagattttgtcaaggtaagcagcatccatcgatgcttcactggatgttcttgtccggttcatttcaaaagagcgaatagaattcaaccttttggataaacataagcctgatttctcactcaattttgaagatatttctccaacagaatttgctatcgtgttcccctctgaactttcaaaatctaagttttgggcatagcttgtggaacaacagtcccaaaatcctgtctttggggaagaaaaacattctgatttcttttcattttcacttctacttatatcatcttctgaagaatctttattagaaacatttgaagaatcacaaaaatcatcaaacaccaattttctgagatggtttgagtgctttttggaacctcctgcttggaccacagagctctctctattttctggagtactgagctgaaggcaactaagggacaaaggagtacaaggagctggaagatcataaagttcttcatctttgtagggtacacagtcacttggtttattcccccattctctttccaaataagtatccatacttgtatctgtcacatctaacattacttctacctgttcttgatataggtctttgttcttagaacagttaaggtctgctttgctggtactttcctgccttgcagaactggtgtcacacagtctgctgctggaaggcttcgctaggtgagaagaactggaggtggatgagccaggctgctttctggcactatcgccttgattctttgacaccacatcctcctcactgcctttgctccctttgccatctgcagaaagtgctgtctggcaaatggaattcatagcttctttctcttcacttgaattttttagctgtgcaacttgagattctagttcctctatatacttatcacttcgttccagggctttcttgaggcgattggtttcacgctcatactgttctactttggactgaagagcagcaactgcaaaccttccaaacctacaaagaatggaaagatagttaatcttataactcaagcttttttcttttcaaggtttgagagtgcaaactgtcccaggctattctaatttcacctaacagtgacatttcagaccactcaatgagtagggcaaatgccagatgtatattttcaaaaaatggtttccccacttacataataataaacatatgataataatagcaaaacctaataggatatttttgtggttaaatcagatctatggtagcagagaggcagaaatgtgctgatgatttcccctcgaagagctggctgtatcaattcagctcatatatgcatgaagagttatcccctaaaacaatggcaaagatttatgataacatttgaacagtggtctacatcttgaaatatttacattcaatcattttcctatcatacagcagtgttttacaatacatttcttatataatgtcaccttgtcaaacataaaatgccaatttgaaattcagaaatcttagcagtcccaggaggggtggttttaaatacttatttgggccctttcaattatagccacccttgatctgaagcttttctgtggcttttcagagcactggcctttaatttatgtcagcactacttatttttggcattttacagctgtgtgggacatctatctcatttctttcaactttgaaatatgaagtcagtgcttgtgattccaatatactaggcaaaaaaaaaaatttttttgtacactttctgaaagagaacattttggagagtgactgaaaaagaattcccttattcacaaaaagtctactccttttacaccgggattatcttgctgttatttccaccaagaatgagtactgtgttaagctcaggaaacaatttttgagtacctagtataggttaggtggtatatttggggctgggaacacaaaagataaaaaagactgtctagctccaagggacataaaatatctaccttaaattcaatcttatcaccaaaaataaattctatctttcaggaaacttatgagccaataaataacataatcccgtgaaaaataccttatctcctccaaaattcttttcaaagcctattcttaatcatctttttgatgatttatatattggcccatttctaagaattaagggattgtctgtttggaggaagctatgagaaggtgactttcaaaaattatttttatctttgggtttatctttttcttccttttttcccctaatttgaaaaataattacaattaagaacatgtatttagtattgaaaaaaaaaactacaaaaaaagcagaagccaatagcaattgcccctcttagaatcaaccacaacatgttttcaactcccacttaatgcccatcacctcctaaaccactagcccaattcattccccatctcaacccctacataatccctgcactcttatcactgaaggaaaaagcagaggcaaaggtaaatatagaatcataaaatctcaagattagaaagggctttaaaagacatgattgctgaatattgatttactcactgcaattaactgaacccccagagagagcacgctcccttcaacttctaaaaaaacacagcaaaaaccacaggtataacaaaaacaaaagcaactataataacaagcctccccattttaaagacaaagtttactactgtatttggttaaatgaatgatgggaatttttcttctttgttaaaaatgttttggcttataaatgtagtacttcacagagttgtagttctgcaagagaacttttaaaaagtgggcaaagacctttcagtacattaagtacaaatgtttgttagttcttgattgtaactactctggcataatcaaataacccacatttttaaatggaaaaactgtagtatgtttatttaatgccaataagcaaaagtgacagccttacatttgcttatcaagataaatttcttcaagtaaaattttttataataaaggtatctcctca

SEQ ID NO: 4991 - DNA, 9149 bp, Homo sapiens
gacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtgctgctgtcctaagaagggtcaggcctagtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccacataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcccgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcagtgagtgttacagctcttaaaggtggcgtgtccagggttgtttgttccttctggtgggtttgtggtctcacttcaggaatgaagctgcagaccctcatggtgagtgttacagcaattaaaggtagtgtggacccaaagagtgagcagcagcaagatttattatgaagagcgaaagaacaaagcttccacagcatggaaagggacctgagcgggttgatgctgctggctgtggtgaccagcttttattcccttattcgtccccacccacgtcctggtgattggtccattttacagagcactgattggtccatttcacagagtgctgattggtgcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagctctgggcagagcccacactgaattccgggtctccaaaaagagaattattatgaggctaagaccatgtgatggttttatgagtgcactctccttttttttttttttttaacaaaaatgtttctctaagtgtctgaactactctcttcctaactttaaacacccaacagtaacctctgttgttactctttgactaaaataattattttagttaaaaaaaaaaaaaaaagaagaaagaaagaaaccaggtaacactatacaaaaggaagcagtgtaagatctgagacgaaattttctcttttacactctttgagttccataaggagaaacagaggttgctccccaaaagggagtctagtgccttctctgttttctttaaggaatcccagggtgttagaaactattttagattcctcatgcagcacagggtagcaagagaaagaagaggcagcagaagtaaaatgaagaaaacagaatttggttgacggagaagaaaaaaacttttgctcaaaaagttgaaggagagaaataaaaaaggccttaactacacacacacacacacacacacacacacaccttggatgttagcttttatttaagcttttagccactaagctccttaaaaaaaataccttcaaatctcattactgtattttagctagtacaaactgctgatatttcaaaagtaatgcaaataccaaaccagaaagggcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaaatcaaaaaaaatttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaactgggtctcgcttgttgcccaggctgtagtgcactggtgcaatcatggctcactgcagccttgacctcctggatcaaggtatcctcccacctctcagcctcccaagcagctgggactatgggtgcatgccaccacacccagctaatttttgtatttatggagatatgggtctcaccatgttacccaggctggtcttgaacttctgggctcaagccttctgcctgccctggccttccaaagcattggaattacaggcctgagccactgtgctaggccagagccaacaggacttactgagaaattatctgagagagaggggtcaaggaagactccccctgttcaaccaagcaacgaggtgaatggtgctgctgcttcctgagatggggaagactgtagaggaaacaaaccaggaacgacaaatcagtaatttagctttgaatacattaggtttgagatggctagtctgtacccaaacagaccacactgtggcatctgggcagcaggatctgcagaatccagcaggatggatgctgatgccaagctgagtagacagttgggtctgtgagtctaaagctcagggaagacctcagggtctgggatacaaatctggagatcatcaccctgtccatgaaagccaagggaatgatggaagatactatgagaaaaagtgaagagaggaaagagaagaggtccatggaaggagacctgggagaatccaaccttcgattagatcaggaagaggagaagaatccagtaaaaaactctgagaagtctctgggaaggaagtcttccttccttcccctgtaccaggagaggtgctatcccagaaattagtaaagaaacagtttttgatggggagaacaggatcacctttgtcaactgctgctgcgagacttggaaaaataaggactgggaagagagcaatagaaactttgaaagccattggttatcttgataagagttgtttctgtgggggtggtgagaactggagcctgactggatgggttcaagagagaatggggagttctagccaagaaggctgatgaggatgagtcaaattaaaaatgttttctttttatgagtcctctcatatttactgatacaactgatatattgggtctccattctgccacattactttatattgatcatgtattgtatctgctatgcaattgtattgcatgtatctgcatggcaattgtattgccatgcaatgtatttttttttactttaaaaattatatttataaaggtttgtaattttattccagtggttattttatatgtacact

SEQ ID NO: 4992 - DNA, 1951 bp, Homo sapiens
cgaggagtggcattgcctggacactgcacagtggaatttatataaggatgtgatgttagagaactacagaaacctgttcttccttggtattgttgtctctaagccagacctgatgacctgtctggaacaagggaaaaaacctttgactacgaagagacataagatgattgccagacccccagttatatgttctcattttgcccaagatctttggccagagcagagcataaaagattctttccaaaaagtgatactgagaagatatgaaaaatgtggacatgacaatttacagtttaaaaaaagctgtaaaagtgtggatgagtgtaaggtgcacaaaagcggttataatggacttaaccaatgtttgacaactacccagagaaaaatatttcaatgtgataaatatgtgaaagtctctcataaattttcaaagtcaaacagacataagacatactggaaaaaaaacttttaaatgtaaagaatgaggcaaagcttttaaccagtcctcaacccttactacacataagaaagttcatactggagagaaacgctacagatgtgaagaatctggcaaagcctttaagctgcctctaaccttactacacataagataattcacactggagagaaaccctacagatgtagagaacgtggcaaagcttttaaccacccctcaccccttttttcacataagaaaattcttattggagagaaaccatacaagtgtgttaaatgtggcaaagccttcatttcatcctcaacccttattaaacatgagataattcatagaaactctacaaatgtgaagaatgtggcaaaattttaactgttcctcaaaccctactaaacataagataattcatactggagatataccctacaaatgtgatcaatgtggcaaaaccttcacctggtttagtcaagcctcactaaacataagagaactcatactagagagaaaccttacaaatgtgaagaatgtggcaaagcttttaactggtcctcagcccttaataaacataaaataattcatattgcacaggaaacctacagagtcaataatgtggcaaatcttttaaatgttcctcaacccttaataagcataagataatttatactggagagaaaccctataaatgtgatgaatgtgggaaaacctttaaccagccctcaactcttagtaaatatgagaatttatatggaacataaaccctacaaatataaagaatgtgacaaagctttttaaggaagttctcaacccttattacacataattcatactggacagaaactctacaagtgtaaagaacgtggcaaagcctacaacaaattctcaattctttttttttcttctttttttgagacagagttttgctcttatcacccaggttggagggcaatggcatgatttcacctcactgcaacctccgcctcctgggttcaagccattctcctgcctcggcctcccaagtagctgggattgcaggtgcccaccactatgcctggctaatttttgtgtttttagtagagagggggtttcaccttgttggccgtgctagtctcaaactcctgacctcagatgatccacttgcctcagtctcctaaagtgctgggattacaggcatgagccaccatgcctagtcataagttctcaattcttaagagacaaacgataattcatgctgaaaaggaactctacaaacctgaaagatgtgacagtacttgtacaaacacctccaactttgcaatacattaaaaaaaaaagttatactagtgtgaaaccctagaaatgtataaaacgtgacaaagcctttatatggttgccacacttgattgtaggtaagataattcatactggcaaaactcctacaagtataaagaatgtggcaaaacttttaatctgtgcttacaccttatttcacaggaaagctattacccttgagaaaaattg

SEQ ID NO: 4993 - DNA, 2089 bp, Homo sapiens
tttatttttatttatttattttttgagacagggtctctttctgtcatccaggctggagtacagtggcacaaccacaggtcgctgcagcctagacctcctgggctcaagcagtcctcccatctcaacctccctagtagctgggactacaggcatgtgccatcatgcccagctaatttttgtatttttggtaaacacagcatctcagcatgttatccaggctgatctcgaactcctgggttcagtctgcctgcctccgcctcccaaagtgttgggaaccaccatgcccacccttattattgctttttagtaagtttttttttttttttttttccatttggttggttggtttggtttttgttttgttttgttttgttttgtttttgagactgagtcctgctctgctgcccagcctggagtacaaagacgttagcactttgggaggccatggcaggaggattgcttgagctcaggagttggagaccagcctgggcaacatagctaaaccctggctctacaaaaaaaaaaaaattaggcaagcatggtggcacactcctgtaatcccagctgctccagaggctgaggtggggggattgcttgagcctgagaggtagaggttgcaatgaaccaagagcacgccactgcactccagcttgggaaacagagccagactgtgtctcaaaaaaaaaaaaaaaaatcttgcttatagtgaaaaacatacaaattaaatctacactgagacaccatttctcactatcagtttggcaaaaactcaaaagcttgattatatgcatactcttggcaagtatgtgaagaatatatactctcatacattgagaagaataatataccaggtagaattaaaggactcactctgttgctgcccaggctggagtgcagtggcgcatctccgctcactgcaagctccacctccctggttcacgccattctcctgcctcagcctccctagtagctgggactacagacgcccgccaccacgcccgggtaattttttgtattttttttagtagagacggggtttcaccgtgttagccaggatggtctcgatctcctgacctcgtgatccgcccgcctcggcctcccaaagtgctaggattacaggcgtgagccaccgcgcctggcggacttttcttaaaactgatgcaaaaataattcttatgtgtaagagattagatcattactggccttaatttctgaactcttggaaaaattaaacacctcacaataaatgaagcatcaaaacagtatttccctgtgttaccattgaacagtagcaagagcttactgctgcagttagaaaaaggattcatagaaacagtgaaaggtatagattgaccagctatctaaagtaattctatagcaaggattacagtgaagaaacatggagcaattagatgttttttctgttatatttactccagttgattgtttaagtctcataatcttatgtgccagatggaggagtattggctgaatagaccatcagtgggtacattttagttgattaaatagccaaaccatattggaggatggttctcttaggtctccagtgttttgtagagactaatttttaatcactgagtgatgaagccttgaagagatgcttacgaactttacagttagcataaagccaggggggtgtttcaaccattatggatgttaaactaaggattattaaagatcagaccaggcacagtggctcacgcctgtaatcccagcactttgggaggctgagacgagtgaatcatttgaggtcaggagttcaggatcagcctggccaacacagtgaaaccctgtctctactaaaaatacaaaaaaaatgagccgggcttggtggcgtgcgcctgtaatcccagctactcaggaggctgaggcaggagaatccctggaacccaggagatgaaggttgcagtgagttgaaatcatgccactgtactccagcctgagcaacagagcgagaccctgtctcaaaaaaaaaaaaaagaaagaaagattgttaaagatctactttggtaaaatgtgaaggaattaaacattccagttaaaaggcagagagtgtcagactgaattt

SEQ ID NO: 4994 - DNA, 5173 bp, Homo sapiens
aagcagagaagtagacagcttcaggggaggcaggggtgagcagagctgccaagagcaaaaagaaaccattcatatcaccttagataccacggctcttcctactccaggtgcttcctggagaggtatagatgcaaaactataggagtctttagaagaagcaaccagccggactgtcttgaaacgcgatcagaaaaagccaagaatagagatggggttgttcaggaaaaatctgtgaggaccctcttttctgaatgtgtgaatcaatgtgacatacgtagaagacccacaagatttttgagaatgttctaccatcagaaacacttccaactgggcctaaaagggacagagacagaaaaaaatgaaagaagattgtgagactgccagaattctacagtgtatgcaatggtatgaggaactgttccacattaaaggagactaagaagacataacaactcgatgcaatgtgtgattctggactggatcttgcattggaggagaaaatgctataaaagtgtcttgctctttcacccaggctggagtgcagtggcgccatctcagctcactgcaacctccgcctcccggattcaagcgattatcctgcctcagtctcctgagtagctgagattacagacacgtgccaccatgtccagcatatatatatatatttttgtagagatggggtttcaccatgttggccaagctggtctcctgaccttgtgatctgcccaccttggcctttttttctctatgtttctctgactcaacctttgacacttagaaggtagcacacttccaacatatccttccgtcttccaagatatagtccatacaactttccatagttcgaatgtttatcccccaaacctcatgttgaaatttgatccccaatgttggaagtggggcccgatgggaggaatttgggtcatggaggtggatccctcatgaatgacttgatgtcctccttgtggtaatgagtgagttcttgctccattagttcctgagaaagctggttgtttaaaaacaaaaacaaaaacctgtaagctcccttccctctctctttcttgtcatttggtctctgcacatgccagctccccttctccttctgccataaatggaattaacctaaagccctcaccagaagcagacgctggcactgtgcttcctgtgcagtctgcagaaccgtaaaccaaataaatctcctttcgttataaattacccagcctcaggtattcctttatagcaacactaaacagattaagacacaactgaagacaaaaaaacaaataacaacaacaaaagcaaataaataactctcttcctacctcagctcatgcaagctttgcggtttacatatcatctccttatagtgtggctcaacttagcctctttaacttattgcaacttttatctctatttaggacatttatataggatggcctaagaactaagcaagaaagaactccttttcctttggttgctggtgcttgtggaatgcttgtggtgctaaagtataaagttgtttttttaatcctcatatttgcatataagccccctcttctcaaaattttcctctggcaccatatcctcttcctttatcctcttcccttgttttattttcatcactagtcaaaaactgaccagaatcatagcacaacagttgtactacaaaacacttagaaccacaaaaagggaagtaaaagttcacaagttttaaaatcagttagacttgataaagaacacgtgtcatttgaagtcttcaaaaatgctcatgagccctattttgagatttcacacagtctccatctactttttcatcctcttataattaaacctgtttttcctcaagcaccaccattgaagcccaaaatataaaatgatcttattcaacgttattgcttttgtttaattagtagtatatgataaatgtgttcactactgtttcactgcaaatgtatagtatttcagtaacattattggctatcctaggggagcccaaccaccatttataacactgccttggtaggaaaatgctttctggattccaaacaactgacatctaaagcaaagttttcccacttgggtaatcaggattcaaacaataatatgccctacatctgtctacagccatttgtaagatagggactgcctgtatttgaaaaacacacgctgatatgttgcttttaatcagggaaaaaaatgtttggatgatgaagttccatgcctagatttctcttcctagttttcaattacattcctccattctatcagattagactcatgtaaatcctaaagaaaattctgtcagtacaatatatgctctacttttaatcttaaaaataattttcatgtacgacccagttaagtatttgggttacagaaacctctcaataactacagtaatcacagtttttcagaaccaagtagatgtattaggacagatgttttgttttcaaaattctaactaatgaatttagaatttttctttcgcttgcagtgggcctgatcaacatgctactattatatgtcgttgcctaccagcattaattagtccgggaacagtagaggagaaaatggacaatggttatttgcagggttggggctaggagcagctgagaattgggtagagaatgaatgaggagtgcttttgagtacgtactgacatgttggacagcagagtcatagttgggtagggacagaaatgagatagatggaaaagttgaatgggaaaaaggcttgtagaataccaaacggaaaagcagaagcagagtgggtgtggactaggaaaggtggaaggaagtggacatgttcaaataagagaattttagagtacttggaggtacaacagtttcaagagataatgaaatctaaattggtaaccaatggttctagggaatcaatgagaagcttgagtcaaagttgactcagagtttgaacttaggtgactgggcttattactgttagagatggagaaggtagaaggagtaacacactttggaggcaagacatacttagcactatgctggaatggatactaaaaatagtacagtattcaatgtctattcttaccttttgttaccaagtgctaaatggatttggtgacttttttttttttttttggcattccttctcatatggcctgaccacaatttcttttttctattcccatggattcaacaagaagagatactattttaagacttcaagagcagtggcatttttgcccttcagtttggcaggtcactttaggataaccattcgaagcaacctcatgttcggtgtcacaatcttctgtatagagcaatctttgcatgcctgtttcaaagacatttgtggaggctatgatctgctcaggggaagaaaagctttctcagagaaaaccacacactcctgcttgaggtcatttttgttaggaaacacgtctgacaagactccactgatactaactaaacctgccattccagggtaaagttgtctaaagatgatgatgaacttctctggatagtcaaaattgtgaagtggttgccagaggcctggtttgctgacattgatcaaggtcaaatttatgtactcaaagtaggaaataagaaacacttttcatttattgcagtcatgcaaattaagttcacactcaagcggcatatgacaaataagccacaggcaaaaagagtttctatcaaaatattcaacatatagttcagagcatgagcagtttatctagccccagatgctccctgtgtcatcagtatcaaaaaggcaaagtcagataaaactgtactggaatatgagactacatgtgggctggtatattactgcccttttgtgtttttatttctcctaataaattataaggttgatatctaaagtaaaagaatattgtattctttgatatacttatactgtacctcaaggctaccctttgtttgctgtttgttcttttgttcattcatctactcatttattcaaaaatgtctgaagggcctattaagttcccaatgacatgcttaatgccggatctacaaagataaataagacatgctcccaatgagctcactatctaataggaaagacaggcaggtaaagaaacaaagacaaagcagtgtgggaattcagtgggaacaacatgctgaaagcaccatgcaagaactgagaaagtatattcatagccccccggtgatggggccgaattgagttttaaaaggatgagcaggagttcatccaatgaaaagaacaagggagggcagtccaggcagggggacacagtgggcaaaattataaaagaatgcagggatttgaagggggacaagactggaagctggaatgccatttagaagattgctgcagttgtctcagcaacagttggtaaaacatgggaataggacaatggtagttaggaagccacagaggtgacacattcaagaaatatttaggaaggaaaacgggcaggatacagagattgtgagatgtggagatttatagagaaggaagaatcaaggttcacacccagttccctgctagagtgagtagctggatggtggtgccgcctacaaagaatcaaaaacggaatagattttagaagaaaaagcagagttaagattttgacatgaactgaaggtgcctattgaacatctaggtagaattgtccagcaggcatttcattatgcaagccttaagttccaggaagaactgtaggctatagctacggagttagaaatgatttgcatatagacagttaaaaatatgagagtgggtgaaatcacacagaaagattcttgtgtagagtgtgagggttgaaccttggtgaacaaaagcatttaatgtacaaggagaaaaagaaacatcaatgatgaggatgaatcaaaaggtatcagaaaaatcaggaaacgtatgttgttgtcacaaaaacaacaataaatttcaactttgtagagaaatccacaactatggagatgacagattctgaattttttctagggttgtgttctagtagagttacagtaaaggtgcaatatcttatctatgcctctatttctgggcaagtaagtgtctgactcattgtaagttttcaacaaatatttactgaatgaatgtatgtcaatgtgaagaatatatgttgttaagtaaaatataaaggcacatggacatggaaagcacttaagtcatttttactatggta

SEQ ID NO: 4995 - DNA, 511 bp, Homo sapiens
agcacatctgggtggcagatagagtggagggggcagggctctgagggtggccctggctgctgctgctgctgctcctgctgctgcaggtaaggagagtgggtaagcaggctggggaagaggggaccagggagagggatgtagacagcccagcagaagtgcccactaatgggagtttcctcttatatctttgggatggactggaatgggatcaggtaatgtggtacaaatgggaaagggaaaggaggcaatgcatgcagacggtgcttgtccagcctgacccaggagggactgggcgatgaaacagaagctggaggtccctctactgcatcttgaagttgagagaattaggtggattcagcagagcaatcccccagcactgtgctgatatcctgggagatgtaaagaaaagcgagacagagtctccccttaaaaaagcattcactcactgtgcagaggaggcgttagtagagcaaaaggtaaataacagcaaaaagacaggcagtaacatgaa

SEQ ID NO: 4996 - DNA, 4318 bp, Homo sapiens
agtgacgctccggagccgtcgccagggtggtaatacctggtgcagagcttgagtctggccagcgggtcaggctcttgctagatcagcaccggaggtggaagactggtaagtgattttactgggttttctcctgcgcctgatattaatggctggccggggctctgtgcagcattatggccagcccgagaagtgagtgggcgagggtggaaccagaaggagtccccatcaaaccccgtggcgcttgacacccagtgcagctggagaaggccctgggatcccggcttaccgtcttatccactcgcaaaatctgtctccgacttggaactcgacctcgggtcaccaagtgtccctgggcgaggccgaagacaccgtgtaccgtgactcggcgttgtgccgagtttctctaccaatgatcaacgagtttcctatctcccattggcagcgtttggccactcttgattcctgagtactgtttccgtagttctggggtgccgtgcctggaaggcaggaggttggctgaagaagacatcttttacaaacatttaggaagtgagatggggaggttccttcctgatttagaattaattgaaggttcctcccgccatttgaattggatgagaagaacggtctttgttttcatggctgagacataagagaacaagcttgtaatttcatgcttgggcattagatgcatttttggaaagcagtgatcagtaagtatgtgtgctttcagaaaggaatgcttgcgttctgctccaggctttgtcgataatgaaggattcaggagaattttggatggaggtctgaggtagccagaatagttgtaaagagaaattgcttccgacaaagggataatgtgaggaaaggtgctcatttaagatttgaaagatgtgatgtagtgaaccttggcgacttctcttaagtaatgcaatttcttaggtaactagttttcacttgccaccttatatttagataattacctccccaccaacccccgtaaaaggcagctgactgttattttttcaaaacagtcagttcccgaaagagttgtaggtactattgcattttttttatgggtatgctcctcatacccataaaaacattttctttatcggagcataccgataaagaaaaatgcaatatgttcaattcaaggcccctgttaacaccaggccagtgtcttcttaaccttttgagagtaatgcaacaaaccatatttaggacagcacattgattttctggccttgttggttaataattcaacaaacttataatcgccccattaatcccaatcttgacattttgttgaatcttgtattttttctttatttctccagttgaaagtattataaattacttcagggatattatgtattatatctgtacagcaactagtttttagaggcagtgatttctctctttgaattgctcttgaatgtagccaatcattaatacttaccccaagtagatactgtctgccaggcactttacatttattattttatttaatgtttaataaaaaaagaaaatcacaaaaattgtattatttctattttgcaaaacattttatactgagacccaaagaggttgtgattttccataaattatacaattaaatggcacaattaaaatttgaatccagtctacctgactctaaattttggctctttttactgtgctctatacctttataagtaaacataacagtatcattattttcactccaggtaaaaatggatagatagtatgtcacatttagaaatcaagtggatagcaaaacttgaggataaaagggacttaagggatgtgttcatcaccataaggtaattttgacatctaaataatgcagtttctttagtgcctttatccttggccagttttattatcctaattcaaacaaatgcctatactgtacattagcataacacttggggcaaatgcagaagatctggagaccatcagcaagcatattggtgactgagtccagagtatcagctaactatctctttagacagcttttcacacacacatttgtatacatgtatatttgtgtgtgcatgtgtgtgtgtgtgtgtagggagaaagaatgagtaaatgagcacaaattcataaaattcaactttgtaatgatttataaggaattattagcaaaactgtgctgttccactcacgtaaccctcaaacagatggggattatcacatagtttcaggaatatgctttattaaacctgcccatcccaatacccaattctatatagagaaacagaaatagcctaattttcagagaatttacaaaaatttagttgaaatgaccaatactagaaatgacatagaagttaattctaaagaatatcctgttttacaactgtataggtatagctagcctgaaatactaatgtgtatttgattacattgcattgacttgtaggcagatcccgtaggcagatctcagggatattttgctatcaaatttcagtgcttatgaagtttgggattatgtctgttttgttcgtcatctcaaacccagcatctagcactgtgcctggcgtgtaatagaagctcaataaataagtcaggaaccatgactcatgactgtaaccccaatactttgggaggctaaggcaagaggatttgaatccagatcctctaaattttggctctttttactatgttctatacttcctttaataaataaacataggtcacagtgaactatgatcatactactgcactctagcctgcacaacagagtaagaccctgtctctaaaaaataaaaaataagcatttattgaatgaatgattcctttttaaaatgttatttatccaccgagaagtatttgtacattttttaaaggatttaccacataaataaatatttatttttactcaccttgcccctgaaatacagtgtccactccacactcattcataaaaggcaatgtgctgtcctgcaaagaagactggactgtgagacaggagatgagagaatatctaatatttttctgtgtttattctctgctattcagtgttaaattactccttacagcacagtgggtaagtattattatcctccttttacagatgctaaaactgaggcaaagataagctttgtaaattgtcgtaggttacgcatagtcattaaacacagctatgatttgaatgaagggctctgatcccaaaagcgataatcttaaccactttgctagcctccagttgaatttttaatcctggttcagctgctaaatgtgtgcaaaagctctgggtatcatgtttctcatctataacatataggagtttgatggattatattatctgtaaggtccctcctacctcaaaaatcctctgactttagttgactcctaagtattatctgaatatagcagttctggagtgccagaaaaccctcatcaattttgatgtgttttatgtaagcttttatatgtgttcacgtcttccacattggtggacacacaatcatgtttttgcaataggaagaatagagttaaaaaaatcacagccatgcttttttttttttttttaccagctatgacactaataagtcactgaacctttgtgagcttatgttttcatatgtaaaatggatccataggattgctgtgagcgttaagtgggttgacttataaagcctcaaacgtgttgtctgatacacaattgctgataaataaatattgattctttttcttgctcagtcttgcaaggataaaagattagtggatatgaaaaatgctttataaattagacaaaggtgaagaatattttcacttacagtctactaggagagagaaagttatataaacaaataattatatgtagggcaatttacatacatcattgaacacaaaacatgggaatgcaaagaaaagagatttttttttttccaggagggcagatgaggaaagacctcataaaaaaggtaatattgagtttgtgccatataggatggaaaggattttggcaggggaacaagagggacaagtgttctactggaagatgcaaaggtgtcagaaaacagaaatagtacctaggtcactttggctatgtaagatggatgaaggctggtaataaagctgaggtaaaaagctgagtttaggacaagctgtagataactgtgggcaagttagagatgttaggcttttaacgataagcaataatctgtgtgtataactaggatggggtggaggatggagttggcatttgttttctttgttatggaaaaacgcccatttgttacagaaacattagagtgtacaaatatgccaaaaaggaaagagaaaggaagagtggcccatgacccca

SEQ ID NO: 4997 - DNA, 4424 bp, Homo sapiens
ggcttgggctcagaggcctgacaatcttcttgaaccataatggaactaagttaaaaattaataaaagaaacatatctagtaaatctccaaatatttggaaaccaaccgataaagtttggatgtgtgtctccaccaaaatctcatattcaaatgtaatccccaatgttagaagtggggcctggtgggaggtgattggctcatgggggtggatttttcatgaatcgcttagcatcatcctcttggtactgtcctcacaatagtgagtgagttcttgtgagatctgctcatttaaaagtgtgtggcacctccccctactcctgctcctgctctcaccatgtggtgttcccactcctggcttcacctgccatgattgtaagcttcctgaggcctcttctgaagctgatgccagagctgtttcctgaacagcctacagaaccataagtcaattaaacctcttttctttacaaattaccctgtctcaggtatttctcttttcttctttctttctttttttttttttcttgtgtgtgacagacagtcttgctctattacccaggctggagtgcagtggcacaatctcagctcattgcaacctccatcttcctggctcaaagaatcctcccaccttagtctccagagtatctgggactacaagcatgcaccaccacacccagctaattttttaattttttgtagagacggggttttgccatgttgctgaggctagtctcaagcatctgcctacttcagtctctcaaagtgctaggattacagacatgagccaccgtgcctggcctcaggcatttctttataacaatgcaagcacggactaatacaccaacatacttctggattacccatgggccaaaaggaaagccacaaaggaatttagaaaagtaaatgaaagagaaaatgcaacatatcaaaatttgcagaaggcatttaaaacggtgatttagagaaatttataaatgcttatattggaaaagaacaacatctcaaatcaaggatctaagcttgcaagtgacaaaactagaaaaagaacagaataaacccaaagtaagtagaaggaaggaaagtattattagaagaccagaactcaaataaattggaaacagaaaaacaatagagaaaattaatgaaactaaaagttgattattttaaaagttcagcacaattgataaacctctagcctggatgaccaagaaaaataagatgcaaattagaaacatcagaaatgagagaagaaacatcactattaaccccacagaccttaagaggataacaagggaacagtactatgaaaagctgtttgtaaatttgacaaaatgcactaatttttaaaattaaaaaaaattaccaaattcattcaggaagaaaaaagtttatgttaaagcaatgatttatttcatatatatgtatgtataacttttaaattgaatttgtagtttaaaccttccaaaaagaattctctaggccccagtggtttcactgatgaagtttaccaaacattgtggaagaaataataattttacataatctcttccagataaagaagaggaaggaacacttctcaattgattttatgagattggcattacccaataaaaccaaagacattacaattaagaaaatgtcaacccaatatcctttaagagcacagacacaaaaatcttataaaatattatcaaattgaatccaaaaatatatttaaaagatattaataatatggcatgatcaagtggggcttatccccagaatgcaaggctcactcaacatttgaaaagccatcaatgtaattcaccacgtcaacagtctaaaaaagaataatcacatgaatatcttattggatgaagaaaaagtttagaataaattcagtaatcacttcatgataaaaaaaaaaaaaaaaaaaaaaaactccagcaaacaagaaagagtagggaacttccttaaactaataaaaggcatctatgaaaaacctacatctaactttatacttcatgatgaaagactaatgctttccccctaagactgggaagaaaaagttgtcctctcttgacacattcgacagtgtactgaaagtgctagccagtgtaataaggcaataaaaagaagtaaaggatataaatattggaagggaaaaagcaaaaatatatttattcatacatagataacatgttcatgtagaacatttcattgaatctacaaaaagcttttaaactagtaagtgaattagcaaggtgccagcatatgtacaagtcaatataaaaaagttaattatattccgatataccagcaatgaataattgaaatctgaatttttttcaaaaataccacttataatagcaccaaaaataaggaaaatatttagttataaacaataaaatatgtgcacaatcaatttgctgaatacaaaagattgatgaaaaagtcaaagaagatataaataaatgtggagatacagtattcatggataaggaaaattcaatattgttaaaatgtaaattctcctaatctacagagttaatgcaattccaattgaaaatccaaaggatttttgtaggtttttttgtagatttagacaattaaaattttatatggaaaaccaaaataaccagattagccaaaagaaagaaaacaaaacataacattagaggtgtcatactacctgatttcaagactttatagtagtcaagatcatgtgggattggcaaaggaaaagataaatcaatgaaatagaattgacagtccagaaataaacctttgtatttatggtcaattgatttctttaaagatgtaaaaggaattcagtggagaaattatggtatttttaacaaatgatactggaacatttggacattcagatgcacataaattcatacatacatatacacacaatacatgcatacatacacacatacatacatatgaagaataagcctaaactatatgtcacaccttatacaaaatgaactcaaaatggatcatagactataaagtctaaagctaataaacttgtagaaaaagaaactatcttgcccttccgtgtcttttaagaagtcttttctttttttacccccttgaaaaccctgtaattgcctcacctggagctgatgcctcacaaaagagaggatgcccactctcctcaaaatctaccccaaacacttcttattgccactagacccataactagagtccaatttcaacatgttccagcagcctggaagtggcagcaggtctctgagtataactgtggcactgagcccaggttcccagatttgtctcgttccacttgctctgcagagtatgagccaatataaactaaaagtgatgtctttactaaacacctgttacgaaacagcctgaggtgtagatatctctcatctctggccttgttttcagcatttttcctccttggatcaacagtttctgataccaggttaggttacaaggctggaataaaaaaacaaaccccagcttggaaaggaaggtgaataaggtagtcactcttacttgtttgttctcacagaatttgtccacctgactattgaaatacccagtctagcttcttagtttttattcatggctgttggtatttattaagtaagcattaacagacttattgggcaagtaaaacataatgtgctaggcagccacaagaaaatacaaagccagagtccccaaccctcaagagttcattctagactaatcgtaaatacatggctttatgttttcagattatgcttaatggagccactccgaaccattttcttctgggtggcacacctctgcgtaacgaaattttccagacttcatatgggcaaggtagctaggcagagagaatgacctaaaactaaaattgtttcagagagaagtaggaattgtactaattaatgctggagcaagacaaagatagacttcgaaggggcagatggctacagcttagtgtctaacattatggaattgatctcggtagggcacctagcattgcttctactactcccatgcctctaactgtcccataagcaggtgctgttagtggcaaaggcaaaatgcaggagtgcagcccaccatggctataagaagtactcaaaatccatatcttcctgctttgggatagctgaatctcaatagacaacaattatttttgtaacacacttaaataatgtaagagaaaaaatagtaaagaagaaatgtttagagaaaatggaatgacaaatgagcaaatataggaaaagaagtcagggaaaagaacatcacactataaactcatcaatgctttataccagcaccttgcacaaagtttaactttgtaaattgtcttaaatattaaatacctaactttatataaaaaggcaacaccaatatcatctcttctcagcgcctccaaacaaaattatgtactttgttttttctaattaaat

SEQ ID NO: 4998 - DNA, 1945 bp, Homo sapiens
attgctttcttgatttctttttccactagttcattgttggcgtatagaaatactactgatttttgtatattagttttgtgtcctgcaactttactgaattcatttaccaaatctaacaatttttttggcagagtcgaggcttttctagatgtaagattatattctcagtggggagcgacaatttggaagccttttatttatttctcttgcctaattgctctggctagacttcctctgtttctttggtttctatcttttttatttctctgggcatttcatacatagttatctttatatcctgtagccagtaattccaatatctgaagtcccttgagggtctaaatctgtttattgtctctgttgacagggtcttgctttgctgcccaggttggagtgcaatgacgtgaacatgactcactgcagccttgacctcccgggctcaagtggttctcccacctctgtctactgagtagtaggcactacaggcccgcaccactatgcccggctaatttctctacattactttcaatacccaatacaataactacacatcacttcattcgcgtggatgcaacacagtacttggcacatggcaaattcgttttgtcttttagaacttcgtgggaatttttcaccctgaatattttctatctccgttgaatccaccaatgcagcacccatggatatggaaggctaactgtaatttgttttactatttatttgtaaatcagcttaaaaataggatggaaaaattacattctcgtgtatatgtaagcttgggaagctctttaaaaccactctaccaggatcacttgcttcttcccttgagattgtgaattcctcagttgcagtcctgggtaccaagttttacctgcacaaggagtttcttcaaagattgtagttcaaagatggaaaactaaaggcatttttctgtagttcattcagttgagcacgactggttttccacatccagtagtgtgagtattcctaagaaaatatgtgctcatgcaccttttttgagaaggggttggtagtgtttcttagaggataatttataggaatagttagcagtgaagatatcagaacctgtaattgtttcttcctcctacacatgaaataaggtaaatgagatgttaggactgggcctccataatagagaagggtgatttaaagcacttatccaggggaggcacatggtctttttaaagctaaaatagaattgtgtgttcaaagagcatttcaaggcctgccctcagtctgttggaagggcaaagtcccttattatcagagccttggtgtctcagtacagtcttgctttcagctgagtgtggtctactggaaaaccacaaacgctgaaagagtcctgttcctcagacaaaacagactagacagtacaattatctaatcactaccaaagtaacagcagataaacctccgattatattctggtaaagacacatggggcttcaaagttatttggaatggatttgagggttctaagcaccacctagatgacttacttaaaagtagcctggattgtgaccatttacattcctgacaaccctggcaaatagtgagccagtacctattcaaataatgcaggctccaaaagtgcctagatacttgcgaatacaataacacaaagggagactaccactttaacctcacagagtagttgccagtattcagtgatagtaaaactgccttgtacagcatctgggaaatagtctgtatgcaccttatggagacatcaaaagtcggcaaggacactgccgacttaaattttttttttaaagcccagcataatacaaataaaaaacttaatttggagagaaatacttaacaaaaggttaatatcctctaaatacataaatcaaaaggaaaaagatgcatttttcagcctggtggatcatctttcttttctttactgctcagcatccccttc

SEQ ID NO: 4999 - DNA, 12554 bp, Homo sapiens
gcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggtaactgagattagtagttctatatacatttattaaataagttaatatttgtaaaggcctagaatagtacatagcacatagtaaatagtatgtaggtgtttgctgttataaagttcttttaaatatacgtaagccccaaataaaccaattatacaaaccaaaaatacccaacaaaagcaaactctcctcctaaggcaagtgcgaacatcattggtaagttctgacgtggcctctgtatagtctgttgtcctggctctgagaaacgtaacttaaaacctctttgaaacgtcttaatctttgagcaccctaagtccttgagcacccattcatttttgtctttgaccttctaagtgtcagattggtttccagtttgaaaccaaacaaacttctttgaaattcttgaagacgtagttccaggggagcatagcatagcttccaggtggctactgaaatggctgacagttactaaagatggtgaggatagagttaaaagcagcagcactcccattttctgatgatggcaggtgataaccttggaataagaagctccaaactatcatgcctgcttaggcactaacttcctgtaattgtaataaaattgttggcattgctgagacctactgacaccttcagcaaacgttagtaaggggcatattacgtgtccagtcctctgcttggtgatgggatttgacattgaatgggttatctttctcctcactccactcccatctctctggatcttcaccaattcctgcccagatagatgctgtatgtcctgctatccgcctcgtccccagccttgctgtctctcctgccagctccccttcagcccctcagcatccctttattcagggtgggaaaagatgccagagatggggctgagagttgcatctggtagttagacttttctctcatggagtttatgttgcatcttcctcggccctgacttctgcttcataatttacatagtttattttaaatatgatgatgtatgttttaccatgtcttccttcggggattttgggatattacctttgacagttatgtttctgttttggaggtcttgcagctggcattattagcttgagggagaggtggggcactgggggtgcactgaatatctccatggctttcagacctttttattagaacccccaggaggaaatacctgttaccttagggcccagcacacatatttgtacatgtgggtatgtggtttcctgaagcttactttatgcaagctgggatagagttttttaattctatcactttttcttttccctttttctctctttttattgttcatcataaccagcaaagtggatttcttaacctgctagtcagtcggttgtcctttgacaagcttgcagtatttcagtgctatggtagggacgcatggtttcttgcccttctccctgtattcttcagtaacttctacagcatttttttacccctaaaaatgcctcaaacctgccttaactttattctttatgggccgagctctctccttccttttgtaataagcttctgtttctattttctcacctactgttcccttctcaactttctgtctgaacttgaacattcttctcctcctgatcaatacctaagaatgcttttgtttaccgtttcgaataagatcaatccttctgtgctgttagatacctggttatctcttggttggtgccatgggttgtagagagacatctgctggcccaagtgtagtgttgcattgtttttctgtgctgaatcaccttgtcattttttagtaccttaaactttcatagtgtgcaagtgagcttgtatattggaatgtgttgaagtcatctacctaatctcttcaagcatttttagcatttagctcaacatctaattaattgaaatgtagtcatacattataacccagtttaaggagctgcaatctagtaggggaaaaggatttcatggtaaaacctgagtcctcaccttcatgtattttttaatgagactgaaaaatgacagttaaataaaggttcagatccatttaaaacttttggaaatgataattcactcttccaagataaatgagaactgaatttttttatttgtataaatttgaaaggtacaagtgcagttttgttacatggatatattgtgtagtagtgaagcctgagcttttagtgtaaccatcacctgaatagtgtacattgtacccattaaataatttctcatgccttacccgcctcccactgtctcacccttccaagtctccagtgattgttattccacactgttatgtccacgtgcacacatatttagctccacttatcattgagaacatgtagtatttgactactcacttctgaattttttcacttaaaataatgacctctagttccatctatgttgcagtagaagacattatttcattttttatgtctgagtagtagtccattgtatatatcaccacattttcttcatccagtcatcagttgatggacacttaggtggattccataactttgctctagtgaatagtgctgtgataaacatacgagtgcaggtatctttttatataatgatttgattttggggtgatatatacccagtagtgggatggctgtatcaaatggtagcagaacttaatttttaactggtgtaggtttgcagcttggtttcttatgtgagaggtatggttggtgctagctataaagctagtgctggaaaaagacaaaatctgaaatctattgcttctttactttgaaactctagttagattatcacagtgattctgtaccatccttgtcttagcaaaattctcactgatttcagatgcaagtttataaaggaattgcaattatgtacatacatctaagatttctccataaatatgacaaattttaaagattataattgcaaaattgttcttttaaacaaaactaaaccaacattgacctatctttgagggctgtttctaaagctaacaggcaataaacaagatattgtatcccaatttcctgctttgaaaagatctcattggagtagttggtagttgtagaagtttctaaatgttttgttattgaagccaagttgaagttgctcatttgattctttgactatgtcctgatttcaattatgattaacgaagcctttctgtatccttaaatataacagattcaccaaaaatttagtcgaatattagtattgtagattaacattttcctatattttacaattacttttaattatttacagttatttttaaagcacatagcacaattcggattactttgttttgtggtatccagagtttgaaaggattgtgagaagataataaagcagacttgaaggctggtggatgccgcagtgtatctgtcaaaattatttgaaaaagtcactctctaggatttcattttgatttcttttttaattttctaagattatttttaatgatccataatgtgtttttttcattagataaatagaacccacacaataataaaaattttctgatgttttcttcttagccttacattagaggacatgaatcctgctttggacatctgttcctcaaatacattcattcttctttgactcaccatttactttgaaggataattaaaccagtccagtattttttttttttttttttgagatggagtctcgcactgtcacctgggctggagtgcaatggtgcaatcttggctcactgcaatcttcacttcccgggttcaagcaattctcctgcctcagcctcccgagtagctggcattacaggtgcccgccaccacacccagttaattttttgtatttttagtagagacggggtttcaccatcttggccaggctggtctcgaactcctgacctcgtgatccgcccacctcagcttccaaagtgctaagattacaggcgtgaaccactacacctggccaaccagtccagtattctatggtcttgtgcatttatagcatttgggttaggaaacaattagtgcatcatctcttcctagaaaagggtctagaaaggcccgaggcgatgcagtagtactttcctggcagtcacatcatttcgaagcagctgaaagccagtcctaggaaaatgaccaaggggttagactagtaggtgatctagagccctctataaattgaggaaaaacaaaaaagagaataaccatagacagctaattaaaaatcctgtctcggaaaaactaaataagcagctgctgtataagagccacaaagacgtactctttctgcctttcccaaggtagcaacgtgctatgtagctcaacatcaccagtgtcctgaaactgctccaacgttgatcttgcatttgccattgaactgagttcattctctttcctttcgccttttgaaacactctactacttgttctcttgcctctctgattatttcttccaagtaattttataagctacactaaaacttgggttagcaatgggtatttttccccccatttcgttcttggttgatcaagtcaaagtattatctcagcataggcagagtccggtgcttgggaagtggtattaaagagatttcagataaatacttcaaagccacttcattggaatccccaatttaaaaaaagttaagaaatcataaaatgagtctttaactagattttggtggttgtcatttggaagaaattctaagagtgaattccagcctgtttcctgatttcctgttgtccttatttactcctagtacatggtacatgactggaatccagtagaaaagccccagaatgtgtattttagtccctacagccaacagctttgagaatgtacagaaaaggaggctaaatccttgcccctgctgtggcttcaattcataagcttttgtctcttctctgttccatttcaaaagctaaagctaagtgtcacaggacaagattgtagtggcttcagagaatggtaggcttgagaaaaagactattgatgattcaaggggataaattatggtagaaatttaaacagtatttggggacataaaatactgtttttgagttgagtaaccccaaacaagaagaaaaacatgtatttaaaaaaatattttatatttttcccatttttttctggccatttttctttattcattttctgagagggaaatggaagcgaaaatagaaactattatttcttttttcaagacaaccaggtcgatcatgaaaagtgtaagaggtcaccatcaggtagctaagcacttcttttaaacctatgaataaaggaaaaaacacaagatgttaaatagtaagtgtgtatggttgctagttttgaacttcagtgcttaacaatgtcaaagtcaaagtgttcctgtgttgctgtgaaataagtaccaatacatgcagagtagctactattgttgccacatgcaaagaaaagacagcacactcagtaaattcttttagttgtgtttcttatagttaaggaatgttgatctattttatgtttttgtggtgtaacttaacatggcaaagaaaacaatcatgttaataacattttgcgattattttccatatgccaagcgttggctgaaaaacataagggtaagtactacaggtactatcattccagttttatagaatgtgcatgctgtaagaaagacaaaattatattagtgtatgaatgaacaccattacctacccctgttgggaatcaatgatgataatctcattagaatattgtgctaattggctgcaaataatatgtcagcaatatttacagctttaaaaagcttttggttttaggtggttgattagcagggatggcattacccggaaaatacaactaggttatagtagtattaaaaataactcaggtttttctaagtttgaaacattaatattttttatgctaaaaggttttaagaaaacacttgcaatttacagcgccttgtttagtcctcagcgatagaatagtgtaattttaaaaaaaccaaagtagggccaggtgtggtggctcaaactgtaatcccaccactttgggaggctgaggcgggtggatcacctgaggtcaggagttcaagatcagcctggccaacatggtgacaccctgtctttactaaaaatacaaaaattagccaggtatactggcctgcgcctgtaatcccagctcaggagactgaggcaggagaatcgcatgaacctaggaggcagaggttgcaatgagctgagactgcaccactgcactccagcctgggcggcagagtgtctcaaaaaaaaaaaaaaaaaagtagtattcccatttgaaatgtgtataatcaacatgatacgcccatatcagtatttcaggtatgccaacaccaatgattgggaaaaaatatatatagaagtggaattgctggatcatatggtagcaattttttatttctggaagaacctccatgctgttttctgtaacagctgcattttacattctcaccaattgtgtaaaagggttccaatttctccatatcccaccactatttatcttttgtttttgtttttctaataggcatcctaaaaggtgtgaggtgacatgttaagattttgatttgcatttctcttaagattagtgatgttgagcaccttttcatatacccgatggccatttgtatgctttttaaaaaatgtctattctgccgggcgtggtggctcacgcctgtaatcccggaactttgggaggcaaaggcgggtggatcacttgaggtcaggagttcaagaccagcctggccaacgtggtgaaacaacatctctactaaaatacaaaaattagccaggcgtggtggggcacgcttgtaatcccagctacttgggaggctgaggcaggagaatcacttgaacccaggaggcggaggttgcagtgagcagatgcaccattgcactcctgcctgggtgacaagtgcgaaacttcgtctcaaacaacaacaacaacaacaaagtctattcaaggctgggtgcggtggctcatgcctgtaatcccaacactttgggaggccgaggtgggtgtatcacttgaggccaggagttcaagactagcctgggcaacatagcaaaaccccatctctactaaaaatacaaaaattagctgggcatggtggtgcaaacctgtgatcccagctactcgggaggctggggcacgagaacgcttgaatctgggaggcggaggttgcaataagctgagattgcaccactacacttcagcctgggtgagaccttgtctcgaaaaaaaaaaaagtctattcatttaaaaatgtctttgcccattttaaatcaagttctgttgttgttgttgttgttgttgttgttgttgtttggcttgtttgtttgctgttgagttgtaggagttcattatatattttagatattaactccttactagatatgtggtttgctaatattttctcccattccgtaggttgcctttcactttatatttttttttcctttgctgtactgagcttttcagcttgatgtcatcccacttgtgtatttttgctttcattgcctgtgcttccgtgtcatattcatgaaatcattgcctagaccagtgtcaggaagctttcccctatgttttctcctaggagttttatagattcaggtcttacatttaaatcattaatccagccaggcacagtggctcatgcctgtaatcccagcactttggcaggccaaggtggttggatcacttgagtttaggagtttgagaccagcctagccaatatggtgaaactctatctctactaaaaatacaaaaaaataaaataaaataaaatagccggacacagtggcggctgcctgtgatcctagctactcaggaggctgaggcacgagaattgcttgaatctgggaggtggagcttgcagtgagccgagatcacgccactgcactctagactgggtgacagtgagactatatctccccccaaaaaaaaaatcattaatccattttgagttggttttctgtatggtgtaagataaggtcttacaagaagacctgtactataagaagaagcagcttgttataaattaccccgtctaaggtatttcttcacagcagtgcaagaacagactaatacaacctcatctaacatagttgtggctcacagttctggaggctgtacaggaagcatagtggcttctgcttctggggaggccgcaggaaacttacaattgtggcagaagtcaaagggaaagcaggcatgtcttacatggtcggagcagaagaaagagcagtggggacagaggagtgccacaggctgttaaatgaccagacctcacaagaactcagtcactgttacgagaacggcaccaagggggaaatccacccccatgatccaatcacctcccaccagatccagcctccaacattgtggattacatttcaacatgagatttggatggagacacagatccaaactgtatcattccacccctggcccctcccaaatctcatgtccttctcactttgcaaaacccaatcatgccttcccaacagttcctcaaagtcttgacttttttccagcatgacctcaaaaatccaaagtctcatctgagacaaggcaagtcccttctgctcatgagcctggaaaataacaaacaagttagttattttcaagatacaatggaggtacaggcattgagtaaatacttccattccaaaagggagaaattggccaaaagaaaggggctacaggccccatgcaagtctgaaacccagcagggcagtcattaaatcttaaagctccagaataatctcctttgactctaagtctcacattcaggacacagtgatgcaaggggtaggctcacaaggccttgggcagctctgctcctgtggctttgcaggattcagcccctgtggctgctctcaagggctggtgttgaatgtgtatggcttttccaggtgcagggtgcaagctgccagtggatctaccattctggggtctggaggacagtggccctcttctcactgctccactaggcagtgctccagtggggacactgtgtaggggctccaatcttacatttcccctctacactgccctaatggaggctctccataagggctctatccctgcagcagacttctgcctggacatccgggcttttctatatatcctctgaaatctaggcggaggctcctgagcctcattcactcttacactctgtgtacccacaggcttaacactacatggaagctaccaaggcttatggcttacatcctccagagcagtggcctgagctatacctgggcccctttgagccatggctagagctggagctgctgggatgcagggagcagttctcatggctgtgcagggcagctgggcctgatccacaaaacctttcagtcttactaggcctttgggcctgtgatgagaagggctgccatgaagttctctgaaatactatcgaggccttttccccattgtcttggctatcagcacttgtctttcttttagcttgaattgctctcctgaaaatgggcttttcttttctgccacatggccaggatgcaaattttctaaactttggaaactctgcttttcttttataaaaaagttcaaattacaggtcatttctttgcttacacatgtgagcagccaggccatgtcttgaatacttcactgcttagaaatttcttccatcagataccctaaatcatcactttgaagttcaaagttccacagatccatagagcaaggacacattgcagccaggctgtttgctaaagcatagctttactccaattctcggtaactttcccgtattcacctgagacctcctcagcttggacttcattgtccatatcactatcagcattttggtcacaacaattcaagtctctaggaagttccaaacttttccctcatcttcctgttttcttctgagccctccaaactgttccaacctctgcctgttatccagtttcaaagctgcttccacattttcaggtatcatagcaatgccccttttcttggtactaattttctgtgttagtccattcttgaatttctataaagaaatacctgagactcggtaatttataaagaaaagaggtttaattggctcacagttctgcaggctgtacaggaagcatagtggcttctgcttctgggaaggccttaggaaacttacaatcatggcagaagtcagaatgaaaacaggcacatcttacatggccaagatatggagtgagagttggggagggaggtaccacacacttttaaatgagcagatttcaccagaactcactcattcactatcatgaaaacagcaccaagagggaaatgtgcccccatgattgagtcacctcccaccaggcaccacctctaacatttaggatacagtttgacatgagatttggggatacagatccaaaccataacaaaatccaatttgattatgttgcatgtggatattcagttttctgagcatcatttgtggaagagattatccttccctgatgtatgtgtattcttggtacccttgccaaagatcagttaactgtttatctgtgggtttatttctgggctctatattctgttccactggtctataaatctgttttaatgccattgctgtactgttaaagttactgtaaattcgtaataaatttagaaatcaggaagtatgatgcctccaaatttgttctttctaaagtttgtgtttgactatttggagtcctttgttgttccatatgaatgttaggatttttaaaaaaatttttgtagaaaataccattaggattttagtagggattgcattgtgtctgcagattgctttggatagtatggatattttaccagtagtaggtctttcaatccatgaacatgggctttcttcccctttatttgtgttttcttcaatttcttttattaatcttatgtagttctcagtgtagaaatattttatctctttggttaagtttattcctaagcattttattctttttgatgctattgcacatgggacccagcaatctcacttccgagtatatatccaaacacatgcacacgtatgtttattgtggcactactcacaatagcaaagacttggaaccaagccatatgtccaacaatgatagactggattaagaaaatgtggcacatatacagcatggaatactatgcagccataaaaaatgatgagttcatgtcctttgtagggacatggatgaagctggaaaccatcattttcagcaaactatcgcaaggacagaaaaaccaaacaccgcatgttctcactcataggtgggaactgaacaatgagaacacttggacacaggaaggggaacattgcaccccggggcctgttgtggggtggggggagggatagcattaagagatatacctaatgtaaatgacgagttaatgggtgcagcacaccaacatggcac

SEQ ID NO: 5000 - DNA, 1492 bp, Homo sapiens
gagatgcagtcttgctctgtcccccaggctggagtgcagtggcacaatcttggctcactgcaacctccaccgcccgggttccagcggttctcctgactcagcctcctgagtagctgggatcacaagcgtgcgccatgttcggctaatttttgtatttttagtagagatggggtttcaccatgttggtcaggctgatcttgaactcctgaccacccaggatccactcgcctcggcctcccaaactgctggaattacaggcgtgagccaccgcgcccagcctaaaacgagatttctatctcgtttttcaaacttataccacaaaattgccgagaaaatcccaaaaaaggaaacaaaccctagaacaatagaaagtaagtctcaacccaattccaggccaaatcaatattaatgagcttcttcatacaatcctcttaatgatgagaagtttacaagaggtggagaaaaataacgtggttagaagcagtattcattgatttaagtctgaagttaaaacttctcacttctttctcgattgttacataaatctctggaaaaatttagtacagtcccttctcccacacttttttttgaaaattgataatctccatgcagtttaaaatccagccgtaacaaaatctgagaagtgccggcacttagaacttttcatttcaaagacctgaaaatactcgccaatatggaacatcctaagcttcactggaactgtctccgtagccactccagttttagagagcaaggaggtccagccacaatggttaagcaaatagcatagaggagatgaaggaaaaacgaagaggaaaccaccagcaacatcaacaaaagctctcataaaacaacgtgggggagggcatatactcaaatcatacatgggaaaggtgtggtgggaatcatcaagcaatttagaatgttgagtaaacagagttcttaggctgaaaaaccaacgtgaagagggttaggtatgtaattaaaagaaaggggggaagcatagagaggagggccattcctctctgtaagctgcgaaccccctcctgtccacagtctcatttcttcacccactccacgaattccccgttttctgcactgagtggtcagtttctggtaggcagacacctaattgcctcttctctaacccagtccctcttggcagcgtcttggacacagtaactcaacataggcagacagcattcctgagcgtctcgctactccctgagctgccttcgtgacgctttttataccacagtggaatcgtctacttgtctgactccccgaagactgcgctcctggccccgagaggcgcttagtaaacaagggttatcaatcaatcatttgtggactcgcgtatctgcgcctccctttctacaatccccccttacgctcccttaggtgaggaccccgcattaatcatccatatcctcccctatcctcctccgagtgctcgactcccctgcagcccggcaagctcccagaggaaagg

SEQ ID NO: 5001 - DNA, 2298 bp, Homo sapiens
atgactcaagtaaaagctcacaagtaatttcttctgaaacccagatcactgaattacaggtttgcctatagatgtaccaggtcaaaggctgtgccagagagaatgaaatactaattattttcaggctgataggttcagttcctgcaaagcctgtaggtcttgctctaccctttgactgccttaatcagctgccgagcttcatgccattgtttacaaggggaattgggtgaataaatgtagacagattacagtaaatccacgttgcctgcaaaagtgactaaggtgtatcctttactgataaagtaaggatgaaatgtggaaacatataattaaattataaattaccaagcttttgtgataattcatatgcttttaaatattttgaacctaagtgttaccctcaaaatgttttaaaatataaaaatcaagaaatagagcaagcaggaaatgggattttaaacattttgatttcaagaaatagaactatcttaaatatgatgctgaaacaatctgagaggcaggagataggactcaggcaacagagatccgaggaaatatatatgggcattttgtggttcatttttcttgtgtggcatgtggtacaactgaagcataaatctttttgatatcatctagttttgccagaggtatgggacagttcatattctgtccataagttcggctacttacataaactgaaatacaagtgcaactccaaacaggttttttcttttctggacaccatcatcaagcatggaagactggatctggaatttcccttcatatcttgccagttggcctcccagtttcttgcttatgttttctcctggtgtgttttcaacattgtaattgttttcaatcaactgtataagttttattttcttcaaagcatctattgattccttttttaaaatcatgtctcctagctcctttaaatgtttggaaaacggtagttaagtttcttggtatcacagtagtacttcttattatccaaagctggaaggatgctgctgccagttagctggggtaggtactgcaactaaaaatgcaaaacacagaattaggttcaaaactgtgccatgcatttttttcattatttagaatatatcacaaaagaggtaattaagctttttagtatagaagtactttttttgcacacaatccaggacttgagagaggattaaatgtttcaatttcgtcttggcttttccttttaaatgtttatattaaaaaggaaaaacattcacattaaagaagatttagagaatatgaaaaggggaaaatctacatgttaacattattgggaagaaaacatagatttacaggagttgagagcttgctgagatcttagggatcatttaagccaatgccttgtcttatagcggagaaaactgataaacagagcacctaggcaatttgcctactcactctcttcccttagttaaaaaggcaaatcaagcatggcacagtgtacacttgtagttccagctacaagggaggctgagtgggagcatcccttgagcccaggagagcagcctgggcaacatagcaagatccccatctctaaagaaaaaagacaaactgcttccttcaagcttcctgaaaatgtttgaatttattgtcaatgtcaaatgaaagaacacacctgtattttttgtattgcactatatgtccttcggtatccctaaaaagggaactgtttagtacttttactttctagaaaaaaatttttcagccattgtcctcagaaaagtgctttttagtacttttaaatcagttgattctttcaggatttaaaagcagtacaccaggccaggtgcggtggctcatgcctgtaatcccagcactttgggaggccaaggcggatggatcacctgaggtcaggagtcgagaccagcctgccaacatggcgaaaccctgtctctactaaaaatatagaaattagttaggcatactggcacatgcctgtaatcccagctactggggaggctgaggcaggagactcacttgaacctgggaggcagaggttgcagtgagccaagatcataccactgcactctagcctgagcgacagagtgagactcagtctcaaaaaaaatcaatacaccaaatagtggagtttccctattttttcaaatagaaatatttccatcaaaaccttttgctctcgaatacaaactaatactgagataaggaataattctggcgtgggggtggaggagtctgtttctggcctgttgtgctacctgggtcacatatgatggagaataaaacattaattttgtaactgtgatctac

SEQ ID NO: 5002 - DNA, 744 bp, Homo sapiens
gggcgcagcggctcacgcctgtaatcccagcactttgggaggcgaaggcaggcagatcacctgaggtcgggagttcgagaccagtctgaccaacatggtgaaactccatctctactaaaaatacaaaattagccaggcgtggtggtgcatgcctgtaatccccgctactcgggaggctgaggaaggagaatcacttgaaccgggaaggtggaggttgcagtgtgccaagatcgcgccatggcactccagcctaggcaacgagggtgaaccaggtccaggaagaaggtgcaaagacagcattccaggtaaaagaaacagcttgaacaaaaagtgtgtaggggaaccgcaagcggtcttgagtgctgagggtacaatcatccttggggaagtactagaagaaagaatgataaacagaggccagtttgttaaaaacactcaaaattaaagctaggagtttggacttgtggcaggaatgaaatccttagacctgtgctgtccaatatggtagccaccaggcacatgcagccactgagcacttgaaatgtggatagtctgaattgagatgtgccataagtgtaaaatatgcaccaaatttcaaaggctagaaaaaaagaatgtaaaatatcttattattttatattgattacgtgctaaaataaccatatttgggatatactggattttaaaaatatatcactaatttcatctgtttctttttacttttagaaatcacatatgtgactt

SEQ ID NO: 5003 - DNA, 1276 bp, Homo sapiens
gaggggcggggacgaggaagaggatgtggctggtgccctgggtggccgcagccgctgtctttcacgcctttctcactccacacggtgccccgaccccagggtcccgaaagtcccaggctgttggacgtggtctgggtggggtgggagggacgacgctggcaaaggcgggctgagaggatttctttatttcgcgttcagacccaacacactcggacaccttggggccctgtgagggctaagtgtcctctgaggccggcaggagtctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgtctcacgcacacgggcacaggcacgcaggtgccggccctgccgctggctcccaagaggccgatagcccggtagggaggtcacacacacacagctgatccctggaggtaaagaaacctagacgaggagagtggaggctgggcctgcgcaaggaggcgccaaggggggagaccactgcccacaacagggtcagtcccgcgagagggtcagttccgcgcctgccgcctgcccgcccagctgcagggtgctcgccattgccactgctggggagcatggtttgggccgagaaaccagtgactccgggaggaaatgcagaagggccggggtgccagcgccagtgcccattatgggcagggctgggcctcacgtctgggccagcgagagctcctccaagcctctctttcccaggcggtacctggcgaggtccttcctggtcaccaacccgacaa

SEQ ID NO: 5004 - DNA, 1900 bp, Homo sapiens
ccttcctcccccctcccctcctcctcctcctcctcctcttcttctgtttacctcaagtttgaattttatctgcgcaacattagctggaatgcggacattgaaaaaaaaaaaaaaacactctctcagcccggcagcagctccggaggagccatgtggcatcaagccacagcaaaggggaaaaagtgctcttagcaacacaaacatggcgaaatcgctctcacaagccgggttcccgcgacagccctaccttcccccgctcgccttccgaacgtcctggccaggaaccgcagaccccttccgggggacggcgagggggccccgggctgagcgagggtgggcgcacggggcgtgctaaggggaaattgactagccagccgatcagctccgccggcagcggaggggacgccttcttcacgccctgagatcgcaaaggagagcaaaattcccatcccaaagtcctgcgggaccggcttccccacccgacgaacttaccccagggctgaacgcacgctgctttagctccttgcctcgttccttcctcccgggcgcgacgcgaggtgaaaatgatgcgcacgtagatttgtagagcgtattcttgagaatttccctgggatgaatcgggaggagcggtggagactccggagacaggtgccgcgctggtctgggctgccggctaaaagttgtcctccgcgcggtgggcggtggggtccccggccagggccaaggaccccggctccctgccccccggcgtcgcccacttgtcacgccaggctgctgcgtgcactcggctgcaggggaggtggcgtagtttctcttcctcccacctcttctcactcacttgtttttgtagccgtgggctcccctaatgctttcctctccacaatgttgtttcattatatcatgtccatcatgtgacaccagagaggcctctctatggaaacttaaaggggctcccacgtgactgcagcagcaacaacagcagcaggactggcggcggcggccgcagcggcgtccgtacctccacccaccgggagcccctcgaagcatcccggaggggcttctggcgctgcaggagccccgatcggggagccacagcatccgggagccgtggtgtctgtgcgtgcgtggagcctgtgctcatgacataggaagccgaacagaaggagcgtcctcaaatcctttcctacagtcaccaaacccacgctctgttaaaatgacatttcgtggctcctactttgtttccccggagagcaatgagttttctatcaggcctgatttagtttgacaaaagtcaaaaagaaaaactggatttgtccctctgcgagttcagtcagatcgctgggaaaacagaaatgacaaaacaataataacagaaatagaaccaggcatttgatacataattaccatcaccacggctttcaagctttctggaattacgttcctccagtaactgttgatgatgcttgcaggaggcaaaatgcaatgcagtttttctcttccgcagctatattagggctttgttgctgacaacagtgaaaacttgtttgtgtcaggaagtgaggaaactgtgtggattggcggaatcaagaaaaacttcgcaagaaactgaagagtgggatggaagatcttttcgtttggccttgccttgactctgtctctctccacctcatcagtttacttcatcagccatgatgaatgagctccattccaacccttctaattctataatatctctcccaagttttaccttcctatctcatgcctaattcttttcatccctttcctcctacctcccttgcctcccaactcagccccttttctgcctgggggctcagctcgggcctccccaaagactgtaccccccaccctcccctgcagctacccccacccccacgccctt

SEQ ID NO: 5005 - DNA, 514 bp, Homo sapiens
gaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaactaaagaaaacagaa

SEQ ID NO: 5006 - DNA, 1158 bp, Homo sapiens
gtgggaagtgcggctcctttcgcgtcccccaccctctcggctccgcctggcagcagctccgccgcccagaggcgtccgagaccctccgactcgtgggtacgcataggcctcgccagcgagccttgcccaggcaacgagtcgccagcccgccccctcgccgcgggctaggtctcacctcgccaccagtacgtcttggacaagtagtgccaggtctgatgccgggtgtggtgagtgccgccgggacccaggtgcgccgcctcgatgaggtcccggcgtcgctccggctgcagcaccacctccagctccgcgaaggtcttgcggtgccgctgccgccgctggtaatacagagtcccgccgcgcaccacgtagcaggcggcagcttttcggattttacgcttgacattgccctcggtgcccggcgcatacggctcgcgctcgttcgtcaggtaacgcaggatggcccggtagctttcctcgcttgacatcgcggaccgcggctccctgagggcgcctgtcagggacaggtgaggaaaacggcccgctacctacgggcggctgcaggaggagcggcggcaccgtagggagaaacggctgcgcctttggcgagcgctcttcgacggctcccttagtccgaaggaaaagcgggcgagttggtaaccagggggaactgcacttctccagcgcgcgggatccgctggcgactgacaaaatggctgctgcaccaccggaagtgacgcaaggcaagggcggggactgagccctgattggagcgcactctcgttttctggcttgatggagccgatccagtgacgtcaggaatgcgggtggacattttggaagcgggtaggacccttcactgcagttcgagggagtctttaagcagacatcttaagtcctggcagtttctcttttcatttttcccttttccacgctttctaaggagccacgtgtagggggagctggtggacagttgagagttcagccgaaacatccagagggttaggagtccgtttttacgtttgagactcccaacatcataaaagcatattttcaggcttctggaaaaatattagtctcttgacacgggaccagagacagcccatttacatggaaatttagattccagttaacagttataaaattttcagtgcctccctc

SEQ ID NO: 5007 - DNA, 376 bp, Homo sapiens
gcaagacggactcgtggagacgcgccgccgccgccgccgccgggccgggccgggtgtcgcgcgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatca

SEQ ID NO: 5008 - DNA, 2130 bp, Homo sapiens
cattttctacaaaatgagaggttaatcaatgttaatttgagtttatagactgaatataactatgtttcacagattttgtttattctcctagaataagccttttgtcaagctctgtatttcagaaacactactctattatacttggcaaaacaaaacggcattcctgagagtgaaaccctagtaataaggatttacattatgaaattaagacaaaacaaatgtagctgttacggattttaaaagttaggtcactacatgagtctagtgggaagaagttatgagaaccaccagaatcatctagaaatttttataagagaacatgactaaaattagctaaaacttacgaattagattagaaaaacagatacatccattcatttgaattgcttctataagcaacagtgtttcttttctaaaatattaatacagtaatcatcactctcctaaagctctccttctgctaggaggaaaatatttcctcaccctactgatgttgggcttagtcatgtgatttcattcacattaattaagatgcagaattttatctagaaatattacatgacttagtctaacattaaaaattaggttgacaaaataatcattttacctaagaatatctagttacttttaaattagagttaaagcattaaaataatgcatccagttttctgtattacatttgtttttccataagtacagataaaataatattaatgatatatcagatagttttaaaactaaacactggcaggattctattttattatataagtaaaagtttagaattcctttctccacaccagtaattttgcagaaaactaatcaggaatattctgaaaatatgttggcactcttatttctattaactgcatatggtttgggattcaacttttagaataagccacgatgcatgatgcattagattttaaccagctgacgacccttggctatgtgattgtaaaggagatggcaaaatatcattgaagatggccatgtaaaacatcaatgagataagattcactcttacccaagatttttctatctatatcagatttttctatacagcagcaggctattcctgagaatgtgtccttcacttttttactttcatttgatgcgggtaagtaaatgtattcaatgagtttcaagtgtgtgaagaaagtgatataaagtaagggaaaattatggcacaatggctgtaactcctggaaagtaatgaaaagacagaatgtctcgagcatttgactggaaatagaagagactgcatcctggtgaactgagttaatttcaaatatattactctatggttttctatcatgtgtactctcactggctatattaataaatgaaatagtgatgaatggttctgggaacttgtagtgaaacttattaatatttcaacattatcaccgagtatctatgtcaacacacatcaaaaatgcatgagaaatgactacctacactcactagttacacccattagaaaaatatctatgagaagtataaatgacacacataaatttgcaatgtgattataggtagaacatacagcaagaaaaaagctacaggaagatatcacgtggtgaagtatgtgaaacaaatgaaagcaaattaattcttgcaatcggtttggaatacactgtatgaccacattaaataccattagatttgaaattatgagttcttagaaattactaacactaaaaaaatttcaacataatttaaaagtaggaaaaataaatagccactatcaaactgtaagtggctcatcagttctatccatggtgtaattttggaatcccctacttaaaaaacaaaagtaaaaacaaaacctttagttttcaaaagtttgttctactttttaaattgatgaccaagaggtaataaattcacattagaatgaggcatggccgtttaaacaataaatcaacacttaacccaatagtttccaagttgttaggtaggcttaaaaaaaaaagtctgtttatacctatatcagaagacattcgatttagttggggggtgtctgtcaaattgattgtttagcattatgcgtagagtataaaatgtcaaccatagaaatggagacagaaatcactttcaaaatagcaacatctgtgtagtagcttt

SEQ ID NO: 5009 - DNA, 4801 bp, Homo sapiens
agacccacggagtcaaggcctcgctgagtcctcaaccccggccgagaggccggttgttaggaggtgaaatgtggatcacagcgcctggggaggcccaccttggctgcccgccctggagcgacctgaagggagggattcgagctgggagtggggctgccgcgggtcggacgcccctctagggagacccaggacccgggagagagggccaaaccccaagttacacagcgcaacagtacttgtcaaccactccatctcctcagtgacacaggtgctaaagtacctctcccctgaggcaaagtcccgacacatctgtgattgaatgcaactatagaagtattagcataaaaatatgtggcctggaaggaatctctgaagatactgaagaacctcaagttccctacattgctaggagccaagggaaggagacactgtacacctagagcgctgaattagcagctgaggttttagtatttgaaagcaaataatataaagcgagtaatgtctacagtgggtctcagttaccatttggctacttatttaggactcgattaacttggcaacttttacaaaaaacattcacatcacaacatgcaacttaaaaaacagttaatgtaactatgccactgtcagcaaggccagcttgcataccagagttaagaatgagagtgtctgtctgcctagggcttaacattcaaagatatttataatctgtgttttaaggttaaattttatatgacccagttttccttctttgttcactatacactaaaattaaacgcctctacgctgtgcaagaaatcactatgtgtgattttactatttcaaccaatccatagaccctgaggatttggcagcagaattcaggagaaatgctacctaaagtgattgagctgttgctaattctaccttctgttccactcaagtacctccagggactaacaagggaaggcaagggcaactgtgactgactaggtaaccagctattctgttgtgacagaagaaaccaggtaatacttgattttcaaaagataattttaactgctgccctatactacttttagtatagtttggcttgaccttaatagccatgtccctcatcttagatagaataaccaaattggtttaaaattacttgatctatgtcactgaaacctgaaatatgccatcactaagagaacccccaaataaaaaataaagaactaaaaaacacaaccaaaccaaatcaaaccaaaaacctcattctctgtatcatactttaaaactaaaataaaaatccctgtgtcacaggtgcttgctcagggctgccaacttctatttttcacctgagagacatctaaaagcgcaaactatgcttgtaaaaaccaaaaagtaaatctctacataggacaatacttataagcagacctattgataccacttatatataattagtctgttttctttagaaagtatcagagcagaaacgtctttggttaattctttcctctacatgcaaaataaaatattcttaaacgatggactgtttatctctggatcttgatgagtttgtcaatgccatttagaaaaggggacaacacactagaaaagttgagataaaaatggaaggaaccaagaaagagagaaaacattcagttgccacattcccatcactgtcagttccaactgccagcagagaaatgccaataagaaataaaatcacacacacgtaccacagttgtagcttcatcagcttttccaatgattactactagcatatttccgactaaaggggtcaggatttaaagctagctacttttagcacaatttagctaatgcaacagaaatatgacaatttcttcattattcccccgaccccctgcaaaaaaagtgagatgaaaagaggaaagtagaatggcaatttttaagaaatgttttaaaaatctgtcagactcatcatcatcccagtttatccactctaactataaggagagaactatgtgattaacatgacaaatctctgaaccagtattacaagcatgtccctgtaattttttccctattaaaatctttttgaaatgaaaattaaataacctatcttggcttgttaaatactgcccacccttgcattgtacacagggaaggcaagaagactctgaggtgtcacatgccaagaacatagtttcagaaaatgaagataggcaaggcccaagtgtacatgaggcacacaatagaaaaggaatttcgccatctgtgatctcgaaattacaaatggagaatgacaaagaatgactctatataaggatatgtctctctatatatttataaatatttatataatttaccatgaagacatgcaagtagtgttatagcaactattatacaatataatacagaaggactgatcttccaatattacagttgctttagataaacagcaagtatgtcttatctattgcattcctctggagtgtttgaaactggagagaaattaagattccacactatgctacatttcttataagagacgttatatgcctcaatagtgttttgagtttgtttttttaaaaagctcaacacagataaagagaacaagagaagttcagtgcagcttcagggcagctttgatgcagcattagaagatgttcacttggggaggaaatgtattcctttcttttttttttgtttcccaattcaactgtattaggtttggcagcaaacacaaggtcaaacagaaagcacatatgtttgctagaaggcaaatttcaacagcaagcagaccaatttacctgaccttaataaggtctttacaacacaaaacacctagagagtataaaaacagcccattttaaaagtctggtagactttcatttgcctgattcctattagaagagtgagattagaacaaatatcttcctctttacagcttcgtaaattgagattgtatgaaaatcaggccaagaagcccaaatgttgaactaaaacacaggagaagcaggtaataaaacattaaaaaagaaatatttgcctaaatttatttccccagatattaattccttattggctaaatgtataaaatacaaagtttgaggattctaagcctcaataatatatctaatttatttctaaatctcaaatcacagtccaaagcattgtgcttccctcgtatcatcttggatgctgatattacaaacagttggaacccagaagacttaaggaagcagtctactctggtcagttttccttctactcaagtttctaaaggaggacacttaacagagatgaaagggcatcttctatcttgaaggctattaacccacactttctttctctccctaaacactaaagcctgcaaaatagctctagttagacttttctttcctttacctaactttcttatttttcataataaaaatgtaatatgttaagaactcttgctctaaaaaaaaaaaatcagggggacctaaaaaaaagtaattggatttgatagtacaactaggaccataaaataaaagcagagagattgaatcagacgagacatacaaaattttaaaaaaaaatctgaactccagggagggtactaggaatgaggcaaagtaaaggtgttcattctcaatacacgaaataaacacacaagccaaatatacatgaatactggctccctggcaacagacttcttatataatctaatatctgatcaatgactcttcagggtgggaaagttttgaatgaaaatatcaaacaagaagtttcacttttgctatataatctttgaattgaggcttaaaaaaattaggcaacccccctaaaattccattctatctcctatcctcaactcttttgtttcaaaggcagcttaaaaaatgagagctcattttaatgagtttctcccccttggatttttgctctatttttccttcttgtacaaagacattgattcctaatctacttgctgcctgccttaggtaattccttatcatgtattatgtcttcttataaataattgatcatgttactttcttttgcaagagaagatcaacactgatttttttacatagaaagtacagggacacacatgcatcaggtttaggaggaagatctcacacctttcaaagagatgcagcctggctcctatctgctgagtttactggctggcttactcttcccttggggggttttagtgctggctgagtggtggtggaggctgccggatcctttcaggccattcttgctgggtttgcaatgctcctgttggcaggacctcctggaggaggaagatcctgagtggctgggaggtgacttgcttctccccagatgtggggacgaactcctctggtcatggtggggccgtccagccctagatggtgaggaactagacgtgcgaggcaaggatgagcttcgaggagaggcactgggactcctgcgagggacaactggactcttgggtggtgtttttggattgtgaggagatcctggactcttgcactgagtagtgctccggggtttctgagatccattttgaagaatttgggccaggcgggagaaaaggtctgagtcggagttactactccctaggactttatatctgcgtagccttaaaagaacagagaaaatatattttaattttaattcatttcaagtgtgcctaaaaagtcacaatgtcccaaaatcataatgtgaatgtgtagaaatcagaaaatagactaacaggatacagggttactctgtcatatactagttgtatgaccctggacaaattcttcaatctctccctgctttcaatgggaatactgtctatctcacagggtcactgaacagaccaagg

SEQ ID NO: 5010 - DNA, 557 bp, Homo sapiens
ctgtatgcatgaagggaaaagagacgaatatcaagtttttctggccaaccaagaaataaaactttaaaagtgtttattttttcaggaaaaaaaatcacagatactacttaaatattattaccaggacaacaaattagcaaataaggcaagttagaaagcagcattttcaaggttaaaggttgcactttaaagctttaaccatgacttctgaagggatcacacaaacatctttaaagacttctttgttaatcagaaaacagtttacatgcaaatttccacactggagagccgaccgagatcaatactttcatgattattcccaatttactgctttatcagaaagaactttactacgaagcaagaagtgtctactcttctgtgaaggagtaagttttctccttgtttctgaaattctttattctagctgaattctcaagactgagcagtgaacttccattggttagcaccaaatagagcaagcctgagtaagctgcttataaaaaggggaaaaaaacgacagaagaaaacttttaataaatggaatatgaggcacataa

SEQ ID NO: 5011 - DNA, 3715 bp, Homo sapiens
aatgaacattttaatgttatgtataacagaacattatgaatataatggaaataaagttttatcaatttaataaaaaaattttcaacataacatggggaggtaataatttgatatctatattatagtatttattttgaaaaatattcccagcttgagggtaaaacaattaattttgcattccaaactctagaatcatgattttcatgtgagcttaatgcagaattacagcagaaaaacaaaaacattttcattaatttcctttgtcattaaatcaataaaatctttgactgctacaggtctcctttaacaatatatatttaactcctctattggaaccatattgctaatgctgcattatatacactcaaaaccaaaacaaaacaaatactgtataaaatctaaaagcaaacattgagttgtaacatttatatttaacttaaggttttaatggatttttacctttgcagacacccaaaaaaaaaataaaataaatatttttctgactgttcctgacttaaatgatggctacagggataaacacggaaggaagccttgccaagttaatcactgcaaattgtaaataatgactgctaaaaacaaacagaagtttttttcttttaaaggaaaccatagagcagtcctgaaaaaaatttcttcctagttctgcacaggataattacagcagaagacatgggaaaagtcccatggcaatcaccaattgcttaaagaggttttgttacaataaaaatttggatagtataatagcagtgttgctggaacattagcaaaagtatatacattccagttacctttgatttagccataatcacatatgtatgcttttttttttcttggacaaaaatatatatttttataaaaaactgatcatccaactttaatgatttcatatatggactcaagagtggtagtaaaaggaacagacccaattatgacaaggcgatccagggacagaaaaatcaagttcctcaggaaaagaaagtataaaattagagattcaaacacatttattcagccctattccagtcttcccacaaattatgctgttaaatggactcttcagttgataaaggctttcaatggtctcaccacccacttgtggtctatcctcactggaaaaaaatgattttgactgcctcatctgaagtgctcttgcctggccctctgaaatactggatatttcacttttataaaacagcctttttggttctttatgtagatttattttaattacttgataaaagaaagggtagttgattagcattttccatcccaacatcacctatctgcacagctaaaaattcttcattcaatctgcttcttttacaatctcttatttgctaaaattggcgaaatttgcaaaggcatcttgcttgggttgcacagttccagaagtcatggctatgttgggcatgcccattcccattgtgcctgtcaagcccatcccagcagcggacatccctatgttcatgttcatgcccatcatgctctggttcatcatcggagtatttccaagaggggccattcccatggtgccagtcatcacattgggcatgctcataggcatgggtccccctatcaaagcattagtttggggccggacaggaagcatgttcgatggagaactgaggttcacagctccaaaactttgagtcatcacattcataggctgctgcatatctaccagacgaaaacagacagaagaactttaccacaataaatttttaggttcatagaacagagaactaataacttcttgaccatctatctatacttctttagccccaataaaattcctttacagtgattttattagaaatcaattactctgcactggttcctcttgagacatatattcagtgactattggctctggttccccagagatgtagaaacagtaagagtagactggggaaaaacagccaacttaaaaacattcctacaaaacctattgttaaatcctacttaacaagttgtcaagagctagtgtgtataaaaaatctttcaaaggtttacatcctttgacttattctatttttagaacattctattaaaaaaatcagaagtatgaagatttatacaaaaatctttaaaaagtttatatcctttgacttatttttagaacattctattaagaaaaaaacagaagtatgaagatttatacaaaatcttgatttataataacaaatagctggaaacaattgaaataattagcaagggaaatcatacactaatataactatcaagagctaacaatcattttcctaagaatattattcaacacagggaaaatgataacttaatgttgaataagaaacagtatagagagaatgatcccaagtattaaaaatatgcttagaaaagatggaaagtggccgaatttttgtatttttagtagagacaggattttgccatgctggccaggttggtcttgaactcctgacctcaagtgatttgcccactttggcctcccaaagtgctgggtttacaagcatgagccaccacgcccagcctgactccaattataaaagaagttctactttaggtaaaatgctatcgagcagcattgcatgctacagagaaatcatctgtgaaaggaagaatctatgatgcagaaaacttcattgttattttaagaaattgccacagccaccccaaacttcagcaatcccacaaccctgataagtcagcagccatcaacatggaggcaagattttccaccagcagaatgataaatacctgctgaaagctcagatggctgtactttttagcaataagatatttttaaattaaggtatgtacttttttaaacataataccattgtgcatttaatagactaccacatagtggaaacataacttttatatgaactgggaaactaaaaatttgtatgacttgctttattccaatattcactttattgcagtggtttggaactaaacctgtaatatctctgaggtatgcctgtataacaatttttttgtttacatgatgtcttgtaaaagattagcataaactgctaaatacatattctgaaagtatatcatctagatttaaatctagactatcttctagatgtgctatctgtggcacactcttggcattctgtgcccaatttcctcataagaaaattgaacataacaatgttgtcacctttgttcttggcacatggcaaatgctcaataactattagcttttattattagaaatatctggatttaaaggatatcctctgtaataaatatcaacttaccaaatttaatgtattcattcaaaaatatttgagcgcctactatgtgtcataattgttctaagagttagtaatacagcagtaaacaaaacaaagttcctgccctcaaggaacttgcatatcagaggcaggagatgaatacatgtaacagaggaaggcaagcacagaaaaaaatagtgacgagtgtgagtgcatactatgtaatacaggaggtccactgaacagaacagagaaagtgagggacagtggtgggagaagagatcacaggcggggcaacaaagagccagatctgtacaggcaattaagcaatgagatgagaagccactggagaattctgaacccatttgacttagtatttttaaagaatccctctcgctgctgagtggacagcagatgacagggctaaacattttacatgcttagtgagaaacaggccatccttcaaa

SEQ ID NO: 5012 - DNA, 8815 bp, Homo sapiens
acccgcgaacctggaaatggagcctaggggctgaggttttgcgcgcctggttccaagggccactccccgtgtgctctcctctttcctgcgcctcagccgctgccgtccccccacccccaagggacttttgtgaggcagaaacgcatcctatactcgggggatcctgtttcctttcaaaacgcctttccaggcttgcccgttcccggctttctgggcgcggggaccagaattagaagccactggggcgggagccagggcttttctctgtcagatggttcttgcgaggaacccctaagcgatacgaaaggaaactcttctttcttcttttccctaaagacatggcgtgattcaaacgtatcgtgatttttgtcatctttcagaccactgctgtccaagagaaatataacgccatccaactgtgtaatttggaagtttctcataggcacataagcttaaaaattttaatgatatactttatttaatccaatatatccaaagtaagatttcaacatgcaatcaatagaaaaactaaatgcgatattttaattcttttgaaaatcgtatgtgtttctgaaacccggtgtagtgttgacttgcatatgtctcaattcgggccatccctatttcgagaggttagcggccacctgcggccagtgctgtctcatcaggggacacaggcagcatgattattactattattattattgagacagtctcgctctgtcacccaggctggagtgcggtggcccgatctgggctcactgcaacctccacctcccgggttcaagcgattctcctgcctcagcctccccagtagctgggactacaggtgcgagccaccgcgcccagcccacaggcagctttagatggtctagcaggagctcagcacattcagttagattctttttttgagatggggtctcgctatgttgcccagattatctgggactcgtgggcccaagcaatcctcccacctccgcctcacagaatagctgggactacaaacgggcaccacaacgccctgagtttgattcttgagtccccttctgtgggcaatatggttataaacttgatgaggagccaggccatacaaataataatacagaatgctacatagtcaggtggtgaaatagtaggtgctacgggcaaggagaaggagatcaattttgttaaggaaagcactcttggctgcaatttctgttgaaagtttctcaaacattaattcaacttaatgaagtgggatgctattatattagagaaatggctaatgtttgttcttcaggtggtcttgtcttgaggtgatggggtttattagagctttccggaaagaaggggcaatattcttactctctcctctcacagtttttccccagactcccaggaacagagatggaatttcacatcttctgctctgggaaagtcacattaggcagaacctcagatccttaaaataagggacttctttttgggaagtctctggtcatttaccctggtacacattaactgggttatctgcaaactaggactgccaacattaggagtaattgtgttcagataaaatgtctctagacttgatacatctgtactccaaccaaaatgataaaaaaatttaaaatgaccagaatggccctttgtggtgtgagcataatagatgcttgctgtagagacacaggtgggaaggagcgagccagcagtgagtgatggggaggacagaggggatcatggtgatgggatgtgtagaggaaggattgggtgagatgaaacacttcaaataatgtgctatttggaaaacattttaaaaccataaatacctcacagatctagggaatgtataatccaggtgttacgtcactatgacaacaagtagttgtagcttcatttactagattgggcctctattcttttttgtgttttttgagacgaagtcttgctctgtcactcaagctggagtgcagtgacgcgatctcggctcactgcaacctctgcctcctgggtgcaagtgattctcctgcctgagcctcccgagtagctgggactacaggcgtgcatcaccacgcccgcctaatttttgtatttttagtacagatggggtttcactatgttagccaggttggtctcgaactcctgaccttgtgatccacccgcctcggcctcccaaagtgctgggattacagtcgtgggccaccgtgcccagccagggacctctattctttgaactacaaggcaaggtcatcctcccacccccttatccattcagtgaacatttactgaggcgttactctgtaaagaaccctgagagagaccaggctgagtaagacaggctttactgccgatttacttccaatatgctcgcttttcatctctgacattctgtggtcttatgaaaatggaaatggagacaaaaagatcatggtgcccccagtcccatggtcatttcacattccaatttcttcttagttgtacttttgaattaattttatttcactttgtccctttttttccttatttgcttttttaatttcttctcttcctcttcctgggacatcaaccatccaatttaacctttcatcctcccctactacctaatccttgaaaaatacaagtccaaaatcatttcatcaccagtaattgtctttaaattgctccaataatttgcaaggaccaaggggaaaagagaaagattaaaaagccaaatgcccagagaaacagattttataaataatctaaaatctagtatacttattcaccatcaatgccatcaagcttttaaaacaccctcatagtctggaataaatccaaattatgagaaaaacatatatggatttaaaaattgtttccttctgagcctactgtgagtcttttagggggataaaaaagtaaaaagtaaaatagaaaattactgttgcctggttacttagctctaaagagaaacggagaaataatgcccatgtcccatcccagtttaaatgaattcaggtagagtagcccatgacagcaagcccttggcacacatgccatcacatctggcctttgaaatgtctatagagatagtagaaccctagacctagggaagacttagggaggtttcatacagaaagaatgacatttaaaccatcccaaacagcacagagtcttcacaatttctgaagaccatcagagaagaatatttattttctatttgcaagtaactactcctccccatttgaaaatttagcaagcctgatcttaagtaaattctttacaaatcctcctttattcaagtgaatttcctctttttagctaccagtatgtaacttttataatcgtgaagtcattaaatgtcccttctgccttttctggcatcaacctatgagctttatttcttaattactttttttttctttttggttttaacattttctttctagcttcttcaaatttttttcatttttaaaattggagaccagaactggacagttcctctcaacagggccaaatcagattcttttcttttttttggagatagagttttgctcttgttgcccaggctggagtgcagtggcgtgattttggctcactgcatcctctacctcccaggttcaagtgattctcctgccttagcctcccaagtagctgggatttcaggcatgcaccaccatgcccggttaattttctatttttagtcgagatggggtttctctatgttggtcaggctggtcttgaactcccgacctcaggtgatccacccacctcagcctcccaaagtgctaggattacaggtgtgaaccaccgtgcctggcttcttttcttttcttttctttctttaaaccaggttattttctacacaacatttttgtagaggtatgtatcctcaatactgtgtttgctgcattgcaatgtcattcccttcttctatgtgctatcccatttgtaatcttattccattttttttcacgtgtttggctttctacttagtggctcccatttaatagctgtatgttttttagcccgtttctccagattgaagtttttgaatacatacatgcaaggtacagtgtgaaagcccttcgtatgcattatttcatataagccatgcaactcattttattaatgaagaaactgaggcttagagaggtcaaaaaacttattcaagaccacacacctaagaagtagtagagcagtgatttgaactttggcagtctaactgcagtaactacactcttaacataactattcaattgttaagatcatattatttgtgtagcaggctctcaaaccaatagaaaaagcttgggatccctgttaaaaaaaacctgagaaagcctgggctagggttgccggacttaacaagtaaaaatacaggatacccagttaaatatgaattacacataagcaacaaatactttggtatgagtatgtctcatgcagtgtttaggacacatagtacttagactaaaaattgtacattgttgaaattcatatttaactaggtatcttatgttttatctggcaaccctaagctgggcagctttccagagtaaagactgggagttcgtccactgaactgatatcaaaatgaattttggttcacttgaaaatatctttgtcctttggagcagaattgcagtggtgtgtgaactgtttaaaatgataaatctctatagcacctaccaagaattatgccacgttcacaaattctgtatcgataatggggatagattttcatctgtttatttttagagagatcttgtacttaactcactagtctgggatgttttatttatgtcacctaatattaactattgctaaatttcactttaataaaaaagtagatacaaagactcattttacttagcaagactgcaaataaaactaagacataaattcacatgttagtattgtccaaaacaattcctccagctatcaacccacggcaatcaatccagcagtatcatttatagaatgattactaaaacaagaatcatttctcagttacaaatggggtcattaagcccttggggctctttgaaagtagaagtagtttgcctacttaatcatcagtctacacaaaggcagaaataaaaaggaatggaaatacaaacacaaaatgattggttattacctgttttataaggaaacaagaaaaaaaaaacagtggctagaaacaacaaaaaagcagtggctggaaccctactgaatagagcttaaagaagtactggttacattcacagacacagtagccactagccaagatatagtttatctccatcaaacttaaatagataaagtcagtaagtatgaccatcttactttcactatttacgctctttaaatagtaaaggtatcggtttgaaagatacatagaaccataggaacagtgaatgatcatttataaaacagctccttttcctgaatcaatatattgctaaaattctttcagtaaccctccctttttatatgatcacagatccctccacatctattttattttagttatataaaaattattaataaactttggtttccttgcattcggtccttatattttaaaaagtgattaaaaacagtactgaatatgaatcacttctgcaaagtttaatgagtgagaaacattcaaccaaggtgatttttccttggaaaaccctacaaaaactgaattttataaacagttacttattttgatagatgttccatttataaatagcagccattacttcactgtctacaaaattgcaggctgtcacattttacatgtttagaattcaaatgttttaagattagattttctagtaagagttaaaataaaaacaaagttacacagacaggttagttgtcctatgcaaataaaacagctgattttcatgattttgctatttagacagataagagacaaccattggattgacactaatgtgtaggataacatattttttgtttaaagaggaaatgatagaaacttggggtggggcagctgcagcaggacttgactctactgaggctcttctgtgctcatgggacaagctatcgcaggatgttagtaccggagaggccctcaagttaagacctgagcaaagtgtgctattcagagaagctgagctatccctgctcccggttctactgtggtgaattggtgttttctgaggtctaggcaacaagagctcagagtagaaggagtagacattttcgggaagtgggatgctgggcatgtcatgttgctctaacaagtgattaatagcacggaaatgggaggaagatgaatgtattttaaatggatactccctatgctagtcttgggaaatgaccttcttttcttgagacggagccttgctctattgcccaagctagagtgggatggcatgatcttggctcactgcaacctctgcctcccgagttcaagcaattctcctgcctcagcctcccaagtagctgggattacaggtgcctgacaccatgcccggctaatatttctatttttcgtagagatggggtttcgcatgttggccagggtggtctcgaactcctaacctcaggtgatccgcctgccttggcctcccaaagtgctgggattacaggtgtgagccaccgcgcccggccaagggaaatgaccaccttctgaaaggactctggagcacattaaaatccatcactcccaggcacattttgttgcctgcaaaaagtgtgcccaggaccagaagtcccaggagtcagaacagagaagggcaactttgaagtaaggggagctaacactgtatctttctaggcaggctcaatgctcccaaaacttctgagcaagctggcccaagctctgggaccattccttaaaccagaagtctgggcatgggcccaaaaagaaggcagggattgctgccagaaaggaccattcacagattcacctagggaagatgggtataggagttggcggggggggggggtggggggtggggggtgggggtcagctcataacagggccaagtcctaagccagaggtggtcatggagggcaccaatatgcttgcaagttaactccagatagctgccctccacttaattctagacacaacccatgggctatacaggttggacaccccctacccctcaatctcaggatataagaaaaaccttttgttcaaatttgctctccccatcctgaatctcccaaggtgactcaaaatgttctgacctagtaatgaaaaagaaaaccctttgaatggattttggcacagccattccaacctggggacttgggcatgaactctgatttgctccacacagctgtctctggagactgaatgttcagcctgacttgcgttgctgcctgcagccctggatttaaaaacacaggctacttagtgaatagagtccttttatcactaagtcagacccactcccagcacaagccacaggcattaagaccaggacatctcttgactgatcgttcctcctcctccacacatggtgtcagacctcttcactacagaatctctacaataatagaaagacacttcatctcgaggtgcacacataacctgtcaggcaggtcctgcagtggctaagagataacaaggatcccactccagcagctgttaagacacttgagttgtttgtccctgtcttcttgatgctgagtggaaccaatgaacagaatttttgagaagaaaaaaaaaaaacaaatcacagcataggtgaaaagatgccgaaataattgagttgtggtgatcaagctctgactctagaaatgtagtcagaaaccaccactctgagccctagggcaaggagcaaagtgtatacaaaatcttgcaaaacctagcaccagtacttccttatgagggctcaagaaagcacacctctaaaataactcacacacatgcagacaagaatgccaggaaggtcaaatgttctctgcagctgtttcttcacagctctactggcaaactcacaggcacatatttgctcagttgctgagcctcacccacagacatctcctaccttggaggcagaggtgagaacactggactgcattttcccaagtaagggaaatcaaatgagttggaggtaacactctacatttctccctctccttaatgacagcatccctaattaagccagcctcaaaggataaaattagtgtctagaggtcaaaggtcaagcccatgatttacaaatcttattggaagtcatataaactgcttacctgaaataaaaccccccatcatcagtccccaccctcctttccctagaaagggagtggatttaagttcatttcttctttttcaccacagtaactggaagacagtcagagaaggtagtcggggagggaggaacattctgattcatcttaaaaaataaagatctgcttaagtatcatttgcagtcatatcaagtttttttcaattctccttagtggccgtctccaagggttcatcttctaagccaaagcttagcttgtcagctagcccctcaaactgcttgctcacactgcccgcagagtccatgaacatgttaggaatgtctttgccaaagtaaatcttgctgttggaagcaatggccttgtacttcatcagctgcagatattcaggggttagcttcagctgttaaaaaaaaaaaaagtatggaagacttatgttgaaccatattagagaaggaggggagtggtgccccttcaattttcctatatttatgcccctacctactttttgtggtctcattgttacatttctgtaagagacagtcatctcagatcttggagcataggtgcaaaagttaaaagtttccatgtttaacacaaaattaaactaaacttctatcaaggcatgtccaaggagaaggaaagtacctgc

SEQ ID NO: 5013 - DNA, 3209 bp, Homo sapiens
gttaccgagcggccggcgctggggtggcaggggcggggctcgccgaattcccggttctgggcgggtgggcccgccggctccggcctggtttcccctacctgtggcggggagtgaggaaagccggccctcgggtaaaggaccctaacttttttttttttttttgagacggagtctcgctctgtcgcccaggctggactgccgtggcgcgatctcggatcactgcaacctccgcctcccgggttcaagcgattcccctgcctcagcctcccgagcagctggggttacaggcgcgcaccaccacgccccgctaatttttgtatttttagtagagacgaaatttcgccatgttggccaggatggtttcaaactcctgacctcaggtgatccgccctgggattacagacgtgagccaccgcacctggccaacgttttaacagcctttagccaaagcctgggtgcagctccagttgagagggagcggctgttgccggggcaactgctcccgctcggggcagcgagggccggtcagtctcgagaattaagacggagggcctcctcggaccctacagagttgtttgaataacatttttccgtttgtgggaaccctaaccctaatccactttgtgctgtcccaggactcgcatagaggagtgcaggttctgatccctgctgggaagaaaaatgattaggactgtaaagccttctagctccctcttgccaaagagaggctggtcacagaggcgggagacagtctgttgagcggggagctgaccatctgaggacagacactgaggaaggaggatggaatgattttggcagtgaatgacaattccttcaacaagaccccccccccccactcacttcaaagaaacagtggacaggatgtgctttccaaaatactgcagtttaattctgaaaaactcaaatgcaagaggcccagagctgtctatgggattggatctcctgcaacctgccttgggccccagaagagactggcaatgtcagcctcctccctgctctgcctgagggaggccacggagaacttccttatcgggcccaaactggagccgctgactgctcagagcaagatttctgccttgaaagcaaatgcagtagcctcagaaatgtgcagcgcatacttcttcctccccctctccccctccaggccggcagagctgcagtaaagatgcctgcaggtcatgacctcatgtttcctgtccacttcccatggcagggatcggagctttgggagatatgtgaccaaggaggacacatgaacttgctacccctctctctaccccagacatacccacatgactttgttttactcatattgcattggtttaactcggaaatgggtgacctcccaccacctaacctgactcagtaggaggggaggtaaagcagtttaggccctggtatctgtttgagaagttaaaggaaagggcatgggtggtcagggaggaggcagagcttggggtcaaagggatacatgtcaggggaggtttgcttaatcttgtctcccaccagctccaggagccagggatttctcttttttttcacaacacattccaaacctaggaaagggatttctccttatctggctcttaacccaggagggctaaacacttcagctgcttgaagaaatcgcctgtggagctgcatgcctgccaaaggattgggataagacacatctagcctgggcatggtgccttctgcgtgtaatcccagtactttgggaggccgaggccggcaggttgcttgagctcaggaattcaagaccagcctgggcaacatggcgaaaccctgtgtctacaaaaaatacaaaaattagccaggtgtgatggtacacacctatagtcccagctacttcggcggctgaggtgggaggatcgcttgagccccagggagtggaggttgtagtgagcggagattgcactactgcacctcagcctgggcgacagaacgagactccatttcaaaaaaataaaaacaaaactcttttcctagttctgacctgaggtttttaggtgcacaggcaggaaggtagctaagccagggattcaggggggggaggggctcccccaggatctgaagtccagagaacaggagcctggaaccaatatttccaggtgccccaatgtgcttgtgtgctggagaaaaggggcatgcctccaggggggtgttagtaaggccagagatagccagctagaccctactctctgccccttgtcctccccctcccatctccatatctcttatcttccctgaggctttggtcttcctcacagcacaagggcccacttatttgggagatggggcgaagataagctcctggagagcgggagacagtgaaggctggggtcacctgagcctctgtccagctgaactgagggtgcgatggagtcattacctgccctcacccccaaagtgcatctgtgtcccctggggctgagctggagcaacaccacctttgttatgcttaggagggagggccggccccccaagtcctagaaagcaaaagggccactagctcccagcctcggttttttggggatccaggcgccttttttggtattaaattatgtactattaaaataaaagctaagtgttttaccctccctgtggatgcggggagaccgcaggaactcaagtaggagttggagtatagctccctgctaggaagcggctgtgcagtgagtcctccatctttctccccattggctcagcctcttggaataagccaggcctgggagggggaaggctgcatcctgtgtgcctccagagcctcctctctgccccctgggattcacatgaaggagcagcagctggagcgcttcttctgggactctacatagtctcggatctggaagctgggctcatccgcctgatgcccggcccggtatttcagttcccttgaagaagagacaatgggctgggctgggctgggctgggctggggtgaggagctgagccgccccctcccctctcccagtggcccagtgctcccagagcaaatggacctcagcctgcagaatgcaggtgtgtccaggggctgggccaggggccgggccctactggattcctggagtgtgccgccctgccccgcacacttcccttccctgcccagctctcacttggcgatggccagaaaggctaactccacattcatgccagtcttggcgctggtctccaggaagggaacaccgt

SEQ ID NO: 5014 - DNA, 732 bp, Homo sapiens
ggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctcttccttgcccgaagcggaactgctgaaggagcggcagcgcaggccggacgaggtgaaccaggtcatttaaccgccttcagggtctcactgttgtgcagtctggagtgcaatggcacgatgtgtgctcactgaaacctctgcctctcatgttcaggcgattctcccacctcagcctcccgattagctgggattacaggcagtaagctcctacaggacattttaaaactacataaatgtgccatccccagctcaaccgattataaacaactgccgaaagattgtgggtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtaataaatgtgtgttgttttaaa

SEQ ID NO: 5015 - DNA, 3382 bp, Homo sapiens
acagttcccacactgcagtgcctctggtgaggagacagcgccactgaggtgagccttggggatctggggacacaggcatggggtggccggagccctggggggcaggcagatggggagaatgcttctctgccccaggcagtggggagcagcagtggactgccagcttcaggtcccccgggggtcagcaggagtgggaggcagaggggtggccagttagccgagagggacaaggctggccgggagctggcaggctccgttcctgcctgggtgcctggcttctgtgggtggccctgggctgagagagaccctcagggggacctgagagggtgggcgggggctgggctgcctggaacagtgtatgcccagtcctggagtccagggctctgaccctgactctgactgggctgctgctatggggttgctgggtgccagcagcggcaccgtccaggggactgtgaccctcacaagtgcctgtgctagcaggggggttggcggctggctggaatgtgctggggctactcccactgcccaggtggagagtctgagtggagggagagatcttccccctgccataggctcacaggttttactccaagctactgatccccagacccatagacccacatggtaaagacaggcacttctccctcccctaggggtctttgaccagctccctccagacagcatccctagaagagctttgcccagagttgcaaacagcagggtttcaacccagagcctagatattcctgcagtcagcttcctggaactgggctggacagggaggaacgggggctctgtggataggggtggggaaagcaggtggagacagaggcctggctccaatgaggctacaagtgtgatttttggagacaaccaagggccacaaggagatcttgagactctaaagctgtgcaggtgggtgggaatgatctgaaggggcagaagccaagtgccaagggccccacccccttctcggctggtagcggggatggagaggcagggctggagaaatgtatggctcacacctttccagggaggtgggcagggcggctctgctggctgctagtggaggaaaagaaaaggccagcccagacgtgaagggacaccagggaagaccttctcaatgggatgcattttgggggtctagcctctggctctctggttggggcacagccaagtcctacagctccctggctccccaaggaggcagtggtgggccaaatcctggtgagtagtggtcccatgaggcggagctgctaagggcagtggcctcataggactgggcagatggggcacttgttccaggggccaactgttttgccctcttcccttggctagaacttcctcatctgagcaaggcgacagctgcacctgctcccacccctgccccctagaaacccccggatggaagcagcatgtctagagaggtggaatcagagctgtgggcacgagctggtgccaggctgagtgtccacccccagcccaccctcctccagccactacaaaccagctgagtcaggggaagtggagagcaaagcctcagaactggccctagcggttactggggagatgtctggcccacagccttggggagaaagcccatctctcctgggctgggcacagctcacgacagccccatggtcctatagctgatgtggcagcctgcctaggtcattggcttccctatcatccagggtgtgtgtgtcccccacccctgcataccccctcccttcccctagcatatcccaaatcctcttacctagctacggattctggcctggggttaagccagtcctccctcacctcagtctgggcctcatcatgcccctcgcacatgacccagacccagagggaggcaggttgccctacccattttccagagacattagggggctctcttccaggcggctcagctcactctgactccaggcgatcatccatcagctccgtgatctcccagggcactgtacaccctactggccattaaagactcagataccattccctgctggtgcctgcctagtgccagaggccagcaggttgctcactcagcctcagtcagtgagcgccaaggtcccgctggctctaactctggtcctaccatgggagaagagggcctccctgagccaagagctccctgagattccccttggaagaggccaacacctctaccttctttctctccctccctgagctccccacttccacagagctttcccgcacagatccacctgccgctgataccttcctaaagagatgatagggcaaggatgttttccccattaaacagatgagaaaacaggcctggagaaaggaaggtgggaaggccaggactcggacttaccacctgactcctactccagtgctccttccaagccacttaaatgccaccctcgtgagatcctacatgagtggggtccctatgcccaccaaactgtccactagctgcccagcctctgcccccacaaatcctcaacaccctgaggcattcccagagacagatgggctcagttactcccaacagtgtttgagccagggctttcggccttggttccaaagcaggcatctaaagggttccctgggctggctaaaggctttggagctgaggctgcataggggaggtgggagagggtctcagagcctggtaatgcacctctcctatctgcaaccccttccatctccttgcatgcccccaacccccgccctctgctgtaaggaagctggctctcagcattaaagtcccaaaacagcttcatgacattattccctgccaaaatcttcatgaggtttgccactgatgtcaatgtgaagtcaactccctcggccaggcacactagcctctgccagtcttctgggccttcttgcccaacttgctcattgtatcccctacactctaactacacctgtgtgtctccaccctgggatggggcacagcagagctcagagactggctgtgggctgcactacacatacacatgcttatacatatattcatgcacacgcacacatgcacacacacacagatgtgcatacagatgcagacacacatttatgtagaagcccaccactcaactgcgcatggttttctgccaaatcacacacacaatggagctgtccctctgagacaagaaggttccaacacatctgctgtgtggatccctggagaggccaagcatggttgtgtcgccatcccaagcccttgaggggcagtggggaagcagaagtagatcccctggatctggctgagcccttgcttggccccagggtatctgagccccagagagtggcagaggatagtcaagcaggttccaactaggttcttaccctggttctgtggcccttatgtgggactgtacagtccccagtaagccaccttctc

SEQ ID NO: 5016 - DNA, 8707 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaa

SEQ ID NO: 5017 - DNA, 1556 bp, Homo sapiens
gagatggagtctcgctctgtcacccagtctggagtgcagtggtgcgatctcagctcaccgcaaccttgcctcccgggttcaagcaattctcctgcctcagcctcccgagtagctagcactgtagggatggccactgcgcctggctaacttttgtattttcagtagggaagggtgagtcagcatgttggccaggctgtcttgaactcctgacctcaagtgatccactccccttggtctcccaaagttaagggattacaggcctgagccactgtgcctggcctaaaatttttcatttttcatgtaaattaaagctaataagggccagtttttattctctaaccaagaccttttaagttaaattgatctttaactacacacacacacccctgcccaagggtacagttctactttctactagtagtaactctccttttccactttaattttgaggaaaattatttacacagctgacccttgaacacaggtttgaaatgtgtgggtccacttacatatatggattttttttcaataaaatttttcagagatttcaacaatttgaaaaaacctgcagatgaaacacatagactagaaatatcaaaaagttaagaaaaagttaggtttatgtcatgactacataaaatatatgtagattagtctgttttatcatttactgccataaaatatacacaaacctattataaaaagttaaaattcatcaaaacatatgcacacaaaccttaagaccagacataataccacttgtagtcaagataaatgtaaacaaatgcaaagatgcagcattaaatcatagctacctaatattaactgtagtacatactatactactgttaaaatctcatagctaacttctgttgctactgcagtgaactccagggttgcaagaatctgtttaaaacactgtgtgacactaatcatctctgtatgatcagctcatctctccagtaaattgtgtattgcaatcaaaagctatctctctcacggctcttgtgtgtttttcttttcttttctttttcttttctttttttttgcgacagagtctccctctatcatccaggctggagtgcagactgtctcaaacaaaaaaacaaaacaaacaagcaaaaaaaaaaaaaaaaaaaaaaaacaaaaaaagggaaataaatatgaatgtttactttatgtgccatcattctggaacacagctgggggtatgcatgggacagggagaaggcaagggagagggaaacagcagtagtgtttctaagtaactttgtcatgtaaaaggagtttacctctttaaactcaaattttggaagtcctttcaaaaatacatacttactagcattctcaggatgttttaactctttcttcatagtttaaacatgtgagttatctaatattgaaacttaagtgcagatgcagatagtgtggagcacaggactagatgagaaccaaccctagaagttgccctgtggcatgctttcttggaagaaaaaaatcaccaacagcttacttttgaataatcttcacatgttcataaagcaaaagtgtcaaat

SEQ ID NO: 5018 - DNA, 8708 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

SEQ ID NO: 5019 - DNA, 8708 bp, Homo sapiens; identical to SEQ ID NO: 5018

SEQ ID NO: 5020 - DNA, 3153 bp, Homo sapiens
agaaaaaatattagacactagacacagactattaaaattcatgctcctcacattagttctaaataatagtgtgtactcagaataaaatatccatgtaacggtgattgagatgactctggttccgtagaagtaactgacctaagatcagaacttttaaaatgaaacaccttttaccaatatcattcaaagatacaccttgacgcccacttcctctccttctctagtatccccaatgataaagtatcaagatcttgtcattgtcctttctccgtgcaggtctggaataccaaaattcaacacactaagtcaaatgccaacatcttgcaagtcccacatacaggtgcattctcatactacttgttgagccaattcagatcttcccaaactacactacaaagatgccattacatgtgcagtgaagagctagtccaagccctaattgaatcctttatgagtgaacattaacgtcttcttctgtcgtaataaatttctgttcacacttgaatcccaacagaaagctgccggaagcgactggctgggattcccatttcagttttcctgttgtgtgtaggtgtaagaccatcgttattacagcgttaagaaattttaatttttccggcaacatgcagccgacccgttccaaagaattccctgaactccgcggctgacaactaactcccttaactcacttccaacccctacaggcagtctggaaagattagtcacctcctctagccaggcggtcccgctccaacacctcactcttacaccctacacagagcagatgagcgtctcggccacctccacaaaccaaatgccaatctgaggtgtgtgtcacccctgaatttcccacattctgaaagagaccctcctcttagtggagctttctgccgtggggctgaggagtagcagctcccagcgtcccgtggaaggaaactcccagagaagagcaagcgctcgcgctcccacccggagcaggctgtgctgattacaacggcgggaaatgcctgtccagagctggtttcgccaaggcctttcaagtagagactctaggaccagtccgtgacaagcacgccggccggcactgctccgggtcccagaccagctcgtgcgggccagagccggggacatggctagggagggatccccgggggcccggctcggcccactctcccaccctacgctgagccccccgtgagtcagcagccggcgaggggacccggggattgcctcaagccctcccacaagagtgagacctgggaggctctggggagctccgagcggcctgcgcccccggcccggcccccctcacacagtgagtcagcagcatcagagccggctagccgggcccctctccgctgccgccgaccgacataagccgagctgggccggcggggccggggaggcggcgcggcgacctttaccgatggagtggaggatgtcgatggaggcctcccggtcggtgctgagtagagactgggctctctggaactccaccaccgccgccgccgccatcttaccgctctcacaccgtccccggccgcggccgccgacgccggaaacacacacccggaaagcccgccctcgggtccctccgcctgtagctcccgtggctccgttcccagagcactccgggagttgtagtctctccgccgggcgcgggctgaggggtggggagagcgggaccgcctcgcaggtgggctgcaagctccccagcgcctcctagcgggcggccggcgaggaaaagaggcggtgccccgcagtgggagctctagatcggtccccgcccaccccaaaagaggcttcttgattccggccccgctcgcgcacccctgagaggggttcctgagtactgggctaggtattgagtcaaagctgcgtggctttctttgcggcttccacgatttaaccattcattcgggacgataagtgaccttataaagtgctcgctatgtggcaaagaatagcaccattcgaatgcgttccagtgtctgacgcctgtgcgccgcacacacgctttccaggcttgactcccgcagaacgctggccggcaggtgggcaaacccgccaggaccggagaaaactgtcctcacgcgcccatttaaccttgggacagtgctggacgtgatgaagtgaaacatcacctttgctccattcacgccacaaatacctcttgggaatccacagaagcctcacccagctccccagctcaaagaaaaaaaaaaaaaaaggaaggaaggaagggagggagggagggacggaggaaggaaaaaattgaattattcttcccaatatcttcagccccttcaactaaagtcacagatatcagtgaagacgtcgtgtggacggaaaaatgacattctatgagaccacttagggttaaacttaagaaaggtgctaaaaggatacaaagacaattcagtattaaggaagacctttctctaggtgatgacgatccaaaaatggaatgtgctgtcccataaaaggaggcaaaaaggggactaacattgcacaccctcctctgagacggtgtttgttcttgttgcctgggctggagtgcaatggcgtgatctcggctcacctcaacctccgcctcccaggttcaagcaattctcctgcttcagcctcccgagtacctgagatcacaggcgcccaccaccacacccgactgattttgtatttttaatagagacggggttactccatgttggtcaggctggtcttaaactcccaacctcaggtgatccacccacctcggcctcccaaagtgctgggattacaggcatcagccactgcccgcagcccaacagacagggtcctggtctgtcacacaagctggaatgcagtgtgtggtggtgcgttcttggctcactgcaacttccaactcccaggctcaagcgatcctcccacctcagcctcccaagtagctgtgactgcaggtatgcaccatcacactcagctaatttttttgatttattttttgttatagaggctgtttctcccagtgttgcccaagctggcctcaaagtcctgagctcaagcaatcctctcacctcagcctcccaaagtggaagcacgagccaccacacccagctgatcttcacttctttctctttttttttttcctgggttcacgccattatcctgcctcag

SEQ ID NO: 5021 - DNA, 11193 bp, Homo sapiens
ctcgcccccccggagccgacaaatggccgcggcggcctcaggtccggcgtcactcagacaagggggcgggtggaggaggaagcggccaagtccacagtcctgctcccgtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttggagtctcattctattgcccatgctggagtgcagtggcaacagcgtgcagtgagtgatcccggctctctgcagctttgacctcctggctcaagtgcttttcccaccttggcttcccaagtagctgggactacaggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaagaaaaaaggaaagaacaattaaaaaaagagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggattgtcattgatggacacagctgggtgagaagacatttgagaacaggatctttactgatctcaaagtaccaccacacagatattttattaattaccaaagggaaaaattattttttatttttttatgagacaaagtctcactctgtcacccaggctgaaatacagtggcaaaatcgtagctcacaacagcctcgacccccaccctgggctcaagtgagtctccaaattcagccccccaagtatatgggactatagtcttgtaccaccacacccagctaatttttttttttttttttttttttttttgtatttttagtagagacagggtttcaccttgttgctcaggctggtctaaaactcctggactcaagcgatctgcccgtctcggccttccaaagtgctgggattataagcatgagccaccacacccagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctttgactcttaaaaaatgccatgtcatgaaagatcaaaaaaagtagaggaatgttttagattaaaggaaatgaagacatgacatgcagtgcctaatctttgattggattctgtgctattctttcatctttctggtatgtttgaattttttttgaaatataaacttgggcaaaagagataaccaagataattgattaatttattgttatggctcattgggggcagtttcagagaaataaaaacaatctttgtaactggagtaaattctcaaggttaatcttaagcaatatagcatggtcattaagaatacagattccacagccagactaggcttaaatcccagctctgtgaataatgtgaatttgggcacattgattaatctctgttccttggccttgtcattataatagtacctacctctaatgagttttgaggattagatgaatcagtacctgaaaaatgcctgacacacagtgagtgctcaataaatgttaactactgtaattattacattacagaggttgtgggggggccttttctgagtcctccaaaaggatgactttattagggccacattaagactgtggaaacagaagagtattcaacagataaatgaagtctatgagttgggggtacaatttatggagttttagattaaaactgcatccaataagttggtctgacacatctttcaaacctatagaggaataatcacaagtgactagtattcctttgggtccaatagaggtctctgatcttcatacagattgaatgtacccagaaccgtaacctagcattttacttatatagcaaccttaactctgacacaaaagtgtttcttttgttttgaggccaagtctcactctgttacacaggctgagtgcagtggtgcaatctcacttcactgcagcctctgcctcctgggctcaaatgatcctcccacctcagcctcctgagtagctagaactacaggtgagtgccaccatgcctggctcatttttgtattttttgtagagatggggtttcaccatgttgcccaggctggtctcaaactcctgagctcaagcaaccctctctccttggcctcccaaagtgctgggattacaggcatgagcctgaagtttaattgttattcttttcctgcccccgacttttgattttaaacattttctttttttcctttaagccttaggatggctaggaagcattttcagatggtataatgaacacctgtataactttcatctggaatcaacagttgctaatactttgccacatttgctttccatgtgtgtatgtctatacattttctggacaaaccatttgagagtcagttgcagacaaaatgaccctttgccattaaagacttcagtgtgcagcccctaagaagcaaggcattctcctgcataaccagaggactatcatcacccaatggaacttcatattatcattgtctactatgcagcccatatacacattttcacaattgtcccaatcataacatggcttaaaaaattcagaatccaatccaacatcagacattgcatttagcgttcatgatttttttttttttttttgtagaaagacctttaatacttctgtttacaaaattcaggcatacatttcagtttgccctgaaccgtgcccaaggctgtgtgctcatctctgccaggatgtctgtgccctcatgtactgctgacgtggagggtgcagagcagagcctggggtctggaggcttcgctgggcctcagggggaggggaatgtgaatgtggcccggcccagaggaccctccatttcatcagttttggattgggcaacagaggaagcagatgtctgggctgcagacctgctggtctgggcaggggtttgggaaccccggggttgcctgccatggtctagaggagatggctgcggctacttcccacagggtggggtggccactaggggcttgaagatttgctcactggagcctttgtgcttggccctcagcagcacagctggggctgtggtcccgtgcaaggtgtgctgagggttgtgtaggtggctggtggtggcagcttgtgccagagtgacacaggcttctgtgggcctggctgggggcagttaaaaagccgaaaaggtacttggctttgtgagggcaaggcttgggaggcggggccctgcaggacgtcatgttctctgtcctggttaggaggggggaggtgttgggggggggaaggtggggcagatcccaactggcccctgtccctgggctgcaagctgacagcaggccagggaagcagtgaggccttctgccctggccttggggagaaggagtgcatgtgtgaggctgggatacagtggccctggagtggggctagggctcatcgccagcaccaggcgcggggaggatttaaaaccagagtcctgtctctgagccaccccacagggacgcttgatccaagcctgttaaggccgtggaactcgagggtaggcagtgggctgggccaccgtgggttcaggatggaggtgtgggggctgccctggaggaacgttagtgtttctgagagcaccttagtgttgctctgcctcagccagctgggcaaggagttggggagcggggaggaggccggcgccatggagtggggaagggagccgtcactgttggggatcagccgctagtgtaaacgagcatctccacccacccagataagccccccacccaagtgtggagccctgctcagggagtacctcaagggccccggcctgggtggcgccagcaggcttggacactgccctggcagcaggggccccgtggaaggcaggatacccagcagggggtgccacccagtgtggatggaggggcagggcgggggcgcccctgagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatcggaaagaggacgaagctgcgatcttggggactgtggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctctgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcatcgctgaagttggactcgtcgcgcagctccttcccatggcggatcaggcactcgcccaggagcccccctgactgcaggtagccggggttcttcacctggccccggatcttgcacgcggtgttgagcatggtcagtttagcctgcgaggctgggttgggctgcgggtactcgatggtcctggacagtacttacgtcaccgccttgctgatgacatccaccttctccatctcttcgaagtcatcatccagcttggtcccctcagcccctccgaccttctcactgaccagttggctcgccttgtagaactgcttcttcagcccggcaaccgacatgctgcctcctgccgcggaaccttccgcccagacccccctgcccagaccccgccagcgacaggctcccgggcaccaccaaccctctgcgcgcctcagcggcccccatcagcaccgcctccaccacccgcttgccagctcggcgcccgccccggcgccgcctcgagttcatgattctttagtctccttcaatctagatctgttcccaggattgtttaaaagcatactgacaaacctttgagactgtaaatgacctgaggtatacattatctttacttgagaatagtaatttttcaatatgcattaaagatcattacacatgagctaa

SEQ ID NO: 5022 - DNA, 1431 bp, Homo sapiens
aacagcagcgggcgggcgctctgcggccacaaaatggcggcggtggaatcaaaggcagcagagctgcgcgtgccaaattccctcttcccttctcctcccagcaacccccttctcgggggtcactgcggccgccctacaaaaggcccagccgcatcgccagcaaagtcagggagatcccggcccactattctacgtgtccaggagatgaagacattaagactggcagggacgggcgcacaaccgctgtgtaaaaacgacccgaacagtgaccgccctttcacctcagtacccctcaaacagtatgccaaaagggagacgtgccccagcgcccacctcgaatcaactgcgctcattagacgccatcctccgcaaagagagcagccccggccgctcacgatctgagcggccatgaagaagcctcgatccgagaaggcttgccctcaaagtgagccactcacctaccggacggggtctttggcggctgagacccagacaggtccgtagtctgcgacggagtcgtcgacctccacgcagaccaggacttaactcgtctacgccactccacaactgacgcacttagcagctctggcgctccacaaaatggagggcgcgtcctacgtcacttccggggacgcccctgggccttgggtccaccccgttggacctagggaagacggaagttttgggagggccggaaatttaggaggatgtgggcctctctgacactgcgagtgaccgaaccctgctcccgcggtgggtggggtcgggggcgagaactcgtttgggctcggccggctggtgccggagtctggagggacatctgttgacgtcgttcgcccctgctaagtccttggcgttcggttcatcatcatctctcccagaagagtctcctgagaaaagtggcaacccttcttgtatctaaagtttttcttagacacccagaagattactaattaggagaaacttagctttgcagaaatacctggcctttccttagctcttgctgcttgcaatttaaatttgccctcaaagcagggagctcctagatgttcgagttcttttttcaaccatgccacagctgtgtggttttgttgtggtgagaagactaaggcactgaagtattttttaaatgaaaggattttcactgatgaaatgttgaaaatgggactgcagctagaaggctgtcttgaattgaggctggaatacagatttctgcatgtccgtcactctgggagagtggctggaagaggtttcaagctgttttttgttgttttttttgagacagtcttgctctgtcgcccaggctggagtgcagtggcgcgatctgggctccgcctcccgggttcacgccattcttctgcctcagcctcccgagtagctgcgactacaggcgcccgccaccacaccggctaatttttttgtatttttagt

SEQ ID NO: 5023 - DNA, 4266 bp, Homo sapiens
aggtgccgtacgcgcgccgcagctcccggcgcacgaagtccggtagctgcagaggggggccccgcgcgcgctccacgcggccccagcgcagctcggtttgcaggctcccgccctccggccacggcgcccagctctcggccaccgccgcgggcgcctgcagcgacagtcccgagatgccggcggcggcgcagggccggcgcagggtcgtggcgtaggccggagggcaggcccaccagggcggcgcggcctcgggtggcgcggcggggccgtagaagcggtggtattcccgtggggccgcccactcgcccgcatgcaggctcccgggccggctgcggaagctgtgggcctggactgggggtagcagcagaggggcggccaggtaggtgcaggtgagcagctgcggcggcggcggccagacgccctgtttgggcggcggccagctgtacacatacatggtcggccccccaggcggctgctgttcttactgggggctcctgcggatccagacctgcggcggaggaagggatatgtagacagactttctacttaaccgcctcctgtccctgtgggccggttccccgggacgccggttcatggctttgggggaattcatcccaaatcgaacattcagctccccgcctagcctcttgtcccaaggtcgggcagagcctcaggctcccagcagacaataaggagccttttcaagccctccgccgggatgctcttcccagtgactccccactcacttgtctccttcagccttggggagccggcgggatccagagcggggctcctctccgcactttgtagctgcgttgctccgctccatgccctgcctcagccactcctcctggttaccaggcaaaaggaaacaccttgagctggccaggagctaccagcgtctgtctacacctgggctggagtgcagcggcatgatctcggcacactgcagccaccgtcttccaggttcaagcgattctcccacctcagcctcccgaggagctgggattacaggtgcaccaccacctcctgctaatttttgtagttttagtagagacggggttttcactatgttggccaggctggtcccgaactcctgacctcaggtgatccaccctccttggcttcccaaagtgctgattttacaggcgtgagccatcgcgcccggctgctttaaattcttttcttccttttttttttttttttttttgagacagaatcttgctctgtcgcccaggctggagtgcggtggcacgatcttggcttactgcaacctctgcctcccagcttcaagcgattcttctgcctcagcctcccaagtaggtgggactacaggcgtgccccaccacacctggctaatttttgtattttttagtagaaatggcgtttcaccatattggccagactggtcttgaactcccaaccccgtgatccgcccaccttggcctcccaaagttttgggattacaaggatgagctactgcgcccggcctactttaaattcttaatagctatgtgaagtgcatagtgatgtcatgctcttttagtagataaggaaccagaggctcagagaagttaggccactgtcccaggttcacacagcctgtaagtaccacagtggaatttgaacccagtccaactgatgtcaaaggccagaagccatttgagtgaaggcaggaagattgcttcatccagatggggtgagccctgtctgagttccagtcccttctggtgtgggtcacaacccctgcacctcttccttctccagtggggagagtggtagttatggatgattaaaactgaaaccgtctcccagctgcagggctgccatgttgccacactttccttccccatctcctgttgactgaagcagtatcaccagcagccctgacagaaaggttcttctgggttctcagtatccctcaaaactcagctaccctctggtggtggccaccatttggtgactcaccctggtgatgtcatgctattcgtgactgagccactgctccaagtcttaattcgggccagtccttttgaaggcaggtgctggggctgggctgtggatggaaaaaaggggcctggttagggtttcatttggactctaacactgtcatagaaacccagattcaggctggtgaacctgatgcacagctaaggccaaacagtgggagatagagaaaggtttatttgatttggccaaagtgagaaggcgggagagcaaatctctcaaatccctattaacagaaaaaaagcagcagggtggcttacacctgtaatcctagcacttttggaggctgaggcaggtggactgcttgagctcaggagttcgagatcagcctgggcaacatggtgaaacaccggctctacaaaaaaaaaaaaaaaaaaaaaccaggcatggtggcatgtgcctgtagttccagttacttggggcgctgaggcagaatgatcacttgagcccaggaggtcaagcctgcagtgagctgtgttcataccactgcactacagcctgggtggcagactgagagcctgtctcaaaaagcagcagggagtttttaatgtgactaaggagtgacggagggggcatttcagggaacccagggtaaaagtctgtgtttcttcagtctcagataaccccttgagccaccagacttctgggcatcagcagctggtcacaacgtccttcaaggcattcattcctgcaattttttttttttgagacggagttttgctctttttgtccaggctggagtgcaatggcggggatcttggctcactgcaacctccgcctcccgggttcaagccattctcctatctcagcctcccaagtagctgggattacaggcatgcgccaccatggccagctaattttttgtatttttagtagagacggagtttcaccatattggtcagctggtcttgaactccagacctcgggtgattcacccacctcggcctcccaaagtgctgggattacaggcatgagccactgtgcctggcctgcaattttttttcatgaccacaaagttacctcttcctgcttgaccaagaaacagcacatcagcagtttatattgtgggaacaaggaatattgggcaaaaagtgagtggttagcacgtgcaagcaagcatcggcctgatcagaattttttttctttttttttttctttttgacaaggtctcattctgtcacccaggctggagtgtgaaggggtgggttgcccctccacacctgtgggtttttctcgttaggtggaacgagagacttggaaaagaaagagacacagagacaaagtatagagaaagaaaaaagggggcccatgggaccggcgttcagcacacggaggatccccccagcctctgagttcccttagtatttattgatcattattgggtgtttctcggagagggggatgtggcagggtcataggataatagtggagagaaggtcagcaggtaaacagtgaacaaaggtctctgcatcataaggtaaagaattaagtgctgtgctttagatatgtatacacataaacatcccaatgccttgaagagcagtattgctgcccgcatgtcccacctccagccctaaggcggttttcccctatctcagcagatggaatatacaatcgggttttacaccgagacgttccattgcccagggatgagcaggagacagatgccttcctcttgtctgaactgcaacgaggcattccttcctcttttactaatcctcctcagcacagaccctttacgggtgtcgggctgggggacggtcaggtctttcccttcccacgaggccaaatctcaggctatcacatagggagaaaccttggacaatacctggctttcctaggcagaggtccctgcggccttccgcagtgttttttgtccctgggtacttgagattagggagtggtgatgactcttaacaagcatgctgccttcaagcatttgtttaacaaagcacaccttgcacagcccttaagccatttaaccctgagttgacacagcacatgtctcagggagcacagggttgggggtagggttacagattaacagcatcttaaggcagaagaatttttcttacagaacaaaatggagtctcctatgtctacttttttctacacagacacagtaacaatctgatctctctttcttttccccacaggagttcagtggcatgaccagggctcacttgaggtggctgagtcagaggcagagtgatgcaatgactgaaagacttaaccagccatcaccggctttgaatacgg

SEQ ID NO: 5024 - DNA, 3156 bp, Homo sapiens
taatggttacagatgagaatggaaaacacatattttatggatgaggcgttttggtctcccctgcagtcgatttctagaatcaagttttagagttcggctgatgcatctgcctggggacctcagatgggaggagtgtgtcagttgtaccccgacagaaatgtctctgggatctgtggctggcttgccccgggcatctctcctttaagctcaagttttgaactctctgcggttttccacccctgccttctcagccacatgcttttggccttaaacgctcagtcttgtggagttcaactctgtcaaacgattggaaagggcatccatttccagatctttggcattttccccgcgctgactctttgatgatccttcactgtggccttttcaagctcagctgttcctgttgtatttgagacgagggtgagggaatgtggtggccacaaaagaacagggacttgcagcacaaatgtcacttctgtctcccttttcagtggtagcacggaggaggaggtgctgcgttggagggaggggatcctccaggagctctctggagcccatctaggaagctagagtgtgtggcccgccaggagctcaggaaggatacagccactgtcgcaggggaaagtgtttgcttcccgtggagccaagcgcccaagactctccgtatccttcaccctgacagtttaacttcagcgtttctctgtgcagttgcggtcaccatgggtgagcactgtctgtgcacgtgccagggaggagatggctgggaccactgcacaggagggcgcagcctggcgtcgccatgaaagttgtctctgtgccatctctccggtccttgaggagagcccagaaagattttaggacccaggaggtgcttttcctccagctgttgccagtgtccttctgagcctggattctccggggatttccgtcgtggtggatggacttcacatcagcagcagttctggtacagaattgtaatgtgttttcatttctctgtaggattcacctctcaccagcgtctgtcttaaaggtagggccaatttcatggagcatttttctgtgtgtgtccttgttgcttttgccagaaaaagtggatttgacatgcgtgccccgatgccaccatagcccctaggccaacaatgtcatggtctaaacaccaaaaagtgatgccccgcattccttccctggatggtaccgtttcttctccgtctctctttgatgattctttgggaccaaagtcctctccttagtgcgcctacttcctgtgggcatcatgccacttggaacttattggaactggcccgggagactctgcagtctgcgccgtttgaaaaccctgagaaagagatgccacctcaacttgaatcatgacagcccatcgctcagtctcaccctaaactcatggagcttgtttcagctcctcacttcttgactgtatttgtactatgttgaaaaaatatcctgtccacaaagacataagcctaacaacctagaaaaacaacagggtactactggcattacagaacttctttgcctttcaaaacaaaagcaaaacacagtgaacttcaccacggagctgcacagcgtggggaactcatccatcactttcaaaattagagtcatttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttcaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaattctatggtggtgtttggg

SEQ ID NO: 5025 - DNA, 1102 bp, Homo sapiens
ggcaagtgaggaatatgaaataaccttatggctgaatcagggtgaaggggaagcttgtaagcatggaagacgctctactcaaactaaaaagttcaagttctgatccagcagatgaagagggaggcctgagaggctgctgttctaactcgctcccaggttcaagtgattcttctgcctcagcctcccaagtagctggaattacagcagccttggcaactattcttttattgaacatcagtaacagaaagatgcttgatttaggaggaagctttccctccctccctcccccattgcaccccggaactcagcaaaggtgagccagccacagagcataacactgtggctgggacacatgtccatgtgtgtttcacatacgtgggcatctgtgccacaagggtcatgtggcaccacagttcatcagctgtgtttccccttcctgccctgctgcagcgccacaggttggaggaaaagcctgcctgtgagcagggtcccggcagggcccacccacccaacagtggagatcgggcctcagagctgggcagtcatgggagttcagggcctggctcgcctcggcagcctggtcttaaagagggacttgcccgaggcctcgatgtaagtgacagtcatctctttggagctgatctccacataggcaaagccacccagtgagtcttcagtcccatagtggaagcgcagatagccgttggggaccttgcgctggtgccgctttgaggggtccatgaaattcccagccccactcagcacgtagcccacgccattctcatcttgcaggtactgaggatggaggacaaggggtcagtggagacccagctttgagcagagccctgcctaaggtccagggctcgatctggccctaaccacagagtcaccttgaggtatgtaacccctcctggcttcaatttcctgacttttaggagtgtattaatcctatttcataggtagagcacttagtaagaaattggtggccaggtgtggtggctcatgcctgtaatcccagcactttgggaggctgagggggtggattgcttgagcccaggaatttgagaccagcctgggcaacatagtgagaccttgcctctac

SEQ ID NO: 5026 - DNA, 582 bp, Homo sapiens
gtgctgggcgggagcttcgggagccggcgcacgggactcgaaccccaagggctcccgccgccaggtccacgtggaccctgggccgcagtggaagtggagcccgccccccgcgcgtgggggagggggcgccgcagccgggttcccctttttctggagctcaaagcctggggaagtgattgctcaaaggtgggggccggaagaacccaggtttccgcgtctccctccccctctcagcccggtgaggaggggccggggcgggacaccctgtccgcccccgcccccaccccgctggatctggcagccactcagcccttcgagctgtaggggaggcgctgcgcccccggccccagccgatcgggggctcctggcgctagcctccctccagagcgccgcaggagtccctcctgccgtctgacttgagtccctgctgctgcagtgcacgccccttcggcagccagggtggggcccagacccaacctggcccctcctgcccccaccccgcctttgggtcgctacccccaggctgtggtgagggtctgagagctggtaccacggagcctgggcaacctcctccgcccaccc

SEQ ID NO: 5027 - DNA, 845 bp, Homo sapiens
atttcccctagcataagttgatacggtcccaatgtttcttttttttttttcccaaatggccactcatttataccaacaccatttattgaatcgtctatagtccccactgatttgaaatgccagctttacataccaaagtcctgtatgcatttgcctctgttctgtttggtaggtctattcaagctccagttcccaaaagtgttgagtgtcgcttaaaatctagaagggctggtttctagttttccataattgctcctcttttctagtgtcctctgtcctattagggcttattgatttttaaatatgatttgtggattcagttttctttagttctagtgagcaacaaaaacaaccaagaaaaaagctttatcaagataatttaaaagttttttttttctttttcatagtctaggtagtttaaatagcactggaatgatctgttttttaaagatttggaagaaatcctgtgaaaccaactggacttagggaatggagtttgtggaagatgtgaaaattggcatgacatttgaggccacattaaaaaagcgaagataatttttaaacagcagttctttacaagtctcatatttacagatagcacaagctatggcatggcgtatggcctccctcctaaatatacgattctttggcatattggaattggtcagcctcaaagaccggctggctacatcgtcgcacgagacagtcccgcttattcctctgcacggactcggagacggtcctcagcgggaggagctcaggtctccctgggccagacacgtgccccagagagtccccagaagcatggacagttctgctctgtttccatcgctcaggcaggggag

SEQ ID NO: 5028 - DNA, 1095 bp, Homo sapiens
gcctgtccctgctgaacttgagttcttcaggaattcctctgcaagcctaggggcagggctccagggggcggccaccaggaccccacatgcagtgggatgagggcccatgtcgcgcagcacgttagcggtgagctcggcgccgtaggtctccaggtagaagctgaccagcttgtcggtgaggtccaaggcgtccatggacagcagcgcgccccgcgggatgcgcccgtagccctcgcgcagcggcaccgacagcagcttcagcttgaacttcttgagctcctcggcggtcaggttctccagcgcatccaggatggcgtcgcgcgcgcgccccatggctccaggatccccggccgctgccgccgctcaccccgctgcagccgccgaccaggaggaagtcggctccggggcggaacctggactccccgccttcctcccactctggtctcccgactccccgccccggtccgttgccctccagcaaaaggcgcttccttactacacccttggtcccctcccacccaggcctctggattggggccccaggccgtcgggggacgccaggatcgcgccctccagctggcctgcgaggtgggacccgggagggggccgcagaggggctcatgggtggcgcctgcttgtctctgggcttgcaccagcgggtacagaccggaaacctgggctggctctcactgggtttattggagcacctaggcttagaacctcggatttctagaaccccgaaacctccgcggttccccgaaccttaggatcctctcccacatgtcgtagaatcttggaatcatgacagctagaagcgtgaagctccctcaattccacatactggggaaaaatgagttgtacaaaagggcagagagtgcaaatctctctgagcttcagtttcattttctacgacatggggataaccctccggtgcttataaatattccagcataacatggccaacccgatggctcccgaaaccttgccagatgcttcctaggggagccagaatttgatcccaacactgattaaaaaaaagaaaaaagaaagagagacagcctccaggagattaaagaccatgaacttgaagccata

SEQ ID NO: 5029 - DNA, 727 bp, Homo sapiens
cttggaggacactcaccccatggtccatgggatgcttctggcttccttaaaaacagttgggcatccgcattgtataagtaggtggagaccctagtgtggttcttttgaaggatatgggaagggaggatgacgaactagagaagtgggaggggaccaaaatcactgaggtcccagaatatcatagatttgggtataggattggggtcactaagaattgagcaccaggaattccagcttcttcccattaaagaaactgggactggttttgccttggaggcctatgtagtgttttctgcccctgtcccataccaagtctcattgatatttctgcagaatatcagatgaaaatctatttctaaagaccattgggagaatgggtggtggagaaggagttggagtggggttggggggcagttaaaaatgaataaaaatctctcagctacagaacccaaacatcacttccctccgcattcacagcatttcccagcagtccccagatggttgtttccgtggggacacagcagctgcctcatttcccttcaggccccatgggctgctggtcaacctcaggatctactaaagatgacgcaaatgccgactgaacaatctgaaacccaaaggactcgaggagagacatgttctgctgaggagagaaagactcaacctccttccctggctgctgaatttcatatgccagtgaatcaaccagcaaaagctctcaagccgg

SEQ ID NO: 5030 - DNA, 729 bp, Homo sapiens
tcctatcatgtctgcagagctccaaggctgggggcgatgttgaggccgaagccagccacagtgcctcagctgtgcctttcctggagagcgggtggccgcccccagcacatccctggcacacgggcttgcataacagactcttgtaccgccatctctagcacaagaccatggccacatctccccaaccactcagcccgcacagcgtgcaaaggtggggagttcactttaatggcattcctccaacgacttattgtaaaagaaacaaggcatctcgtcctgggtcgcaacacccagcagcatccgtttagaccaccaagggtaggctgcgccgggtgcacagggatcccgctgcggctcggcgaaagccggagtcctgggatccagagcagcccggggagccctggagtctggaaaggacacagcagtgggggcggcggcggcaactccagctctgagcccgttggcaccccgcacggtggccccagccagctggaggcaggctcaggagcggctcctgtccttgtggttccccacgatcatcttgctttataattggttctgctcagcaggttccaggactccagttcttctgctgagaatctctttgtcacctcatcatccataatggtctccattcctttccggcaaaagtagaaaatgtcagagagctcgaactctggagtgttgtccagagccttactactaccacttcgacgaatctctttgatc

SEQ ID NO: 5031 - DNA, 7188 bp, Homo sapiens
gagatcgacatttctgaagccctgccacctgccatccctcgtagggattcaagtccaaatagccagagcctctggcagaggagatgggggaaactgaggtagccctagggtcgtcctctcaagtcaagctgcctggagactgtagcagctacggttgaggctgctcaggaagcacagaccgccccagacagcagctgaagctgaagactccagggccaggccatcgggtcaggcgttcaggaacgcgaaagctgacggctctgagccaggaggctctttggctgctgtcctctgggacgatgtttggggggcgcggggagcatcaggacaggactctcccgcagcagccccagcccccaccaggcggggacaggccaccagctccatgccagcaaacaaggagtcgcggctccacgcacagctgctggggcctctctttgggctgtccgtgccccctgggatccgttcaggtctccaccgcctgctttctgccagtctggcctcggcctcgctggggtctccgggggctggaatgggggaggcatctgggggtggggtgggcacagggctggacggcatcccagatgagggagcagggctccgggacgagaccggggttgaactcagaggctgcaggaagacctggctcccagggagaggcacagcgtcggtcagcagacaaatggacaccctccccgtcataacccgccaggcactgccggagggagtgaacacgtggcctggcacatctgggcatttccaactgttggacgcagggttcttccagcatgcccgttttagaaaccccactatgaggttcgcctgcggtggtgcgaaccccaggctcactcgtcgctctgactgaaaggtgagctagcagatggccaatgacagttaaggatgacttggggatgggtgactgaggacctgtgtttccagcagccagggagaaaacaggaagaaagaagctgggaatgcccacaggcagagggaaggtgccagggcctggcggccgggagaggcctccccgtgtgattccagtggccgccaggcagttcagagtgttcaagtgcacagagatgaatggaaccatttctgccctccggagcttgggagttgagcatgagctgtgtcatgggtggcaaactgcatgtgcagtcagggagggcttcctggaagaggtaagtgtgaggccaagacacaagggcaggaacattaaggcagcggagtctgggggcttccaggaataggtagaggccagtgtactgtgagtgctgcagagtttgggtggaaggcgggaaggcaatggggaggtgaggaccctgacttgctgctgctccctctgccagcgggacagggacttgagagggggtccgggaagggctgaccaggcgccgggcagggacggggtggccgtggactgcagcgtatctcccactgtacccttggaccccggtgtgcgtgtggcctccgcagctgcccaccttggtggccttgttggtcacaggtcccgggctgcccatgctgagctcctgcagccacggccgggtgcggaggaggatgtgctcctgggggaggaggtcgctgctccccagggaggcgatggcacacagcgccctctgcgggtgaagggaggggacatcagcacccatggggcagcaggtccacgccagggaggcctatttggccatctctctccctcttcttcctcctcatcaatgactggagtgccaggaggccccagagacagctccaccacagccctgtcctcaccgccttacaccccggatcccagacaccacagccctgtcctcaccaccttacacccccgctcccagacaccagagccctgtcttcaccgccttacaccccagctcccggacaccagagccatgtcctccccggctcctggacagaccccagcgagaagcacgtgacctgctgccccgattgccttaccttcattcctccgcacgccccccgacacacgcacacacgtgtccacactttcatgtgcatgcacacacacacaggcacatacatacacaaccacacacatgcagtcatgtacacacacacacagatgtgtgcataccacacacgtgcacaagtgtgtacacaccgcacacatgcacgagtgtgtacacacacaggcatacatacacaggcatacacacccacacgcacacacacaggcatgtgcgcacgcacagccacacagaggaatgttcacacacaggtgtgcacacaggcacacgtgcacacacacgcacacgcacacacacgcacacaggcacatgcacacagtcacgccctcccgcccgcgtgtgcagctcaccagctgcgtgcattcactggtcccacgcaggtggcaggtcagcagctgcagcacggcctcacagttgagcagtccacacctgcacagaggggacacctgggtggcgggtgcggcccgttccctcctccctcgcccacggttggggctgaggcagagcagggcgggtccgggcgcactcacgctttgatgaagtgctgtgcctcctcgcggctcaggaaggcgcgtggtccccgagtcacagtcctcaccaagctcaactcctgctgacagtcactcagggccaccacctcgaccctgccagggggaatggccgggtcaagggtgagtggaggccatgcccccactcctgtctcgcatgggggagaacctggagagcaggagccgcgctgggagggggacagtgtggtgcctccgagacctctcccacatatctggcagctcccgctcacctttctgccaggtcacccggctcccggctggcccctgaatggctgtcgctgccggaatgactgcccgagtccgagaccctgctcaggtcgctgttctgggaggaattctgagagctggggccgctgtccagctcatcccagccccctccggcctgcccaggctgatgcctcacagctggaggaaacaggacagccggtgagatccctggggcttcaggccagccccatgcccacctcccggggccctggaccaggaggcctcgggggctgagtcctgagctgaggatgggtggccaccttggctccagcttcagcaaacaccagccccatgggcatgtgcttccgccgcgggtcccacccctcctgctgtgtgggaggccctgggatttgcctccgtggccgcaaagccccagcggtgacaggaaggagtgacccagaccccaaggggaggagccctcgcctcgatacctcggggacctggaatggccccggggagtaggttccccagggttgggggaccgtggctggctgaaggcatcatggcaggctggtaggtgtcaccccgcggcaggagcctccgggtactgggactctcgggcccggggcgcatggcgctggccaccacctctgcggccttctggatggtggagaggaaggcttcgcctgccgagcctgtacccgaggagagggagatgggacggccgcccagtgcggcccccacccgcgttctctgggagcagggtgcccgcatcggctccctgctcaagcttggagaggtcggggtacatgctgcaggtagggaggcctcctggtgggccccaggccctctggaagctcccagtggactccgctttggcattcccactcccagtgggcctggacaccaaagctcactgcagagttatgcctccgtccctctgtcctctgggggtgaaggtgtcctaaggggcttgggcttggccttggctcagggagggtgtgtccagggctcggggaggggccggcctttcctgtgtgagttccctgtagaagctgccccgacaccaaagtgtcggcaggagccccaggctgtgcgcaggacggcgtgacacagcctaacgccgaaaccctggagggtgctgtgcggcctggcctgggagcccatgcctgcagagggtcctccgttagcagcaagccggcccccaccctcggccctgcccacggatggcacagacacccaggacactcaaggaggcagaaaccaggtgccagagctggacacggtcccctcagtcacctacctgtggcaggcggggtccccagaggctgggagggagccagcggcaacacggtgtccgagaacagggtgctccccaagtcctacagggggaggcgaaggccctcagtgtcctcacaccagggcctgctgtactcaccctgccacccatatcagctccgttctgtcccccggacacttctcctgagccactcagctggacacaggctctgtgtccaccagcaaggagcagaggcaggggtcccggatgggagaactgcaaaccccccagctgacatcctggccccaatcccacccctctacaggaggaggggcaccccgcagagcgacactgctcctgggctcacctgcgcggccgcgcgaaccttctggtacaagctgttcccgtgcagaggatctgggggccctgcaaaagctgcagaacagaaaaggcaagtcgggggcagggctgagcctggcaccgctgctccctgtggagcacggtgccctgggcccactccagggtggcaagttcctgccaccaaggcccttctgtcacagccaatgggatgccctcctccaggaccctgcagaggccacacctgagcagaccctcagctccccctcacccatgccccacagaggcgagactctctccacagcaaccacctcgtctcccccagggtcggcaacccctggtgcctgagcgggtgtggcctccccgaagcccactctccctgccccaggtgcaccagggacccctcagaggcttccggggcctggagggagaaaccagcgttcttatcacagcctgaaagctccacctagccccacccaaccccagtctcagccgcctcgagctcccctgctctgagagttcctgtcatgatgaactggggcttctttccttaaatcttccggccccagggccccccaagcctacacctggggccgcggcatcctttcagggctcaggctgagagctgtgcctctgagaacccctcgagagcctctgtcacaggcgaatccactcacgcccctcggccgtctacctccaccctggcaggctggtcccgtgattcggagacgatgctcctggctgtccctgggcccagggctggcggccacaagctgagtcaatggctggatgaactgacaccctgaggctgccatcttccctgcaggagcccagggcacccacctgccaccccacgctgcccctgctctgtgacagagcaggagcatcaccatcttggacaagcccctcattctaaagttcaccttaaccaaaaactgcctaaatccatagggcatcagcctaatggctaaggtcagcacgaccatgaaccacaaataacatctccaaccagaaacattccaaactcctccccaaccagagacatgctagccccaagataacccttctccagccgggaagatgccagcttcgagaaaacccacctccaggctgaaaagatgcctgccccaagataaccttccctccttccaaccctgccataaacttctccacacacataaacattccgagcttctgataagccctctcatcctaaaaccaacattcagtctgtaagataaagtgctcctgaccgcaatcggctgggggtgcctctcaggttttaactaaagaaaatctgtctgtaactgccagctgcgttttctttcctctttctgacgctctgcgcgcgtggggcaggccatcctcactgcacacccaccacctggagcagggcgccccgtctctcacgtgtggcatctggcacccactttcctcacagggcctgtcctgacacctcccacagcctgtgtgtcacccagggccagtgtccaggcacggcaggcaacagccatcatccatagctgcctctgcacaggagagactctggtgccgacaagaacccagggtctgaagaagagcctttcccatcctcaggtcctgctgtgccccatccccctacctgctgcagcccccaccccagggcgtgtccccgagaccactgaggccacgacgtacatgcaccaaccacagccacgggagtggcctggagcccggggccctctggcccgctgaatggtgaggataaatggctggtgctgccttggccccaaagctgtgaggagctctgtgaggatggcgagagcacccccgcactgccgtcccctcaggggcatctactgcctaagtcatgtgtcacaactgtctatggcggcccagggcactggcccctgcggaacacctagagctgcatgcccacttgccataaagtgggacaacactggtttcgacaccggttttggggtgagcccagtggatggtacaccctgaggtctccacaagcaagcagtggcacgagacagactcagtctccctccccagaattccccactcaggggctggggtggggtccagacatggtgcgcccagtgaccacctggagccaggcctccctccaccccatggaagatctcaggccaagcccccacaagtcctcattaggcagaggcacatgggactgcccccaagcctgcggggacagctcccccagacccatcttctgcctggacagaccgactggccggggccccgcctctcctgcctcccagctccgccctcccatggcctcactctgtcttgggctccgaggagcagccccagaaggggaacccacagcctgggaaggatgtgtgaacaggcactgagtctgctatgtgtgggcactgggatggagggggaagacccgtggggcacacagagaaacaaactggcacccggggcagcaagcgcagggacagacgcagccaaaggcccagggacgcataggaggcacggaggacccagcggagggagggggcagggcgcgtcaggggaggccgagccggccagctggggtgagggtgggcagcaggtggagaggccagagatgggccaggatcagcaaggcggggctttgatcgggacccggcccaggtgagggctctggctgaagtcttccttctcaaacctggaggatccgccaccctcccccattctccaaagccctggctcttcctgagcgcgtgcgcggcccctgtacctgcagcttcctggatgaaggcagagttgcgtttgaggatgagcaggaaga

SEQ ID NO: 5032 - DNA, 1594 bp, Homo sapiens
gccttttccacctcagatccccctgtcctacccatcctagctttaactcagccataattgccttgcttaatcccaggaacctggccactgctccttggtccttggcattatgacgggattcccttgtcacctctgacagttcctggctgcggtgtccgcggactggctggggagtgatgacaggtagctatcagagctccagcctccaggcagctttagggattaaaacggaggccaaagcaactccagacctgtttttatagccaaatactgagcctcaggggttgtacactcaggggcttccaggaaaatgccagccttacttttctggggtgccttttaataacctccaagcactttgtggactgtttgtcgagggacggtgaatcagaagaatcactattctgatttcctttgtctccgaagaggaagtccctgactagctatataactttgggcgagttacctctcacttctttgtgccccagtgttctccttgggaaactggatttaggttagatgaccttttaaggctccttgtatgatattttgtgatctgtacatggcagagtatagattaggagccaaattttccaacctagtgctatggttcagaatacatagcaccccaagcgtctggctggagccgaggatgggtcctccagtttttggcacagatgttccggagcccaggaagcatcccataaccaaccttcagccccaccgccacccccagcgtattccagagccgcttccaaaccacagcctatcctctgctccatttcactcttgtcctcacagactttcagcctccatgctctgagacaactgtggaagggatggaaaccctattttcttttctccaagaccatggttggtctgcttccctcactcgggctccttgacagtcttctagaagagagaaggaggaaaagaagcagttcctgatgttacaaatgaacaaggatctcccagccttagtctttgagaaaagatggctgaaagagaggaactctccaagtcattccgcaaacaaatgcccatttaaacatcatccttgtcttgtgaagaaaacaggaagaatgtcatgtaccatgtggatcaccttcagttcaaagttgcagcaaagtgaagaaagaaactactggaagccacccagcaatgcactgtttagtcatcaattaggagcccatgggaggataatagggagactgggtggaggctcagtgtgtaataatctcttgtctaatgtatgtgtgtcactgccatgttgtatgaacaatagtgagggctcacatttacttaacacttgtgtgcgcaaatctgggtttttcttcctttccagaactatgactcgatcataaaatctgttttgtttgcatgcatgcccaaaacaaccctgtaagtagaacattgtcattatctctgttttagagatgaggaaacaggctcagagaagctcagaaatttgttcaagatcgcacagctagtaaatggcagaagtaggattgtgaacccagggaatctccagagcctctgtgtaaccatgatgttatattttttttcctctttaaaaacaaaatttaaaaccttg

SEQ ID NO: 5033 - DNA, 8515 bp, Homo sapiens
ggaagtgcctcgcgacgcggggccgccaccgccgccgggccgagggagggcccggcaaccgccgcctgcgcgccggctgcccctcggctcctgggagccgcggcgctacgggcctgccgagcactcgggcgggcgccgagcaggctgggccccggcgcagtggcctagcctggaccgcaaggccgaagccgcctccgggccgcgtcccggtgtttcgggttgtgtaaccttggccaaaatgcttaagcttttttcctggctgccaaatggggccgatcgtctgacctgctgcctccggaacttgagggatcagatcaaataaccctttcctggcgctcgtctgccgctgtgaatgaatcacgggctcctgtaatcaccgttaggagagattgttaaactcgtacagggttggatgttttaaagttactgaatatttactggacccctactgttcaatcaagacatgctaagttagcttgccattcttgttcatttatgtgtttacttaactatttctgggtctcctcttcccagtcataaatatctcttggagtgtaagctcctcggagcagagatcctgtttccgtatttcctgtacctagaacagtgccagatccgtagtagacactgaaacaaaaaatctttaaaaaaaaaaaaatatacgaatgtggcaccaccatttacacaggccactaagccaaaaatctcgaacttgtcagattgtctcttctcagccatcagcagtcaacaagttctagcatttggtctcttaaaagtggttcaagagtttatttttcctctccttcctctgccagtaccaaccagtcttccgtatcactatgtattgcaagagtctcacaagaagatatccatcactgactgatcttcctcccgtttaacatccccaacaggtgccagggtgatgttttttttattctaaaaagaaaccagattatatcgctcactcccttgcttaaaacagttcttcaatgttaggtaaataaatcatggagtcaccacgagggcgttcatctgccaggcactattctgaacgatattggctcattaaattctcacagaaaccctatgcagcaggtacggtgaaaatgttcctgttacagatgaggtaactgaagcacagagagcttgagtggcttgctgaaacaccagacccactcagtctggctccataataggtctttttgctggtaatgatttaccaactatacagccactttaaaaaaaggaaataggtaagtactggcatggaatgataaccaagaggttctgttaaattttcaagttgaagaaaataagagtttaacttcattttatatggcaatatgttagtctgcccatagaaaacaatctgaaagattataacaaactactatcagtggttaactttctactttgtacatgcctataaatgtttggttattttttacagtgagcatgtgctaactatgtaatcagaaaaaaagttccctgctaaaggataaagtccaaatttttgcctattttatccctaatttatttccctaactttaccttccaccaatttctatgctctgcattcacccgtatatatttttacacctctgtgcctttgctctttatactccctttatctggcatgctctgcttcaccttgtgccttagatattatcctttcagacctagctgatgatcacctcctcagtgaaaccttgcatgatcccttgagaaatggagcattccttctttgggatttcaatagcatttggcgtgttgtgttgtaattatctattcacatttcctcttctacactgcattcggacctttttgattgcagggactatgatttgtttgtctttatatctgtcccagctgctgagatagtgcttgtcacatcataggtattcaactctttgctgaatgaatgaagacattaacaagtgaaaagtcaaatagcatagcaagatttgaagaatgctttctagatagtgtaagaaacatcacaaagcagtacatgattaattgctgaatgaatcatacaccagtaattgctgtagaaatcagaggaggcatcttatacatctttgtatatcctcccgagcacctagcagggtgacttgctcatagtgaaagctcagtcaattctgtgaatgaataatcactgctcttgaatgaagtgatgatgtgcaattgaagaacaagccgtgtaagtgctacattaagatggatgtgtagtttcttaagtatccatcaccaccctccacagatttgaggtagtatgcatgtggcaggtgttttggggaggactgggttggcaaatgcttggaggtagggaggacacaagaaaaagtatattcatttagggaggatagattaaaaccaggaaactacacacacaacaaagaacaggcatgacagtgtacttttaaaaaggaacacaaaagctggccaactgtgcaaatggtcaacaggcagtaaaagcaatgggcaatgagagaagtggaaagaaaccctatttcagaggagtatttgggaaaatttaatggatggaagagcaggtagagccattaattcaacgattatttattaagcctctactatgtaccaggcactctggtaggtactaggggaattatgctgataaatggcattaggtgatacaagtctgacagcagtaggtgtggaaagaaggaaagggagataaagtaactgattagagtaaaagaagtgtggcttcaaagatcctaggtgcctgatgacctcaacaggacaaaacagggctcaggtcaccatcaaaattagggttgtttcactaaactggggagtgaaaaacattaacataccttatttcaccacttatttcatctgggtgaatgacctcattccctgacaccaaaaaggatggcagcggtggggagaaaatgccggtgaaaggcatttcccacctcccccagtggctatacagcctcttttctatggtagctctaataagactccattttggttaaagagcttatgaccagcaagcaatccagaaaaccaaaatgtcagtcttttattttcattctgggtaaacatgatcatcaaaactattaggtatgggggctaggcacagtggctcacccctgtaatcccagtactttgggaggccgaggtgggcagactgcttgagctcaggagttcaagaccaacctggacaacagagtgacacctctgtctcttcaaaaaatacaaaaaaaaaaaagtatctgggcatgctggcacgtgcctgtggtcccagctcctcaggaggctgaggtaggaagatggcttgaacctgggaggtggaggttgcagtgagctgattgtgccactgcactccagcctgggtgacagagccagaccctgtctcaaaaaaaaaaaaaaaaaaaaagtattagggtatggattgaccacatatcttctgatttctatcatcagctactttttctttgaaattctatttcttccttctactttgttatgtttgtcttgccagttatgtacttcagcagggtgggcgacagttcgtctattgctatttgccattttccacctccaccgtttctgttctggctgtaatgttctagacacagatcttcatgattgctctgagttctttctttaggaagccattactgagaacatttagttcttggactgaagagcaactaaggccattagtttctttgtgtggttcctctttcactgtctctcagttttttaactgatataacagtgagacagagcaaggaacagcaggtgccacataataaaaagagccttgccaattaggtggtgatgccactaaggctgtctccctgcttcttccgacaaagcgattccacaccctctttctgagacttagacttaacagagttgaagagacctagactgttaccaaagacacaactctccacttcgtaggtgatgaaacatagaacaaggtagtcaagttatgtgaactcgtcaagtaagtagcacaccaaaataaaagaccaggtttcctggcttccgaaacaatctcttccctataccatgctaactcttactgcagagatagcaaagacattttatcctaaatgggctttggcgactagcctaaatattaaatttgaactcaattgaacatggacacaaacgatggtcaccaagtcccagaacggattgtgtgagctctttgaggcgttcatccagcgttgtttcggagaaatctctatttcaatctattcctatacattagttattgaaaaacaatagacaaccgcaaaaacaagttgacctttttgtgttccttgatcctggtcacaaagggcccttgtgactggacctcatgccaaacaactcgttacaaaaagagctagggttccagactgcgccgaagcttcatgagacctctccttgtctgcatggacgagtggccaactctggagcccaggctgttgcttcccagtctggtggtgaatcctccatagtctggtgagtgtaaatacatatatatatcttttcccttctcccttcccattgcaatttgcttattatatcatttgcttatatctgcactgccatttgggataaagcttgtttacccttaaaggtattgtgtgtgtgtctcctcccgcgcgcatttcccacacagaacacctaagaacctattttttatgatttttacgagaagtgaattccaagttgtgcctcagaattcagaatatatctttcaacctcctactcatcccctcaccaccctggtgaacacagtgtctggccagcaggaatgaatgaagaagactattttatgttcttaataacttgcttggaaatgaacagagcacaatttatcaaaccaaagcaaatatttatacaggcagatcccttaaaattgaggattaatgcttaggaagaattttttagaattttccaaattaaccacttgtctttctcagaaataaatctgttactgatgcttcctccaccaaccagctgcaaaaccacacactattctttgaaggaggaacacagaaaaccaacttacttcctggggcatttgggagaggaatctaaaaatcctagtgatatggcaatgactagaaccttttttttttttgtaacaacaaagctaaaaggggatgtgtaacttagcttgacttgtaaaaatattcgtagaagtcatctatattttaccactttgtgtaactaaggcagagcattagagattattcacatcattaaatatgtccagttaaattattagattacaacaccaacctcttgttcatagtctctcagtcttcagctgggcacgggggctcacgcctgtaatgccaccactttgggatgccgagacgggcggatcacttgaggtcaggagtttgagaccaacctgggcaacatggtgaaaccccgtctctactaaaaatacaaaaattagctaggcgtggtggcaggtgcctataatcccagccactcgggaggctgaggcgggagaatcactggaacccaagaggtggaaattgcagtaagccaagatggcaccactgcactccagcctgggtgacaagagcaaaactcttgtctcaaaaaaaaaaaaaaaaaaatagtctctcagtcttcatactttgttgcttagttggattatctgctcctaggttttaatataagatgaaataaaagtgctggcctaggaattggaggccaatttaccttaggggcaaaggcaatggtggtgaatatacccaacagcttcactttctatggagccagcttgtaaaatcttgggcaaggatggtggcagcagagctgtctgcctaagcatcatgtagaaaattttttaatggtttctttggaccctagcttgcagtgtcatttctgcttctcattgtattggaaatccatggttttgttacataatgtactcctaaaaatgtatacacatgtgttgagtatgtggaagttgaatatatttatgttataaatgagcagttctgtttctggaaaatgaaaattttcacctcatcactacagacattctttgataacacagtcccagtgtttcatccagattatttcattttcttcttttacatataaccaaccattttggatgttaaaggaacaaccagtgagggcttaagatctgctgcttttgacttggcactcctgatcagttccatccgtgtctcaagtgtatcacattcacgagacaaggcttctcatcagcaatttcaattttatgttttctacttatttttatataagaatacaatgcaacaaaatattcatatattgcacaaacagtgatgtgcatacaaagatgctaacaacattggctggtaataggctttaccatgttacgatctaaatgcttgttcatcagagaatgtacaaaattctaagtttggcatccaaaagggggcttacagttattgaatatttttcccagccctattttaaatcaaattcaagtttgcctatgacaaagactgtctataagtaacagggcaagcataccaacatcaaaattattcttcttcttatctcacgtgcccctatttctcccaaataagtgacaaggagagtaaaaggatcactgagggaacatttgaagaatgctactaagtgccaggtcctgtacaaggtaattaattactacaaacactctcgtgatggacatggccaatagtgtattttgtcaaaaaacaaaaacaaaacccaagattccagaagctgtttctgacaagaagtccttgtttcagtactcttcagtatgagtccttacttgcaggactgaggaatgaaattgagaaagaacctttaatcattagaaaaggacccaataaaactatacttaaatggatcattaatgtggatttttttacattcgtgtgggatagagaataatcccatgggaaacaaacacattttgaatattttttaaagaagtatttctgattctaattttactgtatgtttaggcatcattaaggacctctgatttgaaggtagatttatgtgccagggactccaaattcatgacatgttttaaggctccatattccatgcaaaaatggacttactgagcatggtggtaataataagtatgtaaaaaatagataactacagtcgtactttggtatccatgggggattggttccaggatcccccagtatcaaaatccacaaatgctcaagtcccatatataaaatagcatagtatttgcatataacctatgcacatcctcctgtatgctttaaatcatttctagatttcttataatatctaatacaatgcctacacatcacttcatttacatgaattcaacatacttcttggcatgcagcaaattcaagttttgctttttgaaactttgtagattttttttcaaatatttttgatccaaggttggttgaatccacggacacagaacccatggatttgaaaggctgactgtatttctattttaggtttgtttttcctcctcagaagcctcaacgaagaaaaagtcaaaggtccttctctctctatgaccagaaataaaacctataaaggaaatagagcactaagtggggtccctggaatccccagcttctggtttccagccacttctagatgttctctggaaacataactgcgttgaaaccatactgaagtataaattcccaaattggaaagaaaacaaacaaacttggtagtctcatgcctgggagatacggaagatggaaaattctggaagaccaataggcactgatgaatttctacatctgggcatttcttgagggagagagggcctggctatttggagatggaaaatgtggtgacctagaatgagcaggcccagtctagactaacctctttatttaaccaactgaatagtcttggttccagacttctgtggaacctcagatttgccttctgtataagaggagtttgtactaatccctctagtctttttcagttggttgtgtgtgaccagccctagcacttaaataccctgctgaatatacagaaaagtagaagaattattttaaaattaggtcacttatcttacttgaatactacaagtctcacactataacctcttctagaaatcaggctgaactagcaaatacataaagactaatataagtgcatttcagtaaaatcactggtgaagtacatttatgatcattctttttaggcttctgatatggcaaattagaggtaagtatttcgattaagtcttcatccttttggcaaacaagtatatggttcgatatacttggtgatggtgaatgaagcccttagtttttcacttcttcgtgccttaataaaatcttcgaggcaagcccaaaccagcagggctgcagcattatcagcaatgagaatggatcttaaggtcaacagtcatgctataaaactcaacatgaagacatcattaacaggctgaagactgtgagtcttaaagtcctgaagtaggcaggttttaggaggtggaatcagcgtcctctgggtggaacaggtggag

SEQ ID NO: 5034 - DNA, 1482 bp, Homo sapiens
ggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagctgaagtgcaatggcgcaatctcagctcactgcaacctccgcctcccgggttcaagcgattctcctgcctcagcctcctgagtagctgacattataggcacctgccaccacgcccagctaatttttgtatttttagtagagatggggtttcaccatattgggcaggctcgtcttgaactcctgacctcgtgatccgcccaccttagcctcccaaaatgctgagattggaggtgtgagccaccgcgcctggccagtgtgtcctttcttaattgacagtgacattatatctgcaaaataggcttcatacctactgtgttagttttagtttcctaggcctgctgtaacaaagcaccacaaattgggtagcttagaataacagaaattgtttgatagttataaataaaggtcagatgtctaaaaccaaagtgttggcagggccgtccctctgaaggcactgaaaaaaaaatttccagtccttctaatttcttgtggttccttaacttgtggcagcataactccagtcttcacatgaagttcttcctgtgtgtgtatctgagtcctaatataaggagactagtcatattggattggggtccatcctgctctgttaatgacctcatcttagctgctgacatctgtaatgactctattaccaaataaggtcacagtatgaggtagtaggggctaggacttttaacatacgaatattgggaggacacagttcaacccattaacacctacttataccttgattaattatatgaaaaccattcagtgtacaactgcttcaaggattgaaaccttgtatgtagtcccagctactctggaaactgaggtagtaggattgcttgaggcctgaagttcaaggctgcagtatgctgattgtgcctgtgaatagccactgcaccccagcttgggcagcatcagaattatagagacagaaagtagaatgatggttgccaggggttgcaggaagggcagcgagagggaattactgtgtaatgtgtacaaggtttcagtttgggaagaagaaatgagtcctggagatggattacggtgatggttgcacagcagtatgaatgtacttaatactactgaattgtatactcgaaagggttaatatggtgaattttatgtgtattttatcacaataaaaacattgaaaaataaaa

SEQ ID NO: 5035 - DNA, 1097 bp, Homo sapiens
ctccaccccgggaggctggtgacctatcatctcagctttgcccttctgtaagtattgatgccagcagaactataaacatacatatctaccatcaaatgcatgttgggggtcaggcactgttctaagtacttgacataaattaattcatttcattcccacctatttgaagtaggtacaatcgttattcccgttttacagattgggaaactgaggcacagaaggggagaaggtccttgtgccaggtcataggtcttctcggtgccagagccaaggttggaggcagcctggctctgcagtggtcatctcgctgcgggacaactgaagagttggagaacctcctcaggcctgggctccaccctgctgcccacctgtggctctatgcccttaggcaggtggcttcactgttcactggcctctcatctgtaaaatgggcacagtggctcctatgcagcaggctgcgaggctttgagatgctgcatagaaagctcctgatgcggggtagttgctcactcatgacctggcatagtagatcctcaacaaatatctgaggaacgaacagaaacataagtgaacggacttctcagatctcttccagctctgtcagtgttttaagatgctatggaagatactgaaataactgaggcaatgcagtggggcttcctaatggagggatcaggctggcaataccagaacgcaccaagccttcttagtatcacccagaaagcgttcttagtatgctccagatgtgatcccataggaaggacacagcacttcccaggaagtccgcttgctagaatgattgaccctacatcacctcaaccctctggacctaaacaccagtctacaggaagcaggaggacagtgcaacatgttaaatgacaccacgagggttcggtctgccacatcaacaatgaggacagtctcacatgacgaagggcctggtttcctcaacaagtaaaagggcataaaaaggaagagagtaaagactgttagagaggaaaatagatttaagggataaagtaccaaaatgcaatgtatgggtcgggtgccatggctcacgcctgtaatcccagcactttgggaggccaaggtgggcg

SEQ ID NO: 5036 - DNA, 394 bp, Homo sapiens
ccctttttatttgaattcggagaaccagaggcgcctgcagattctggaggggtctcgcctgcccatcgctggcagcccgagatcctggggaggggatgccatactgctagagatgagggaagagagccccaagcaggaaaacattgatttgctgtacactcaaagggcatctcatgccttcagtccaccgcctcctcgggccacagcccgtgccctcgcgccggctcagactagctctggccctgctgctgtcgctgcaggttgtcgtcttcttcctggtggtcctcgggcaggggcggctcctccagccctgcagaggatgtctggagctcccgggtggacccggcgaggcggaagaccacggggatctgggccagggttgggttggtctcct

SEQ ID NO: 5037 - DNA, 1883 bp, Homo sapiens
ggaaagcggggccggttccttcaggacccgcctcagggggcaccgcggcggcttggggaccacttggagccccgtcctggggagaaaacagctcacgtctatggccctgactgcttaggcgggagctgcgtgcagctcagcttctccggggcatttttttctacacggttattgctctgtcacccaggctggagttcagcagtgcgatcttggctcattgcagccttgaacctcccgggctcaagtgatcctccctcctcaacctcccaagtagctgggactacaggtctgggtgagctatgaacaggccaactgcaagggcgagcagtttgtgtttgagaagggcgagtacgcccactgggactggtggaccagcagccagaggacagactcagcagcctgaggcccatcaaagtggtgacagccaagagcacaagatcatcctctatgaaaaccccaacttcaccgggaagaagatggaaatcatagatgacgatgtacccagcttccacgcccatggctaccaggagaaggtgtcatctgtgtgggtgcggagtggcatgtgggttggctactagtaccctggctaccgtgggctgcagtacctgctggagaagggagactacaaggacagcagcgactttggggcccgtcaccctcaggtacagtccgtgcgctgcatccacgacatgcaggggcaccaatgtggtgccttccacccctccaactagtgcccaccccaccatgcctccttcccaggacccaggtctgctgcccaggaaccctccagacctcccagagagtgaatgaagtgtgacttgcaacttgtctgctgtgggtctttgatctcccctggcagctggtgtgtgtgtgtgtgtgtggaagtttctcttttcatcatcatgagtcctcgaagggtgctgtgttctgtccctctcactcctgactggcagtgactctaaaaaatgccccacccgtggggaggccttggaaagtagaagtggagatgcagtcactgatctcgggagaagctgaaaacacagtcatcagccctaggagaggggttttctgcacttccttggccatcgctggcctctggggtgtttcaagtttttctggaaaacaggatcattctgtggagtgagtctcaggaccttgacatgggaggaacaaaacttttcttgcttttttggtgcaccctgggctgaaataagaaaaccactaggggtgagtcttcaaagcaaagacaacccaggtgagcggagtggtggggttttaaaaaaacacaggtggagaggagcacgttctctctctcagataagatctcaaccagtggggagaaccatgcgtgctcaggatgggatgcctgcctcagaatcccctggaatatggatttccactccacccatcttctgctacagcaatggaattggtttctatcaaggtgggactgaggtgctgggcaggttgaccatcacctcccaagtgatgaagcagctggctggggatgtggatgggaaggagctcagaggctgccccaagctcctcccagcacgaagctgaaaaccagacccttctgcccctaagaggctgtcgagggcttcctgtctccccttgtgagaaaagagactcagtgaagcagggctcatattagtgaatctccaaaggtattcccagcttccctgaagccgcggttctcagtgtgtgaaccacaaaccagcatcactggcatcacctggggtcttgttagaaatgcaagttccgatcaggagccttggttcaggcctataatcccaacactttgggaaactgaggtgggaggatcgcttgaggccgggaattcgagaccagccaggacaacatggtaagaccccatctctata

SEQ ID NO: 5038 - DNA, 2556 bp, Homo sapiens
cgtggtggtgggtgcctgtaatcccagctgctcaggaggctgaggcaggagaattgcttgaacccggcaggcggaggttgcagtgagccgagattgcgcactgcactccagcctgggcaacaagagcaaaactccatctcaaaaaaagtgtgaatgtaatgatttagtaagaactgtttaatgtattaatatttatatttcataatctgtaatcatggagtaaaagccaagcaggctgcatcacttgccctgcagtctcctagcacatgaactaatgggcaggcaggagggtgtgcatcatccaccttgcttaccgctgacctccagcacccagacaatccctggcactcagcacaagtaactgctcaataaccagaaacatcaagtgcttgccggaaaaactccatgatgagggagagggaagattacacagaccaaatttaagaatctctgccttaggaactcaggggctatcctgcctgaaccatcgataggggatattttcaagtcacctcaaccactgcttgactcactccaggtggacccaccactggcaccttctagtaccacagctcagccttgagtatgtgcttgaactttcgttcgcacttcacattttccacacacaaatataatgtgccaaaatgagccagtcctgctcccaaaaccctgctcacaaaatggaggacgtgagggtgtggacgcatagaatgaatgaaatgaaagatgtcagacaaagcaaattccaaagagaagtgggaaattttctagcctccaagaacagaggacaaaactattaaacatgatacttatctaggtcactagagttcactctaggacacattgttttggaaagaaaagcccttcaccattccccagattaaagcaaattcactaatctgtgttcttactacacaggggcctggctttctcaagtctgggaccctgctgggactcttatttccgacgtcctattgggaggagccctcacatccatcctcctggagatgcccaatgcccccaagtctggtctagatccacccttgcattccaggcttgcacatccaaccgcttcaatgacagcatccatgaggatgtcgacaagctccacatggtcaaggaactaaagtgaccccattttctctaaaacctgtcaaaacagggtgacaacagccctactgagtgttccaagcccccttcaaaggcccagtgtcattttacgaagtcaaagaaaagatgtaaaagtaaaatccttcagggcacacctgttaaatgaatcaccacctttctagcacaggggtattaggatcttgtgcaacaatcaccaccggagacattaggatccctgaaacacctgcctcactcactgtcatgtctgcagtgaatgcagaacagtgtctgattaccaagtacatccagcacacgcattggacatggatgttgaccgagttccacttggtgtgcctgaggcaggcaggaaattctcttggaaacagaatccttaaggggattgggggggggaagcacccatgagctagaactcaattctaccctacagtaagcagcacttcaagggccgggcatggtggctcacgcctgtaatcccagcatgttgggaggaccaggcacgtgaatcacttgagatcagaagttaaagaccagtctgaaaatatagtgaagcctcatctccactaaaaatacaaaaaaaccagccgggcgtggtggccggcgcctgtagtcccagctacttgggaggctgaggcatgagaatcacttgaacccgggaggtggaagctgcagtgagctgagatcacaccactgcactccagcctgggtgactctgtctcaaaaaaaagcacctcaagaccgagaagcggccgggcgccatggctcatgcctgtaatcctagcactttgggaggccgaggcgggcggatcacgaggtcaggagatcaagaccatcctggtctaactcgatgaaaccccatctctactaaaaatacaaaaaattagccgggcgtagtggcgggcgcctgtggtcccagctacttgggaggccgaggcagaagaatggcgtgaacccgggaggcagagcttgcagtgagccgagatcgcgccactgcactccagactgggcgacagagcgagacaccgtctcaaaaaaaaaaaagagtatccagttcacaccataattttaacaagcctggggcacctggactaaagacacactccagtttacttacttccccccaaccatcccgcttctatattcccagacttgctctgagtagcaaaaggataaatggaagtgaaggcccggagcggtggatcacctgagatcaggagttcgagaccagcctggccaacgtggtgaaaccctgtctctaataaaaatacaaaaaaacagtcgggcatggtggcgcatgcctgtaatcccagcaactcaggaggctgaggcaggagaatcacctgaacctgggagacggaggttgcagtgagctgagaccacaccattccattccagcctgggcaacaagagccaaactccatctcaaaa

SEQ ID NO: 5039 - DNA, 3955 bp, Homo sapiens
acgtactcccctgcgtcctctgcgcgcagccccaacacagtgagtgagcgcacgggcccctcggccaccatctggaagcgcttgcccacccgaagctgcgtgttgccgcagcgccacaccacctctgcacacgctgggcttagctcgcaggccagtgtcaccgtgccacccagctcgccgcacacaggctccagcagccggcagaacttggcggccacctctgtgggcacaaaggggacatcagccgggctcttaacagaccagacttgagccccagcttcgcccctgtccagctctgggacagaggtgtctggaggagtccccgccccacgccccatgcccggctcaccttccacctgcactgggaagtcctgcccctctgcgcccacacggcagctgtagatggcgctgtccagaacctgggcgccatgcacggtcagggtgtgggtgtccccctggctggctgtctcatgccgcttgctgcggcgaatctccacaccatccttgagccaggtcaccgtggccgcagagggtgtggccagtgtggcggtcaggatgatgtcttcatgctccttgaccaccagaggctccctgcggcagggtctctctgaaatttggggctccagctctgggtagaggtgagttggcatgagagggggaccctgtcatccctggaccggccccgctcccttcagggccaccctaatgctacctggcacccctgatacccattgctcttcaaggatggcccagtgcagtcctgagcaccatcaactaccatccagaatcccagggaccatacagtgtggccatcagcttcaggcgaggtggattcacccaaagcactgacctgccacgtgcaggcggaaggacagccgttggccccccgcctcacagctgtactccccagcatccgcctggcccgcctgctgcactaccagcctccgtgtgtagccgctggcctccatgtgcacttttgagctggagctcagcttcttcccgtccttgtaccatgtcacctccatctggccctgggccacctcacagctcagcgtggcactggcccccgcctccgcctgcacctccctgcatgccggctgctccttggcaaacaccaccttgggctctgggatggacaaggagggatgcagggtcagaggctccagagcagacacagcccatgtgtcagcccagtgacagccaggcagggctgtccatcattaagcagtgcacggtgacgcacagagctccccccggcactaccagagccaaaggtctaaggctgcatgttggcagcaccatcatcatgtcccttgggaacaggatgcggccccttccctgcctcggtcttccagggccctggggccctcacctgtcgccagccctccccaccacgcagggccacaggcagtaggacgtgaagggtcaggagagatggaccagcaacctgggccagcccagaggcagcggagtgttggcagggccattggaaagagggtgccaagctgagtgtggtctgttgtccccagctcagggacagggtggaagggagatggatatcagaaagacaggtggacacatggtgatgaccaaggggcccagcacaggcttacagagatctagggcccagagcacagagacaagcccccaccacccagtacacgctctccagtcactgccgggccctcccatggcccagcacccacagaggagtcagcagatcacattagaccagacccagacccccaccccaaggacatcacaccactgtccccaccacccagacagaaatcatcacatctgaccagacccggaccccagacccccgaggacatcacgctactgtccctaccacccagacaggggtcctcacatgagaccggacccagaccccagacccacaccccaaggacatcatgctactgtccctaccacccccggctcagccactgcagggcacacaccatggtcaactcagcccatgggcctgctctagtctcatgacataaggacactggcctgagagctgctggggagagctggggacacagattctgaggcctacatagagggaaggtgccagggcccacagcaccttgggccgcccaaacatgcccttgtagtttcacacccgacactcagcatcacctccattttgcctaaccctggcacccaccagccacatgcagatggaaggagagccgctggcccccagcctcgcagctgtactccccggcgtccgcctggcctgcctcctgcaccaccagcctccgtgtgcagcccacggcctccacacgcattttcgagctggagctcagcttcttcccgtccttgtaccacataacctccgtctgggcttgggccacctcgcagctcagcatggtgctggtccctgcctcagcctgcacctccctgtgcaccggctgatccttggcaaacaccacctgctccttggcaaacaccgccttgggctctggggatggacaaggaaggacatacgaggtcaaagatacagcctaggtcaggaagaccaccctaggataggagggcctggatgaggaagtaggagaaacagaaccttccccaggctctgcactggctgcgtggccaggagaagtcctgccacctcccagcgcaagaatcacagtttgtctatccactgtgcacggcgccatgggctatcacaggtggggcagctatgacaaaccctccatgcatgagctcctccagggcagggactagggtacctgcacatgcggctcttcttcaagcatgtatggagctttaaatccacttgtcatttttcaaccttgcatcccccaaaaccacatttgtttggattttgattgagactgaacgtctttcattcttccatggcttctatccactttagatctttactgtctctcaaaagtgtttcatagcttcccccacagaacctctcgacatcttttattagactgggatcataaacatgatgcctttgaggcgtctgtcaatcttttacgttttcattttccaactgcttgctgctagtctacatgtacggaagtttcttcacacagatcttgcaagggttgatctttctcaactctctaataatttatcttctaggtaaaccgtatattctgtcaattcacttttttctaacttttacacctttcgttttactttcctcctaactgtgccatccaatgctggatggaagtgttgaccactggcttcctcatgctgtcccctggctcagaggcaaagcttacaaagtctccctttgtgatttttgtgtaataccctgtgtcaaattaggaaaaaaaaacttttatttatactttgttaagaattttatggcatgatggatgctaaattttgccagacatttcttctgaatatatgaggttaaatttttatcaaatatggtactttattctgagtttaagataattacattgttttcaaatttcaatcacatatcatgattttctaatgtttttaacatgaaagcagccctcattcctagactatgaatttcatcatcctgtatgattgtcttgatgtattgctgaattcagtttactaatgttttgtttaaaaaattggccatgatatccataattctttgatctacaatgtgcaaacttcctatcttctggccagattttagtcatggcattaagctatctgcatataatgagttagagggtatatcttcctttttccattctccagaagaatttccatgaacatggaagaatttctggccagaacgtttggaagaatttctcagtagggccacatgtttgatgagaagatttttcgctaccggttctagtttttactaggttgtagtaactgagataacttcagtaacagtagataactgcatataggttatctatttcttaagtctgtttttggtttctagaaattatataatttgttaacacttttcaaattt

SEQ ID NO: 5040 - DNA, 4985 bp, Homo sapiens
acttacgaattgtttatttgtggaattttccgtttgttttcagaccaccatactgaaactgtggaaagctgccgtggctaagcaggaactgctgtacatatttattaagcccttactgtatgctgggcattcactcttactgtaggcaggcattcgctcactgagcctctgagtcagccctgtgagctgagtttctattttacggcgaggaaacaggcaggctcggaagggttaagccacgtgcccagtcccagtagcctagccgtgtggcccggggcccctcggtggtcttgccagggtgtgggatgcctttaaacccacacatctgggattgaatcacagctccgtcacttcccggctctgagaacctgggcatgagatttgattgtctgagcgtcagtctccctctctgtcaaataggtagcagtacctgcgggttgcgcgattctgagttacctcgggggagttttcctggaggaggcctctttacttcttcctgagcctttgggggccccccactaggcaggagggaagatcagccctgcaggtcatctgcttcctggggctgggccttgggccctaaggacggtggcggtcccccacaaagtgatgaactcagcagggctttctgcctaggctcatggggctttgaagttggaaggaaagcggcctggtctgggctgtttttcccagcctcctcctcctctgcctctctgtcccccgtccatcggcgtctccgtctccggcctaatggggagccttcctcctgtggctgagttatctgcttgtcatgccagtggcccacccgaggacgataaaagggctttttgtctgcaagcacttagcttcctctgccggggcgatccatcacatctgagggaggccgggaaggcagacagacggtggagtggggcctcctcctcccctgctgagggaacctgatgctcccaggagcccccttgcaggacccaagtggctcctcagcccgaaggcaaggcctgtctgggggccagcaggggtgagtgggagtggggccatgggggcacattgaggcaggcagatgctctgcactcccctgacagaggacagacgctgcccggatgccctgccccaccacacccacttggcagctctgtggggcccctctgggaccctccatgctggagagggtgggtggggggtgcagccttttctgagtaagaaccgtgatggtagaagggggcatgggggagacaaggggggacagacctcagggccgacactcgctatgcgtgcactaagcactttgtggaattacctccttaaatctcagggcgaccctggaggtgggcaccgtccttatccccattctccagatgaggaaactgaggtacagggaggcgatgtggcatccccagggtgcagcagcagagggagggcttggctccaggctcccagcggtacactcttccctgcggacctaggaccttagaagggggctgtgggagcccctggccccaaaagtgggttgcccgtgactcgaaactctgtgagtggattcttcagctgggagtggggtggggaggtgggtgtctgggattgtctatacattggggtgaggggtccggtgtgggtgggggctggggtctcggggtaccctgggcgggtgatcggggacaccgaaggtgtgtagggggaggttttagggccctggcccggtgggatctcacctctcgggggctctgggaggaccggctttaaccccagttggacggggccctgggccctgcttgggtggggaggagagcaattcagggccccctgcccttccctgtctgcgccaccacccttccctctctgccatcctcctctctctccttcccagcctggatgctcagccctgggcgggggctccctgcaatcccttcctcccctcccccttccttcctgctccctacccctccttctcctccctccttctccccacaggccaccctcaaatgacagcaattaatggtgcctgtgatggcgggctgagaggaggaggctgacagttgagcgtgtctgcctgcggccgcccgctaatcgggcccgggggatgcccctcctgccgttggctccaggcgcctgccctgccatcactcagaggggagcaggagccctggacaggcctgtgggagctggtgcagagcccccatccctgcagccccctccctgtccttctattattattatcattttctttcataaacgggtgggctctggctggactgttgttcagcatgagttggtggatgcctcccagacgtccttctcctgaaatgacctctcatgtgcctgtgttgtcctcagggccagccatccccacagggccccatccttttgtccctgcttccctgggagaggcgggttgggtggagcccaggaaccgtgtcctgtccggacagcaggcatcagttaaatgccccggcctgagtcctcggggcctgggggcagctatttgagcccagagccttgtctggtggggtgaggaagtgtgttgtgtttgtcagggttacaagaatcctggccagctctgtccacagtgggcctgggcttgaccatttatcacctggcagcagcaataatgaagcccctgctgtatgctggggcctgcagctggtatgttcactttggttcattttacttggcagttttctgaggagtgtggtatttctcaccttgcttttgtagagggggagactgaggggcagagaggcaaagcgatttgccctaaggggcacagtgccctacgtgacctagctagcataggacaaagctggggttcaacccagacccaaactgtccaatgctcatacatcaggggactttgggaaacttgagggccagtttaggaaccagcagactgatttagaagtgaggaaatagtccctgggtactgggaatggagtgagtagtgttaatatatgcatctctctccctgttccacttaagatcatcttcattgagatgtaattaacctataatgatgcacccattttaagggttcaattgcatgtgttttgacaaatgtaaacatttgcatcacctccacaatcagaataaagtgtttctgttccccccaaatccccaccagtcccttggcactaaatctctagcacccacctccaccccccacccccgactagaggtacccactgatctgctgttatagaagcttttaactcttctagaattttataataaaattatcattttattatatactatactttgttgtgtctggcttctttcactctgcataacccatgttgctcatgtatcaattcattctttctcatggctaagtagtatttcattctgtggatatattacagtttatccattcatcagttgatggacatcaaagtttccagtttttggctattgggaataaagctgctctgaacattcttgtgtaagtctttgtgtgaacatgttttcttttttcttatgtgaatatctaggcattgggttgctaggtcacatggtaaatgtgttattttagtttataagaaaccaccagctgttttctaaagtggctgtcccattttgcatgcccacctgcagtggatgagagttccagttgctccccatccttgtcagcacttgctactgtcaatcttttaatgttagccgttccaggagaccctaatgcacatgcgattacatttttcagcttttgctgccttttgggcaaagctgtggttctgtgttttgattttatgtgtctggccagctggtgggagtctaaaggatggtgggagataatctcgtgtctgccaacgctagctctgtgttttcctttctagtctttatgctgctgactgactgcttctcgtccggctgcagtggttgagaccacagtgcagtgccggattgcaccagttgggttgtttggggttagttagctgtgagtgttgttatttatttttttattttttattttttttgagacagagtcttgctctgtcgcccaggctggagtgccatggcatgatcttggctcactgcaacctccgcctcccgggttcaagcgattctcctgcctcaacctcccaagtagctgggattacaggcatgcgccaccacatctggctagtttttgtattttttttttttagtagagacggggttttgccatgttggccaggctgttcttgaactcctgacctcaggtcatccacttactttggcctcccaaagtgctaggattagtgagtgtttttttttttttttttttttttgagtcggagtttcgctcttatcgtgcaggctggagtgcaatggcacgatctcggctcactgcaacctccgcctcccgggttcaagcaattctcctgcctcagcctccctagaagctgggattataggcatgcgccaccacgcctggctaattttgtatttttagtagagacggggtttctctgtgttggccaggctggtctcgaattcccgacctctggagggcgagatgggaaggacacggacgggggcagatgacctcagtgcaaagtcccagggatccaggtggacccgtctttatgctgcagttgggtttgtaaacctactggagcttcgaagtgggagcaccccatggcagtgacagcagcagtcctaacagggtttgtgatcgtccttgtgtcacacttcacatgttataatttatttaattgactgggcacagtggctcacgtctgtaacattgcctgtgccttcgagtttagtatccagagggggagtgtcagttaaacaagcaagtgctatcgcgggtggtgagggttgtgaggacgaggttcaggcattcacctgggtgaggcaagagctgaattagtcttccatcaggccaggcgtccagggacgagtcattcaaggggagacctgggggtgattagttaggggcagttagttagggctcctgagttgtggcagagacacactcgagccgagttaggctatgacgggga

SEQ ID NO: 5041 - DNA, 2560 bp, Homo sapiens
agataaggtctggccctgttggccaagttggagtgcagtggcacaatcttggttcactgcagcctctgcctcccaggcccaagccatcttcccacctcagcctcctgagtagctgggattacaggcacacaccaccacacctggctaatttttgtgttgttttttttctgtagagacgaggtttcgccatgttcccgaggctggtcttgaactcatgagctcaagcggtctgccggccttggcctcgcaaagtgctgagattagaggcgtgagccgcctcactcagccttcattcctttttatggccaaataatattctgttggatgaatgggccacgttgtgtttttccatttatccgttgacaggcactttgttaccactttttggcatttcttcgaggatctttatagtctgacagtttgattttcatttggtgacaaggggattgttcttacacaaggccttggtcgtactgatgctgtcagctggaggatgtattttgcttcctgttcacattgtctgtgcgtgggatggtcatgagtcaggtggtagagcgggtgtgttagccttggggtattttggtgagacaattcggtttaaggaaggaaacacgttttcaggacccgtaccccaaaacacaaccataacccgaggtcgccacttggctgagctgtcccccacagggacttcaggtccctggttcctccatccccaatctgcttccttccattcccgccagaaccagggtattttccaagggcaggtttcacatccacttggggcagggatcttaagccacagtaagactaatttccaggtcccaggtctcctgggaaaccccaaaagactgagccctgccgagtgagaacattctctgaagctctgataatcaaaacagcgtggcacctcacaagcctcagcagcccagaggcggaccacatgtataaaataacgccatgtgtagtatttaacaaaggaggctccccaatccagggagggaaggattctttcacaaaaggcatgaaaacagttgcttccatgtttggaagcagttttgttttgttttttgtttgtttttttgatacatggtcttgctctgtggcccaggctggagtgcagtggcatgatcacagctcactgcagccttggcctcatgggctcaggcaatccccctgcctcggcctcccgagtagctgggattatagatgtgcaccaccacgcccagctaattttttaattttttatagagatggcgtcttgtggccaggcacagtggctcacacctgtaatcccagcactttgggaggccgaggtaggagggtcacttgaggtcaggagtttgagaccagcctggccaacatggtgaaaccccatctctactaaaaatacaaaaattagctgggtatggtagtgttcaggcccaggtatagggggtcagcccagagctgtgggtgaaaggacaggcccatggtcccacctgtgggagcaggagaggaccaggccgatgagccttgcagggggcacgccagcttgtggtcccagctagtttctgctcccaccacccccatcccactcccagggagggatgtcccttctagggctacccccttccctgcagccctggctgctcagcagccgccttgagcaagcccttatccacttcctcctggcctgggggcggggcacgcatctgccagtcctgtgaccgtccccttcagccccatctctgagagtggggtttcctgagagtctgcccttctgccccgcacaccaggggcccagagctgcagaagcccccacaggctttgttcccagcagggctcagagggctcctggtgctccatcagcagtccctggaggacacggagcagtctcaagtgcagccgtccatgtggccttcagcccttgtgattccatgagctagcatcagccgtcccctcagtgggtggcagaggctgccgggagcagaagaaagagcccatccttgggttctcctggcttctcgctcagagctgctctctgctgtgaaggaggaagtaggcatatcccagtgagttttgcgtcgcctacatccaggcagctcagccataagtcagcccaaagcccgccagctgggagctgcactgagcccctggtcacaaaagtgaacgtcacaggacgggccaactctgcccaggcctcgctgtgtgcacatacacaggtgtacgcatgtatgtaggcatgaacatgtgggtggacatgtgcatgcaagtgttttgtgtacaagcatatacgtgtggctgggcacatgtgtgtgcatgagtgttcatatggaagtatatgctgggcgaggcggctggatcacttgaggctagaagttggagaccagcctggccaacatggcaaagccctgtctctattaaaagtacaaaaattagccagacgtggtgatgcacgcctatatcccagctacatgggaggctgaagcacgagaatctcttgaacccagtaggcagaggttgcagtgagctgagatcgcaccgctgcattccagcctgggtgacagagcaaggctccgtc

SEQ ID NO: 5042 - DNA, 665 bp, Homo sapiens
tttatgtagactggaagtccatattttatttctctagtgacatatttacagttcaatataaattaaaggcctgcttgtatgccaaatccaggtcccttgggtggttcagtcaaaggggtaagacctccagctggctcacaagagaagcgtccactccttgtaattgtcatttatttgaaccattggtgcgttcacacaggcccctaaacattccacttctacaagagtgaaaagtttgtcaggtgtagtctccccaagctttattccaagctttttctgaatggcctccagtatgctgtcagagtttggaagcatgcagggtgtagtagtgcagacctgaatgtgatacttttcaactggctttcgattatacattgtataaaaagttgctacttcatatactcttattggaggtacttgtaaaacttctgcaaccttgttcatagcagagatgggcaaccacccattctgcctttgggctaaatccaggactggaagaacagctgctgctttatggccttctggatagttttttacaattgcctctatcctcttatagttttctggtgtgaaatcaaatggagtatcagggttattctcaggagtatctctgtgcacaaataaagctcctccagctccattttgcatagctgtcttatgcaatt

SEQ ID NO: 5043 - DNA, 7315 bp, Homo sapiens
cccacccatctccagtttcacagccgtggcgaagggtgtgaagcactgtagcctgccctctctggcgctttcccttctaagccgcaggaaggcaccgcttggagggagccccttcaggcccagacactggcagggacgagcagcagcagtggccgaccgcccgcctgcacctgcctggcacctgcgcccggaggatccactcccacccacaccctcggaaaaggacaggtggcccagaggcatccgtgtgttcaagaaccgcagaacatgaatgtggacaccatcccaaccaggactgttcagggtgttcttgttctcttgttctcactcactgactaccagcttctcgacgggagggccccgtctgagacacagagcttcacacgttccttctgctttatttcctctccctagtgaaacattaaacacaggaggaaaagatacagatgtagccatcagaaggaagtgaggctgtcattccaaatggccccccaccatgaagaaacccaggcttcttaaatcaggaacctcacgtctcagttttccctcaggtttctttctgtggtgtgaggacagaaacaggcgtccctgcattcctcagcaatcctctccttcctctaaaggcacgggagaggatttccgagcgcctgcgatgctgtggggaaccgcaggctgggcaccgtcaccaacgcgtcacaacagagcaaatctgcatagccttccccaactaccaccgaaaggatggctccggctcagcttggtgaacgctcattaaacaaaaagcacactcgagtttcctagcttcattccagaactgctattgtggcacaacaaattcacaacaaattcacatcggagtcccctcgaccgggagctgcgggcctgggaatgcacagcacaggcagaagcattcgtggttcgtcagctcctggcagacgggactcacttcacggacacacagacccacgatcttcatgctattagggtaatttcatcttcacagtaaaaaatcaccaattcccagagaaacggagcatcagcccagctgtcgcacagggtctcgcgggtgctggtcacgggacctgcggccactccaagctaatgaagagccgtttactccggaggaaacatccagcgcttcaactggccacggagttactaagtatcaaccgaacaaggtagttttaaaaggaagggaaatattgcgacacgaatgaagggacagattaacttgctcctcggatccgggcacacagctcctcctacttcttcttcctcttttcctggacacaccgtggacagaacctgtgacaagaaaggcgcagtgaggccctgggcgccatttccgccagcgcgcagggtgcccagggcccgcctccccatgtctcccagggctgctggacgccggcaggagggcaccaggagaggcacacgcagtggggccgcggccctcccgcagggaaaatgcgccgatgcacgtgcggctctatgcaggacgccggttctgaagctgacagatacaccatcaatgagcaaaaccgatttgacacccaggcgttcctccttaacaggtgggtccttcttccccggccgatggcagggtcgctggtgccctctgtctgcagtctgtgggggctgcaggtaccaagcacgcgttgagagcatggcagcccctcaggcccacggaaacccagccaggcaccctgcactggccctggaagctgccgtctcacaagtgctccctggtgactctgagcaagttctggagctgcacgcacaaggggctcctgaacagaggcagctgctgaccacagaggacattccataggttccccacgcaggaggcagccgactcgcatgacggcaaccgtcaaccaccgcctggcccaggcccaagcctgcccagggccctccgccctaacagcctccgtaccccttctcaaaaccctcggtgcaccatcccccagccgcacggcgtggggcaccacagtgccatgtgtccctgtgacaggacagcctgtgttgacgccacatgacaccgtgagctcggccagcctccgagacacggcatcctttccctgtgtcctcacaccgaacaccaaggataactggctcttaccaactcgggcgagtctgccggagtttcaaacacgctgccacgatgacctctgagtgccacacagaagagcacattccgatttcattttcagaacatagatatccatttttagattttcagcacaggcaaacaaagccaggtttttatctttttatttatttatttgagacagggtcttgctctctcgcccaggctggagtgcagtggcgcgatctcagctcactgaagcctcggacttccaggctcaagccatcctcccgcctccgcctcccaggtagttgggaccacaggcacgcaccaccacgcccagctaatttttgtattttttgtagagttggggtctcccgatgttgcccagactacaggtttttatttaaatgaaatctgaggaacaacaatgcagaaagttgccattgccaaggggatgcaagggtcaggtagagaaaacacacccttctccactagacagagccaggggcagagccccagatccatgccccggcttcagggctcacatctcatgctatatttcccaaatttccctaggggacaagaacctctcatttctgatttaagacgatccctacctcccagagtccggaaggttgtccttcaggaggggccattaacgtgaatatcacgtaacctggtaaccaccattcctgggtgacggcatccctctgccagctcggacaggcacagcagcaaaggggggataaagccacacccagagcagccaccagccagccacactccttgaggccacagtggggcatgcctacgtggctaccgtgtcccgctaagcccggcaagattctgccatggagcaccttctcctggggaggccagcagcgcaacacccagcagactgggagaaaacagagcgagcgtccccacactcaccattttcctttgggtttcgtggtaaggtccacgcaggcaaagtgaaaccactcaattggacactgcaaagtaaagggagaaaccgcagtcaacacgcctcatgttctgtatgcaaaacacaagaaatgccaacatccgccagccctgccccacacaagaccccgccccatggcgcgaatcctgcaggcgacactcacgtctggattgtcacagccaatcatctccccataggagacctggtggcacaggcagtacgtgggttcgtttgggtccacgggcatgtccagcacatcagaggggtgcacggacaggatggtgtcagtgaactcagacctgcaggggacagggcacaggcaccactgaaggccatggtgggaagtgaggcggcacggacaccacgggcccttctgtctctgacttaaggccccctcaccccaaaactgtgaagacaatcattccaagggggaaattggtaccgtgctctgagcgacacataatgaataagcttgcttccatttttcccattgtcctttagaaatgaatgcgactccagggccagccactgcagtcatgcactaactgaatacacaccttgtggacgttttcttcctggagcacacattttcaaaacctcaataacccctctgaacacgcaatgttctaagaaggcgcagcaagaaaatcattaagtatacgaacagattgtcagctgatgctagaaagaacagttacccacaaaaatccaggaacagcagcagctggcagcagaggggtggagacctcgcgcccaccttcgggcccaggcaggggcatgggggcacagagggcccccaggaggccgtgaagcgcagcactcacccacagcaccggggttctggtcccactctggggacgagtccactctcatctcggtccctcctcccagacaggactcccccggggacctctggactcaacccacttctgggccatccctccaaagaccccggcccctttggaaacaagcacacgtcacctctgccagcagacggctgacacctgagagaagcctgccagcctcccactccagactgacaggtgtcagagcagcccgcacagtcaacagctctcccgtaactgtgacctcctcccaagagaacagccatgcgtcctgcgcccgggccctccacgcacctactcaggcacctctgccccaatactgactcaaccagcagctccccacacactccctggaccgcccaccacccacccagctgtccacctggcacagggccccttccgaccacacaccatccttgtcactccttcatccccatcagctcccacgtgggtttctacacagcagcctggcaggtgttccaccccgtctatgcctccctccaagcctgccacctgtagcaccatggccgtcccaccaggaccacagacctcaggtggagactttcctgtttgaaagggatgcacttagggggaaatttacgcttttatatttcagtatttttcaaataaacttacaagctgcaggtactatagacagtgtattcccattagtacagaaagaaaaagtatcttccctatcccaccctccaacccacgaatatctagttggtatgtaaacacagcaggttagcaggaggaacgtggccgtgagaaaaacagtcacgatcagggaaagccaaggagcagaagtctgggtcccagagggaatcaacactcagcttttccttggatacctgtctaaagcttttctacgcctttgcaattgcctgtacacatacacacacactcgggctcagcatgcacccggcctccccgctgccctctggcacaggggcgcccacctaagtctgtcctttgcaggtaatctgctcttctgctctttctctctgtctgggaatagacaggggtttctctttagagctgaaatccatcagcgtcacaagtccaggtccaggtgctgccgacactgctttcaagcaacagtctcaagtagtcttcgggtctctcctctgacagcagcacgcaagggtctacgtctcagcctcctgccgattccgggatgccacctgtggcttcacctccaaggggctcctgcggtctcctcgagtcacctctcacccgcggagagcagggcagcaccctctgctgccaaccgtccccgaaacgctgacgccctcctcttctgcgccgagtccaattctgtccacaaagcccgacctgacatcttgagctgccacttgacctgtgtctcagcatcaccaggttcgagggcgctggccagatttgatggctgtgggagagggccgggggcctgaggggaccgcccagcaagggcaccccagaagctgaggccaccgtgcaggcctcactggcctctcagtctcgcctgagggagcgccatggcgtgtggccagggagtgctgctatcagccctgagggaggcaaccaggaggccatggggagccctgtcccttgcacaggccagggtgaccccaactgtcagcggctgctgactcccttcagcaccactgccacaagaggcaccctctgtgctaactccccagggtgtggcaggcacccctcgccagacggtgccagcgagcccttccgcgcccggccccgatggcttcccagcactccacgtggctcctagcagggggctggctgcctgtccaagccccgggattccaggtgctacaggtgacactgcccttcatccacacacacaggttctgcctcgccagagcaaggccacagggcagcaacagtgcagggggcagcctcaggtcacgggatctcagacgagacacggagcatctgtgcagtctaggaacactgcattccaggaagagccccgggcacgtggggaacaggcctgaagagggcagtccacagggacaggatggtgcgtgcgcctgggtccccagcagggaacaggacctgccttgaggcagagcggcctggcaccacagcgtgaccacgaggggcgtgaatacccactgtgctgatgggtcagggacgcgcaccacagaactccagagcccaggggcaggcgggctcctgcacacacccaggatgatgcccttggaggcacccgagtgcacactcccgccccggcaggccaggctttgggtccaaccgactggtcctcaggatgacccgtctgcccacctgcaccatcctcctgtccctctggaaggggcctccttggcgccttggacgtcagagcccagcttcagagctggccttaccagcctgtctcgacgtcttgcaatgggacaggagcagcactgccacttgggggcacagagaagaaagagattcacacacaagctagatccagagccgcagggccccgcaactgtcgccatcggtgatcacccttctcatctgtcactactgggacctgcacggcaggcagcgctgagctcccaggctccgcattgctactaaacagtgctggtcagcgcactgtcaggacaggaaaagccatgaggccacagtggatcttcctgtgtttgcagaggtgctggctgttcctgaggtctctgaagctgggcagagccctcagggaggaagccccgaccccaacagggagctggagtctccttcacccccacgaggacccccagtgcctgcattccttatgcctagcatacccttgagaaacagcactgggtgaggaagagaccaggaggagtcccactttcacgcagaaaaggcacggtcgggacagggccttcaggttccgagcaggaaggagcaggaagactcagaacgctgttgccactgagttagaaaacacaaaacccagcaagtcacaaaaaccacattctcaaagatgtcggggagctgtggagcaacaagagctagatgacctgcagccagagtggggggtgttggggggttgggggcggcgtccgcctgcctcatgcactgagtgagggctgggctggccactgggccacgctgagcccacacagccacacatggcggccgcgtccccaccgacatttatagtccagaggctgcacagagcaactaaaagcagagggaaaatccctgcaacctcggagttctcgagcaaggggtctgctcgggcaccgctggtctcctcccccgcacttctaccaactgtggaagccgctggggcaggaggcgagagaggaaacctcaaggtcctcaaggggcctcggtggagctgaagctgagaccctgccccgccccaggcccccagccctattggcctggactaaaacagaacgaacacctcctggggagaacagaaatttc

SEQ ID NO: 5044 - DNA, 1261 bp, Homo sapiens
gagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcaggtgaggcggggcccggggtgtgtcgagtccggccccgctcacctggcagcgccggcgggggcggaggggccgggcaggggcggaggggccgggcagggacgggagttcgtggcgaagactttaaaaaccctccccgccgggagacgggggacggggtcctcctgccccacctccggggcttgggagccacgttagctcccccaggggcaggggtggccccgggcgaaggcaactcgggagacggcggagtcggggaaagagggtccctgaggctcggcgacccccgcgcccgcccccgcggggtctgccggccctttctggggagggggctccccggcccgggctccagtccagggtgcggaccggccgcggcgcgcgcccaccccagtgccaagggggaggagaggccggtcccggggcgctcctgtctgccccggggtgggatcgcagggcgagggatccgcattgcaggtgcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttccgtaagtacactaccttgccagccccttcctgaagctttgatgcggctttagtttactctgagtaacgatttgcctgtgattcgtgaaacggagcagaatgcacaaacgcagcagagctccaggcttggctactgggctgccgtctgctacggcgagtgagtttctctaacttaggttttcatgctgacctgtattgtttcatttcaagttttggtatttagcagtacgatctagtccactaaggaaaattaggctgccagagagaaaatataaccgcgctctgtagcttaggttgcagtagtcggttttataacaaaatgcaagctaccacgctgtaatactttaacatattacgcagttccagaaacctgtaagagtattaaaactaggattgccattttaaaacttttacgtttgaaatttatttaaagagcattg

SEQ ID NO: 5045 - DNA, 1554 bp, Homo sapiens
gcacttcattcctgcacaggcagaatcatctggcttctgcaaagcagtcgcgcagcgctgtagggacaaccggggagtctcaacctaaatgactctcccctcgttcccctggaggagaagagaaggggcgacctcacacaggaccagggccggacggggcagaagggaggaagagttcccgtgctggcacagaggtggcagggggaggcagcagtgcagctggagcccaggcctgctgtgagagggcagagagtgagcctgggctgtgctcacaggacattcctcaaactcattcctaaaagagctgcaattacacggcggcgtttccgaaatgacctggcacagtgcgcggcgcctcacataggcccagggccgcggccagcgctgagcagactggtgactagaagcagctccccgtcgggctgcaccctccctctgtccctcgcgggggcatctgcagaagggcactgaatgcgctccccaccccaggaaacccagcccctccactcttccaggaaggagcgtcgtcatggccacacaggcagggaataactgatgcacagaattcagccgggccgcactcagcaccgcgctctccagatgcaaacggacacacgcaaaccggccccagactcgagaattcgtccgcagagatgcatccactacaactcaaacatcattccaccttaaaaaccctgcttaatgacatcagccctgctctgccggttttgtggcctctttgacacaggccgagatcctcccttctctggcctccccgctggctgccagatctcaccaagccacaagttacagacgcagggtgcaactgaggaacatgatcagtgaaggaagaaataaggaagggggagctttacgagtccagctaaaaacaagaggacaaactagccagacccctcggagaagcaggctcctcatttcacgaaatcggccgtttccttcagcagctcccctgacccccgttacagtctgtgacgatgacgagagacacgcctgctgccctgctcagtggggaacacaccggccccgcgtgcgtatttcgctgtttctgacttcacacaaagaactgttgttatgtttccatcacttacacgcagcaaccagcattcaatgttgtgctctcaaagtctgtttaaagttggctgcttgcaaactgggccatagtttctgacaaaaatgatgctggtaagctaactcccaggccgagaatgcccatgctgtgggcaaaagaacagtgcccgcccctgggttgtctgagcagaagctggattgtgtgcctggagccctgtcgccctcagccagacccggggtcgaggctgggccggctctccgggagcatcagggatccggttggagagaggctcatacggcggtcccaggggccacctcgagggggttgaccggagctgggtctgggagctgcagcagagggaaggcggcatgaggagagagccgcaggtggggcgtgtgcacaaagtgcaggtgtgtggaggccctgtgggtttacattgccctgaggcaccacttcacgatcac

SEQ ID NO: 5046 - DNA, 2694 bp, Homo sapiens
attttgaattttcatttttggataaccaagcagctctttaagaagaatgcacagaagagtcattctggcacttttggatagtacataagattttcttttttttttttaaattttttttaatagtcacattcagctcgcttgctcaaaccagactcccacattgggtgagcaagatgagcccataggattccagagttaatacgtaaccgtatatacaaacagccaaaaaaccataatggtgccacagggatggagcagggaagggcatctctaacgtgtcctctagtctatcttcgctaaacagaacccacgttacacatgataactagagagcacactgtgttgaaacgaggatgctgaccccaaatggcacttggcagcatgcagtttaaagcaaaagagacatcctttaataactgtataaaatccaggcagttccattaaaggggttaagaaaaccaacaacaacaaaaagcgagggactgtctgttgtcactgtcaaaaaggcacttggagttaatgggaccaggattggaggactcttagctgatacagatttcagtacgatttcattaaaaggcttggatgttaagagaggacactcagcggttcctgaagggagacgctgagatggaccgctgagaagcggaacagatgaacacaaaggaatcaaatctttacaaccaaattgcatttaagcgacaacaaaaaaaggcaaaccccaaaacgcaacctaaccaaagcaaaatctaagcaaaatcagacaacgaagcagcgatgcatagctttcctttgagagaacgcataccttgagacgctacgtgccaacctaagttctcaacgacagcttcacagtaggattattgtgataaaaatgactcaagcgatgcaaaaagtttcatctgttcccagaatccgagggagaactgaggtgatcgttagagcatagcgacatcacgtgcggtttcttaatgtccctggtggcggatacgccgagtcctcggaaggacatctggacaccactttcagccacctccttgcaggggcgacatccgccaaagtcatcctttattccgagtaataactttaattcctttctaacatttacacggcaaacaggaatgcagtaaacgtccacgtccgtcccacggctgggctgccgttccgtttcctccacgaacgggtacgcgcttccatgagaaaggatatttggcaattttatattccacagtcaggtgggtctgcgatagctcatttaatgttaaacgccatcaggggcctctcctcccgtttctgccaggggcttttcttgtcttctccttggtcatcatcatcatcgtcttcctcttcctcgtgggcagatcttctctggtgggggctggctgctggctccgagggggcatccgcagtccgtctggtcgtctcctcctgcaggctgggcagctggccaccacttctccgactcgacccctccaacaagcatcgcagggcactgtcctcgggggtacagaccgtggtcccacattcgctaccactctgttccacgtcatccaggtacacgagctgcgtgtaggccgtgctgtctggggctcgaggctctttctgctggtgctcttggacgggcgggtagttctgctgcagagacaaagcatctccccttcccttccgggctgattttggttcattcatatctacgccagagtccaaactggcatcattacttccgttccttccagctctttggagatcaatgtatgaatgtctaacgtgagcgttggacctgccatccaaggagacgaaccacgcccgggggtgcggaagcggcttcccacccccaagctccatcagggccttttcagtcaggagctgcacctcactgttcatctgagccaaagccgcgtcgttcagggaagctgggatggagagagactccgacatggatgcgttctgagggctccactcccgggtgcccgcatcctgcagaactgcagcagattaactggccgggccgtgggaaggacgtaggtctctcgaggtgatctactgatcgcgacatcatacattcagtgggtctgcggtccagcagctgttctttctcaggtgatgaaggcgcggggtacagatgttcctgaatggtgagtttgcttcccgtggaggctggaccttctctgtcctgcttttcaaataaaggctgtgagagcacggtgttgtaactacccctgtagtcatcattgcccgaggactcgtagccttctctttccatagattttcttgcctttaagggaaaaacctccactgacttatggtagtctttccccagcgtcccacttggagtgaggttatcaaaggagatctggcttttatcctcttccttgcaagagaggagctcctcccgggagctaaattcctgggaggtgctgtaggagagcttgagcatgggggtgtgcaggtccccttcgccgcccggagacatcatttccaaatggactccactcatcagttccttcgtgccgggggcctcggggcggccgtggctggtgacggacagcgggccagggaattctgacgctcggcgtgaaaacagcaagttaatgtgtgacatggacgtggactggtctcttttggaactctccagtcctgcagggagctgcagttttctgtggtgctgacgaggtttcaagcacttcctcctgc

SEQ ID NO: 5047 - DNA, 572 bp, Homo sapiens
ttcagccagctcaaacctagaaaaacagaaaccacctcctctacactcaccaacttctccattgaagaaataccccaggcagggccggaccctggtgttcctgatcctcctcggtgcctcacggccccagcccggcgaacatccgaacagccgagaaggcaggaggtggcgatcccggccgccgggcagccttggggcagaggtgcagggaggcagggaggaagtcctggctcgggtgggggggcagtcccggtccagggctcggagcagggggctgccgcgctccgggccggaggcttccagctacggagggacccaggaggtctcgggacggcgaggtcccaggtcatacggggcccgaagtgccagccgtggggtctccggacagggggctttcgggatgcactttgcactgggccacccccgccccctcccttcagcactttggggtcactgggatgggaccaagccttcaacaaccaatcagcgcccgcagtggagcctgagcctggagccgtaaaccaggtttcactgaagaaacttcttagagattcattgcacttctgagattt

SEQ ID NO: 5048 - DNA, 599 bp, Homo sapiens
ctgacgacaaggagtacgaatggtcggagccagtatcagggaagccctcttcccctaccaccaccaactgggggcccatagggcactcggcagcctccagccctgcggtagcagcctgtaactccgacgcggcggccgcagcggctgcgccctctgcggctgcaaactccacttgcactgtgagatcgatgggcttcacgtcttctccagtgggagtgatgggcgccggctgtacggatcccggagcctgactgctgtctacagtggcctgaagggtgagaagcacggccgcggaagcagataccaggttcggctgcagctgggcagtctgggcagtggaggcagaggattctgggaaagtgaactccacggaagactcagaaaccaagttctaattcagttgccatgaaaacttaaggtgagaggattgtcaaccagtgaaaaatacggaggaaaacactaacagaatatgatgaagaagccaagacttgggctgcttgcattacattaaccgaggtttacccgcagcgaggctgcctccaaagcatccggagtttgcaaccatcactgtccaccccgcgagctgcgatagtgcgaga

SEQ ID NO: 5049 - DNA, 3291 bp, Homo sapiens
cgtgtgcgagtagatgtaccagagtgcagcagtgagcagggccccgatgaggaaggcaccaaaggtgatgcccagcacggcgggcaggacgaggcctttgcttgtgcaacctagagagggccgacgccatcagcactgccactctgcccctgccccatcccctaccctgttgtgctggcccatgtgggctttggtgccagctctgctcagccatggaccctcgacttctctgaacctcagtctcctcttgcagcaaacgggctcatcacagccaggcctggcattgagccatggttgctaggactgtccacctagagggcccagccaggccttttgggtcatgcctctgcccctcaaggctgatggagatggcgttttcagggaggatggatggggtaacgtgaggaaactgaggctcgggagtacagagcctgccccacctgctgcatgaccttgggtcaaccctgcccctctctgaggcctttagcaggtagagaatgggccagagcagctccgagtgccctgcagctctgctcttggattgctccaagcctcattccctccacattcctgactcctgtgtggctatgggccaagcagtctttccttgagcctctgacatccgattctgtgtcatggggttatcagccctgccttcttggtcctgggctgggagtggaggctccatcctggcctggatggggtggcaaagaggtaggtgcccccatccctcacccctgcctctgccaccagtgtcgggactcttctgcctggtgtgggcctgggcctggggggaactgatggagaggctagagggggcgtcctgcagggagaggcctcaaggaaggcaaggccagcacccaccctcaaagggcctctgtctcacccaggagactccatcctcccagcaaggtcagccaataactgtggggatggagtggagccgtgagtgggggcagaggcctagactcccaccccacagggcggtcccgggcaagggctctccatctgcaaagtgcagctctggcccctgctctaggctgctatggctctgggaagccctcctcctgccccttctgggccgctttctctggggtcccccttgccatgtgctatgtgcccaggccgtttctcagggctgcccgctgtgccctactgtgacctcagccactagaacaaacccgagagacctggagggagctcaccagacaggtcagggctgatgatgttcaagcgcatgaagacagtcctatggacttcctggaggagaaagagagagcagtatgtggcacctttgggaggcggcttccaggtttactccctggctccgtgaccccagcccaccctagagccttggctttgaatcccatctccaccgcttcgtagctggatgcctctgggtgagtcctggaagatctgtgctgtgggagggtgcctagtggacgatccctggctgctgctgaaatgtttcctgtgagttcctggaggccttgatgcccaggagcactgtggaagcactatgcatccctcacccttgtgaacactttggagctatgagccaggtcagcccagagtcccaggctcactctggctggagggagaggcccacttaggggagttgaaggcttccctagcttcctatgaccagagaagtttgtaatcctggaggcctgtctgtgcaagggcctgggggtgactctgggggcgtccaggatagattgcctgagagtgggggtcaccagatggtgaagtgttgtgactggcaaatacagaaagccaggagtgtgtgtcctttgtccgcctctcttccctcaggtctcctgttctttgagattacactggtgaccatactacatggatgtgcgggtggttagattcctgggtgggagggtggatggatggatggacggacgggtaagtgaaaggatggatggatggatagatggacagtggcagctgcatagtctgccagtgccccagacacagcagtcccaccagaaagctctcgggtggcagaaagtgctgctggcagccagactgccaggccacatgcctgattaaggctccgcccctcaccagctggccccacatccctgtgggctgccatgtcccttcctgcaaaccacagacctggaagctcccacttgaagctggggccggcccaggccccactcacctggtcttgagacccggtcttgggacgcagggctaccgtgcagctgagggtgccggttttgggtatgggtactgtgtagaagtggaggaggaagctgaagcgcgggtcaccctcggggcttggggacagcaggctcacacagttgcccttggccgcccggccctggatgagttccacggtgcctccctcaggccccaagtccaggtggcagctgtctaactggagcaggaactcggagacggatggggacactctgacctgcatgggtaggtagggccacgcggcatgggcagctgctcttcaccccaccccacctgctgccttcaaatatcggctagaattaagagttcccacccctgagtcctcacagtggaaagaaagacatggacctgtctggggcagaggaggaggacagggccacatccttgtcagtgtccctgagcaatgccttctctgtctctccctctcccgtgcacccaggctgtctccctcctgactctgggagtctcatctcctctggagtcatggtgggaagaaaggcggagaggaagttccaggagctgggaggcccgaggggtgacaggcatgccaggtacctgcacaaagctctgctgccccggctcgatggtgttggaggcctggaggaagtgtgggctgaggtagaggcccagctggaaagagaggctgtccatgttgaggcagtgcacctttttctgggggaggacgggagggagacttggtcaatctggcggcgccagccaggagggcgaggggtgtggggaggaacaggcatcatggccctgtggagttgcctgactctctttttttttttttttgagacggagtctcgctctgtcgcccaggctggagtgcagtggtgcgatctcagctcactgcaagctccgcctcccgggttcatgccattctcctacctcagcctcccaagtagctgggattacaggtgcccgccaccacgcccggctaattttttgtatttttagtagatacggggtttcaccatgttagccaggatggtctcaatctcttcacctcgtgatctgcccgcctcggcctcccaaagtgctgcgattacaggcgtgagccactgcgcccgg

SEQ ID NO: 5050 - DNA, 2481 bp, Homo sapiens
gtgtaggtgcatttgtttaaaaaatataactccccattgcctctgggataaagtcttatctcagtttacatatattcttgataacctctccaactttatgtctcaccacccccactcacttcgtaattcgtgccttatcagaatggacctgttatactggcagttcaccatatataccattacattttgtttctcccatctctcaggtagacttacactttcggcccagcacatcagtcatcgcccttgcttgctttcctattcactcctgttctggaaggtgcaccaccttttcttggaaggcttcccttgctctcccaggctagatgagatgtccttccatcagttcccacagcaccctgtgcatgtatctgttgtgcacttaccaatagtatacaagggatctatgacccaagtctctccccactagcttgtaagctcctcacagacaggaaccatgttttgtctttgtactccagtgcctagtatataagagatactcaataaataaatatttgtcaaatcaactaattgattccttgtgacctaattctagagaatgggaagaaggcctgttattttgttgtcctttatggttctttaggaaagctctccaagcttggcatttgtcagggtgggaggaaaactgttgaagtattaagactggacacatggctgctaattcatcagcttatcattgaaaaagtccatagccaaaacctgactgtgcacttactataggaccctgacctgcctgggtctccctgtctctccagccagtatatttaaaggtaatgagataatgatgagtgttttgaaaaatgtttagtgttcaaatagaaaccattcgtgtcccttcactctctgaacatagtctgcaaatctctccctctctggtatgtttctgttttgtggattagactgctaaataagcgaagagttaattttgaagttcaggtcaacaaattcctgtttggagacgggctgttcctgaataccaggttgttatctgtctattacagccccttcacttctgggctcctggccctttgcgaagtacttcagaaagcctagagagaagagagggccctcaaatcccattccagcccctaaatgaaagtggcatcacaaggagaaaagtggaggtagaaatgtaccatgggggacgttgccccattgcctttcttcccctgactactgggcttcctctatcagcttttaacgcctggaagtagctgagtctccagtcactggtggccttccccaagtgagctcagcagcatgtgctaataggtgccaatactgtgctggctccagtgggattcctctctgcaaagctgctggcttagcttgactgtttccctattcctctccttagaactttcatagccagtcaagcatagaattgcatccattcttctgaaataggtactgtgcctaatttttcattggcttggccaagattctgttacctgtaattatgtcatatgggctgactggtgtaggtttggtaggcctcactgctctccagaggctagtgttcctatcccaggatggctgttgggattaggagtggaatgaggaatagtttaggaccacaagagatttggcctccttggaacatgtaggaaggcctcaaggatgtaattctagcccagggaagaaaatccttttcagcagacgcttcccttcccttcccctagggaatgtgtccctactatagtaaactcttccttaagagagttttatgttttctctgtcagatcaatttgtttttcttaatgttgttcctatcaaaaaaaaaaaaaaggaagaaatacagtcctcagacctgacagtttcatttttccccccaagtagaagcaatagaaaccttagcagttccaagactcctggcactcacttttcctctccatctttaggtctaacccagctcagcccagagtaaagacataaaagcctcacatgtgatttcctcttgcattttttctgctagaagggtccacagtacttactttatgcctcatctcaattgaagctggatgatgaggatagtgggcagtgattgcaattggggaatgcatgtactggatcacataaggtcatgaaagtccttgaaacagagccttgccaagcagaacccttgccactcatggtattcgatacagtctacccatctgacatgaaatgatattcttaatgagccattcctatggaagatagctattgccaggcacattcagtctcctggtctccctctcatagctatgtagggcctatgacctagaataaatggaaaaatgttatcaggaggaagagactgctggactcccctgagaggtagggtttgtgctaggagagctgggtgccatttatttcattttgatatatcaggtgctcctagtaacaattcctagtttctcttacctctgtaatcatcctgaatagtcactgcttcttgagctttggtgagtgttctct

SEQ ID NO: 5051 - DNA, 1482 bp, Homo sapiens
gtttgaacatttattcgcctcctgagcttgtacaacagtcgtgggagttgctgcagaagcaagcgaaaagccagatgagcgcttctaaacttagagagaggagggcagccactgaggattcttgaggagagagagaccatagaatgaatgaaagagttggaaagactttaaagctctgggaggctgaatcctttatttcgctggaagaaaaactgaatgccaagagggcctcactttccccaaagctatacagccatcaggggcaatgctgggattcccccatggatctcttgactcctaatacagtgctctttctgatatgccatctggctccataatgaacattgtgttccaggaaaatcagtctgcgctgaacaggatggaattggggcaggacgtccagtgaggaggacattgaggcagtagagcagttgattgccgaatgaccacctaccctgacttaaaagatcaacctcagggaggattggagctttctagagtctcttgggacagcagaagcacaggccgggttggactgaatctttaagtggacatgagggacaaagtacctcctgttggtaaacatctcaccaccaacccactgtggtggctaaaatcccacctttagtcccagcaacatatgagcatgtcaccaggaggtcttcacaggcctgtctgccacctgagtgtagacatcttttggccctggagcccagagaggctgaatgtggagagggtggagagaggtctgtagtcctcagagaagacttgcagctttttcagagccaccaacccataaaaaaaaaaatccccaaacagaaaaatcctaactgtggtgaccaggtacctcctgagacatgaagcctccacttacctggaccctggaggcctctccgggcacagctgccaatgttgatcttagataagaccaccagcaagtaaacatccactgtgcaaagctgtgttatctttggggaactgaaatgtcccctgggagttggaaactcccctagccacataccacagagttgaggaaggaagagctgatggacggaagaaccatggcgggaggagtcatccggaagctacctcgctgccctgtcagttacggaacagaggagagatgccggctggaggacacagcaaatttgaaccaagaggagcttggaggaagcccgagcgacctggaggggactggctgaccttcctcattcttttcaagtgtgaataataaccaagcccagtttggcaactccttgagggtgaggacgaagccccattctcctttttggaacttggtggggctcaggaagcaggttctctccagtcggtggctttcctttctgttgcgggtctcttgagggcctgccttcatgaaggcacatgagtgactcatcatttgtgaattaattgctatatgtgaagggcatctgagaacaaattatcttcatagacttttcattataattttatttgtactga

SEQ ID NO: 5052 - DNA, 1119 bp, Homo sapiens
cctgattgtttaagcttcaggctaaacctggaccttccccggcccctaccagcagcacatgaaagtcgccattgttcctcatcacttggtagcgtcagactttataattttctgctagtccaatgggtgtgaaatgcttgattattttttaaatctgtagtccactgagttgttgatgactcatagttcagattcccatgcctgacctcccaacagcctgggaggcgcagatgtccaagctgatccgggtggagcgccacttccatggtgaggggactgcccactggagcaagtgagggtggcagctcagggtggggcatgctagctaggagcctctcctacaggcaccagggagtggggcaggccccgcttggccagaatgggatggtggctgagttggccttctctgactgtgtccactggctcctggctctgtcccttctctgtagctatttagagagggctactgcctgatcttccgtgttttctcctctcttcctctctaaagggaggagaagtgttctagacagagatttcacaggggtttggtggagaagtgacttttctggtttttcaagaccagaggctggctttggtgaggactcagtaactttgagctgctccctggaaactgctaagtgtgatgatggggctcatctccacaggattgtcagacatgtgtcatcacacctgagctatattttaaaagattgccttttagcttttcataagtcactcccccacctcacagggatggggcaatgccagaactggtgcaaaggcaccctttctgtcccagtgctttcagaagtgagtaggaagccccacgatgctgctgccagcagcgctcacactcaggtcggccagggacaagggctgaattttgcacctatactcgccacaccagcaggcgaggggcagagcatattgtgctgccagcacagactagctctgcacagccttagcagtggcttggctttgtcctgggcccagacacattctccagagaaggggctgggagtagggactggaccacctgggacctgccttgacacaggacagagccagccagacttgaactagaaggggctgggggctgacttaagccactccagggct

SEQ ID NO: 5053 - DNA, 1672 bp, Homo sapiens
acacgtgtgcgggctgagtcgccggggcctggagggggaaccgcgcgctgcggctgctgcgcttgctccgtccccggacgccgctggcttgcttcccttgtcagctgtgtggggactggcagagggtgtgagagcgggaaacgaccggacgagcggcggggagcgtcctgggtgaggaggaggaagtctggtcttaggtgtgaaggatgctgacgcgttccggcgcgtcgcggtgccactctcggcttctgagcgttgccctacgccgcagcgggttttcctcagctgtgaagcgcggctgcgtcctgcccgggcttccccccgccgggacggttccaacgcccgagcccagcgggcttgggcctccgctgtcgggccaggctagttgctccggggctgggagttacggcaccggggttggggcggagaagacgaactagttcaactcgacccggttaagcaagcgcagcagtgtgtgttcttggatcatagtatttcatgtaaacattttgatttaagagaaacaaaagggaaaatattaaccgttttcaagcatccaaaggcgaaatgcttcatctctgggatggagtagaggagtagcctctgcggttgagttgcagtcgtgggtgcaagaagcagcgctgaagcagagtgcagccccggaatagggcgggatggaatggcctgggcagttcagaaacccgcgaggagtccagggcggaacagaacacaggtgtcatgaaaactacccctaaaagccaaaatgggaaaggaaaagactcatatcaacattgtcgtcattggacacgtagattcgggcaagtccaccactactggccatctgatctataaatgcagtagcatcgacaaaagaaccattgaaaaatttgagaaggagactgctgagatgggaaagggctctttcaagtatggctgggtcttggataaactgaaagctgagcgtgaacgtggtatcaccattgatatctccttgtggaaatttgagaccagcaagtactatgtgactatcactgatgctccaggacacagagacttcatcaaaaacatgattacagggacatctcaggctgactgtgctgtcccgattgttgctgctggtgttgccaccctacagccagaagagatatgaggaaattgttaaggaagtcagcacttacattaagaaaattggctacaaccccgacacagtagcatttgtgccaaataagcgctggctatgcccctgtattggattgccacacggctcatacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaa

SEQ ID NO: 5054 - DNA, 1481 bp, Homo sapiens
atgccctttatttatatcaatattatattaacatacaccatagcattgctgggaatattagtctatcaatcccacttaacatcatccctattatgcctagaaggtatagtattatcaatactcattataattattcttataactttaaatatacatttcactctagcatccctaatcccattagcctcctattatttgtggcctgcgaagccgcagtatgccttgccttactagtttcaatctccaacacatacagcctagattatgtacaaaatctaaatttacttcaatgctaaaagttattattccaacaattatactgttaccaccaacatgactctgtaataactccataatctgaattaacataactatccacaacctattcatcagcctcattactatatcttacccaattaaatgataattcatctaacttctcactaactttctcctctgacccactaacatcaccccttctaatcttaacaacctattacctcttgtaattctagcaagccaacatcacctttccaatgagtcacccccacagaaaaaactctgtaatagttctcttcccctacttatcacacttacccatactcaaaataccttgggttcactaaacataataataataataatatttaccacccaagaactattaacttcctgatctaataatcttatatgactagcatgtattatgactctcatagcaaaaatacctctatatggacttcacctatgactccccaaagcccacgtggaagcccctattgctggctcaatagtacttgcagaggtactcctaaagctaggtggctatggtattatacggcttacccttaccctcaaccccctaacagaatatatagcctaccccttcctcatatccttatgggaaatagttatgacaagctctatttgtctatgacaaacggacttaaaatcactattgcatattcctccataagccatatagcacttgttattatggctattctcatttgaaccccttgaagctttacaggtgcagtcacccttataattgcccatggagtcacttcatctttactattctgcatagcaaattcaaactacgagcgagtccatagccgaattatattacttatctgaggccttcaaacactgcttccactaatagcctcttgatgacttttagcaagtcttactaaccttgcctttccccctactattaatttaatagaactcttcatcactatggctttattctcttgatcaaacatcaccattatgcttataagacttaatatactaattacagatctttactccctacatatactaatcacaacacaatgagggacacttgtgtattacattaacagtattaaatgctcatttacacaagaaaatacattaatacttatataccttgcacctatctttctattatccttaaaccctaagattattatggggtttgcatactgtaa

SEQ ID NO: 5055 - DNA, 3106 bp, Homo sapiens
gtcagcccctgcgatacttccggggcgaaggtcgtctcccgtcagcccgcgggtgcccagttgtgctcctgaactcgcggtggtggtgcgtgttggggagcggatgtggggccgcggcggggactgaaaggagaacggggccgcagcgcccgtggctattcgcggacgatggataaacagcagcgcacgcggaccgtcccggagcacggccccggccgcagctgtggctccgagggcaccgtgagggcagcggacccgggtcgggggccccgcggccggggagctcgggtgcggcgcgggcggggaggggcaggccgccccctggggccacgaggatgttcaggaaccgaggtggagatggtcgcatcggtgtgaaagtgcccgttgcctctgaaccttgcactttgtttacttactcattttgagacggggtctcgcccggtcgccctggctggggtgcagcggcccgacctcggctcgccgcggcctctgccttcctagtagctgggacgtcaggcgcgcgccgccacgcccggctaattttttgtgttttttgtagagggggcgtcttcccgcgttggccaggctgttctcggactgctggcttctgctgggattacaggcctgagccaccgcgccatgcctggaaattctcagcttcgaaatggtaaatgtgatcgctgtggtgctgatgcctgtaatcccagcactttcggaggccgaggggggaggaacacttgagtccaggagttcaataccagcctgggcaacatagtgagaccccatctctacaaaaaatcaaaaagaaattagccgggagcggtggtggcgcgcgcctgaggtcccagctactcaggaggctgagacgggaggctcgcctgagctctggaggtggaggctgcagtgagctcagattgcaccaccgcacaacagcctgggcagcggagccagagtctgtcccaaaaaaataagaagttttatattatgtgtaattttatatttctgctatattatcgaaaaattgggggtgtgcagtttctttataacagtttattatacttggatattttttaaatcatagaagagttggaatacaagtacaaggaaaactccccagtgttcactaccaaaatgtgccagctgttttcatttgttccatttgtttaatactctcgaaccaaattcacctactatttacgttttgctccatttttgaatcattctctctgtaaatataaacataatggatttttttcctaaaccatttgagacgctggagacacctaaacactttgctgtgtatttactcttaggaaccacaccgtagaatggtcaaaatccggacccagcccacactccagatttaactcgcttcaaatgtcttttatacctttttttccctgttgaggattcagtctaggatgacgcactgcatttgttgttgtgtttcttgttttgttttgtttttttctgtttttgagacggagttttgctccgtcgcccagtctggagtacaaaggtgcgatctcggctgaccgcaacctctgcctacccggttcaagtgattctcctgcctcagcctcccgagtatctgggattacaggcgcacaccgccactcccagctaatttttgtatttttagtagagacgggatttcacaatgttggccaggctggtctcgaactcccgaccttaaatgaccaggctgaccaacatggtcagctactcaggaggctgaggcaggagaatcgcttgaacccgggaggcagagtttgcggtgagccgagatcccgccattcattgcactccagcctcggaaactagcaaaactccatcttaaaaaaaaagaggaggccgggtgcagtggctctgcacaacactttgggaggccgaggcaggtggatcacctgaggtcagaaatccgagaccagcctggccaacatggtggaaccccatctctactaaaaatgcaaaaagtagccgggcgtggtagcgggccccagtaatcccagctgaggtgggagaattgcttgaacccgggaggccaaggctgcagtgagccaagatcgcaccactgcactctagcgtgggtgacagatcaagaccttgtctcaaaaaacaagaagaagaaaaactactttttttttttcagatggggtctcactctcacccagtctggagtgcagtggcgccatctcagctcattgcagcctctgcctcctgggcttgagtgatcttcccacctcgacctcctgagtagctgaaccacaagtgcatgcctggccaatttttgtatttttggtagaaatggagtttcaccatgttgcccaggctggtctcaaaactggcctcccaaagtgctgggattacagacacaactggcctacctgcaggattttcagtttatggacatgactgactggagacatggagaagctgttgttattggagatttttattactcgcatttcctgagcgatggggacactcactgtggggaaaagcaagagagatcagattgttactgtgtctgtgtagaaagaagtagacataggagactccattttgttctgtactaagaaaaattcttctgccttgggatcctgttgatctgtgaccttacccccaaccccgtgctctctgaaacatgtgctacgtccactcagggttaaatggattaagggcggtgcaagatgtgctttgttaaacagatgcttgaaggcagcacgctccttaagagtcatcaccactccctaatctcaagtacccagggacacagaaactgcggaaggccgcagggtcctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggaatgcctcttgcagttgagacaagaggaaggcatctgtctcctgcctgtccctgggcaatggaatgtctcagtataaaacccgattgtatgttccatctactgagatggggaaaaaccgccttagggctggaggtgggacccgcgggcagcaatac

SEQ ID NO: 5056 - DNA, 1065 bp, Homo sapiens
caacagctgtttttcttaacgctctgtctcccgaaaagccccagtgtgtgttgttccccttcctgcgtccatgtgatcccatttttcagctcccaatacaagtgagaatgtggcgttttgtactcttttcctggattagatttaaagtggactcattccaattacagggcctcgaaagagtcctgtattgttatttttcgtcactacctccccgggtcgggagtgggtaatttgcgcgcctgctgccttccttggatgtggtagccgtttctcaggctccctctccggaatcgaaccctgattccccgtcacccgtggtcacccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagtttcactgtaccggccgtgcgtacttagacatgcatggcttaatctttgagacaagcatatgctactggcaggatcaaccaggtaggtaggtagagcgcggcgaggccccgacgcggccggacggccggccggggggcctcgcgaggacgggcccggcgccccgcaagcgaggaggacgacggacggacggacggacgggccgcggacgggcggacgggagggagcgagcgggcgcgggggcggcggccgggaccggtggggccggggcggggcgcggcgaaccggacgccccaaccacccgccccccacgcgacacgaccaccggggccccgcgccacagacccgcgacgcttcttcgtcgcgcccgcccgcgaggaggcggacggcccgacccgcgcccggcggccgggagggaccggcggccacgcgcgcgcgcgcgcggccggcgcccgcgggcggcggcgaggcggggacggcgctccgcccgccccgcggggcggccccgacgtccgggcggcgagcgagaggcggaccgcgg

SEQ ID NO: 5057 - DNA, 888 bp, Homo sapiens
ggcggcagcagcagcagcagcagcagcagcagcagcaactggatttgctttttcaccagaggatccagatttccctgtggccttgcaaacaaaaaagaaggaagacggagcagcacagtcatccctttgtgaaaaaagcattcagagacggggtttcaccgtgttagccaggatggtctcgatctcctgacctcgcgatccgcccgcctcggcctcccaaagtgctgggattacaggcgtgagccaccgcgcccggcctcagctggtttttcaaaagtcatggcgtgtaattgtcagaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaagaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattg

SEQ ID NO: 5058 - DNA, 1267 bp, Homo sapiens
ataaactgttgggttagaatctatattagaatctttcaaactaattgaaaacaggaagactatcatctaagtagccagataatctgggtttcaaaaagttattccatggtactggtttaaaaaatacttttcaagtgttttaatttttaaagtgtaactaattcttcaaatatgttatgctgttaaaatatgtattccataagtactttttgtatatgtattcttaaattttaaaaagtcaactgaatgcgcaaagatgatataattttggatgtagacatttaaactagattcccagtcctctccttcaaaagcttggtctttgtttttcctatagggaaaaaagtcaaaataagttccaaaaactatcctcaaagtagtattgtgcttgtagtaaatgaaggttggatggatggatactgacaatggtggcaggcatttcaagccttttaaattagtactttttgtcgtcttgcttattaaaattttgttaattttagcaaagaccaattgttgtgataaactggtgttttttggatgcttcaagcacacgttaaccaattttttaattccccttttggttcctcccattgttctaaaataggactttcatattattaaaacctcaaaagatgatccacccaggatgaacaaagatcaccaaggggaaagaaaacattttttatctttacagaaaacatgttaagattatatatagatgtattctttacattggatattgtattagagtcctccttacaagaaatgaaatagtttttagcactcttagcattagagttcctagattggtgttgatagctacagttttaaaatgtataacctgaaaatgaaggttaattttgcattgtaagagcacatttgatctatgtaaaaagtgtccatttggtgtatttttttaaaaaagagaaagcactttcatattaagtagcatgtgtatgaatttagattttcatatttgttgtgtctgtattcagtgaagtaaattgagcatttaaatgtttgttgatggcaacattaactattaaattaaagcaccttatactctgctgcttaacttgcttgtaattgcacctttgttacctgcacattttcatatagaatattgttgtaacattgcttcatgtgggtctggatggaagattagtgggcctacaggatcatttatttatattgtttatattacaataatatattgtagatcagttgtaagttcatttctttacaaataaaagcctcttccatttga

SEQ ID NO: 5059 - DNA, 250 bp, Homo sapiens
aacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcggacattt

SEQ ID NO: 5060 - DNA, 17889 bp, Homo sapiens
ttgttgtgagaaaaaaattacaaagacgttgtaaagattgggaatgaggaaggtgacttgatcgggtatcacagacttacaaaatcttgtatgtaattagagttatgttaatggcacatttataagcaaagtaatgtcatggaatggaagacccataagttgacatgagaaacagaaagtgtattaaagttaatctgcattcatgggggcagattgttagccaaatgaataaagaattagattcatcttcatggtatgtagcatgaagaatttaaaatgaatcagaggtttaaattaactgcagaaattatagagtttcagaaaacgaatttctctccaattttgaggaaattactgatgatacacattgtagaagcaacaagaaacacaaagattgatagtaaaaatgaaattacagagttgaaaaagttgtgacatcacataagaagagtgaaacccttggtgtgtaagatataatcggggaaaaataccagttcaaaggaaaagtgacttgagcacatagttcactgaaaaaaatacacaaagtgctgttaatcatataaaaggattcttgggtttgctcataataaggataatgacaattgaaaatacaactaagatataattagtttctctactattagactagcaaaagtccagaagtttgacaacatttttttttttttggcaacatgttcggaattatggaaaatcatacgttgcttctgggcatgtaaaatgtaaaccatatgggtaggaatttaatattttgtaaatttatatctgtggcaaatacatagttcatctcctagtaatatgtagcagtaagaaggattgatggatgtttgtataccactatgtgataatgtcttggatataatgtagaaataggggagaagtcggctacaggaagtaaaaatggcaatatggtgctcagggtgcattcatcactataacagataaccattttgttaatggtgccctgcgcggtaactgaaattgtactgggctttcaacagaattttgtcaaaatgggacgctgcatgagctaataagttgtgaaataaatagggttttattgtggagtaataagtaacacaaagaagggggtttgcagtatcttaggaagaagaacagacgttcttggtaaagttcctttaatatgaaaatagcatttttaaatacttggagtagtgagtgaagaagctttctctatgagagcacggttagttcccaaataaatcccagcctcctctcttctgttaatttcttcggaaggatttgaggtagcttttgaagtatttggtcaaagttgcaaactcctcgggaggaggccaggcatggtacctcacgcctgtaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaaaaaggaaacctgagattctgcttaacaattgtaaagtcagaaggtatgaagagtatttgaagttagacctgtggacaggctgattggatcttcagcagtatgagaaagtttagttaagccaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaatacagcgagttctggtcattattttattgttgcatttgtgtgtttgtgtgttttgaatacatacatgt

SEQ ID NO: 5061 - DNA, 3155 bp, Homo sapiens
cagtcactaatgcgtgtctctccaaggtctaaacaatggaagactgtagaagatgttattcattaagatatctcaagaatgtggaagactattattcgcttctaaagggacaggacttcatagggcacctgaagaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacagactttttgtaagtttttcatatatgcttgcaaagggttgtaaaactttattgtgattattcttgctttaagctgaaacttccctaatctttctttagagattgtggcatagcatgttagtttcttttccatatccaattgttttctgtaatgaatacagaaatatgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattatttttccttccactgtggtttcccgcatttcaacacatcacctatttttgtcctcaaacattacttaaattttttccacagaattaaattaaatatgaatcatccctcctctgatttttgaaatgaccctttgcttcctatgataatgattcttctggtccattttgtagttatatgttagagtttgtaaatagtcacacattttgcaactgcatataattttcttattattttttcctcttcctctaaacctgctgttatttcttttaactttttgtgggaaaaattaaacccatctttcactttgttgatatacttatttataattgaactccttgatttttgctcaaattgcttttcaagttacccacttttagggaagacattatttgggttttgtttagtgtatcaggctttttttagttagttgtatcaagaagtgtagacttttctatacataatatcctttttcccacagtagttttttttttttttttttttttttttaaagtctggccgggtgcagtggctcacgcctgtaatcccagactgtgggaggccgaggcgggcagatcacgaagtcaagagacggagaccatcctgcctaacacgttgaaaccccgtctctactaaaaatacaaaaaattagctggacatggtaacgggtgcctgtagtcccagctaatcaggaggctgaggcaggagaatggcatgaacccaggaggcagaggttgcagtgagccgagatcgtgccactgcactccagcctgggtgacagagcaagactccatctcaaaaagaaaaaaaaagtctgttaaaataaaggtcatcaaaagatcttttcctaaacctttcctttaccagaaatatctctagagtcacatggtcctttctcccttcttgcttttgtaggagtccaaagctaatctgtccctgatccagattgcaggcacctgtgccttttggggcccttctgcattagttcttccttctcttctaacctcaaaaatgtgttttctctgttggctctttccctttaacatagaagtatactcacgcttttgttgaatcttggaataaaagtcttcctttaccacatatctccctttaatactacatctctcttctcagccaaatacttgggaagagaagccctgagtttgtgtcattgttttctcacctccagttcactactttacccactgcctgacatccagctcgctcacacacacacacacaagcccaatcactaagttgccatagctaatttgtggctttcctgccctcctggcaaaatttgactctgcattgggataatacatgttgagtacctattgaacaggcactgtgctaggtgctgctgttatagatatgaaaagaaggcatcatctcctttctaacaactcacaggagcagccattcctgattcatatgcaggtctcttgagtctcagtgctcacttttgcaagcttcacttaatgccgtgcaaatcaccctattctccaggtcttctttcttcccagttctccttactatacacagcttctcagggcagtcacctccacacccatggcttcaattgctttctccattctctgagaacaacagaattttaaatggcttttttttttcatgtattagctttattttatacaaggtgcctcaattgctgtaaccatagattcaaagttgctccatgaaactaataaatgaaaaatggtgattttttagcatgtaaattttaggaaatttccccagttacgcttaatggcttgatttagtatgtatgttatttttgaaaacatatgttgggatgtcacaaatggacttagcctacagagatttatattcaacttttgaccagagagttccattttaatgtgacactgagagtaaaaaactgtcttttcctccttacctatttctcttcctacattcttggccaggaggaaggcactgctacatacccagtcttccccagcagagcctgagcagctctgttttccttctacttcccctcttctttcacatctcatgaccaagcacttcctattctgtctcccaaatgatcacagactttttcctccgcttttgtcactgccactgcccttagcattactctgcctttagagaaagtctcttaatttgtttggttgcttccttcagtccttattatacagaccactacacacacatctgacagagacttttcaccttttcatggttcaatgactgaaattcccagaataaaattaaaaccaccccagcatcaaatttgaggtcaaatagaggtgggtttgtatcccaggttcatatactgtccagcagtatggtctcagaaaactgacctccttaaggctttgtttgtgtatctgcctacactcattgagagttgggactatttcacacatacagtgcctggcatgtagaagggacttaatcaatgttgaaagaaggggaggcattttaaaatccac

SEQ ID NO: 5062 - DNA, 435 bp, Homo sapiens
tcagacaactcaatctttgtgtaaatacttggtaaagcaacaggacacagaagaggaatgctggaaaaatctggtttatgaaaacagaaatcaaaccaagttactaaccaacctccccgtcccctccaggcacacaaaaacatttgcctttgtactctgccaatgcttgatttaattataatacacactcaagtggctgtaaaaaaacccaacagaacagaaaccatttaacatctgaatagtgatttatgaacagatttcctctgacaaatggggccagctattcttaaggcttgccaaatagctgttagatgtctaaatttttgtatgtgcctgcgtttgtatgtggttacactgtaaagtaatgacagactgaggctttgatttcagaacttcagatgtatcaaaaatacagatttttaatatttgatttta

SEQ ID NO: 5063 - DNA, 32663 bp, Homo sapiens
ctaccgcggtcgctgttggtggcgccgccgggcctgcgactaggtggcatccttcagacactataggccgtctctgcacacgtgatgcggggctcggtcacgttgccccctggaagcttgaggatgcgccaggtttgactctgcagggcgtacgcgctttagggatggaaggaagaggaacgcggcaggaaggcgagccccaaggtggagaatcgcctgggcgcgcaggctgcggcggcttcgcacagccgccctgggcgctgcacgggtccgcgcgcaccctgctgcgcacccactcgcggccagctccctacagaggagtggagtgactgctcgactaccacccctcttttagtgtgagcgtctggagtcctgaccgccccagccagcccagctacgatgaactgtctaagaggatgtggcaagacccagaagtatgggtgaccttatgtcagaggaagtggctttcttattgcagcaaaaattcccgtaccaatgtcagtgctaggatggagtttcactgtgtcacccaggctggagtgcagtggcacgatctcagctcaatgcaacctctgtctcctgggttcaagcaaatctcctgcctcagcctcttgagtagcctgagtagctgggactaaaggtatgtgccaccacacctggctaatttttgtatttttagtagagacagggtttcaccacgttggccaggctggtcttgaactcctgacctcaagtaatccacccaccttggcctcccaaagtgctgggattacaggcatgagccactgtgcccagccaacattttttctttcattttgactttggagaatctgctgatacatatcttagggatgattttcttgaatagttatcttactggggttctcttgttcctgaatttgaatgttggcctatcttgctaggttggggtcattctcctggatgatatcctgaagtatgttttccaacttggttctattcttcctgtctctttcaggtaccccaatcagttgtaggtttggtccttttacataaacccatatttctcagaggttttattcattcattttcattcttttttctctattcctgtctacctgtcctatttcagagagatagtctgcaagctctgggattctttgctctgcttggtctattctgctattaatacttgggattacattgcgagtacttgtagtatgtttttcagctctgtgaggtcggttatggtcctttctatactggctgttttggctgtcagctcctgcattgttttatcatgattcttagcttctttgcctttggttaggacatacacctttagctcagcaaaattggcttttgtccacattctgaagcttacttctgtcatcttgggctcagcctagttctgagcccttgctggagaggtgttgtgatcatttggaggaaaaggggctctctgggtttttgaattttcaagatttttgcgttgattctttctcatttttgtgggcttatctatcttcgatctttgaggttgctgacctttggatggcgctttcatggattgttttgttttttcatctttttcttttagcagtctgtttactcttccttacagatgctgcagttagctgggggtccactctacaccctggttgcctcagtttttcctgtacttggaggtatcagcagtgaatgctatgaaacagcaaagatggcagcctgccccttcccctggaagctccatcccagggcggtactgtcctgttgccagcatgagcacacagtatgtagggggtggctggagaccccagttgggacatctcacctagtcaggaggaacgggatcagggatccacttaaagaagcagttgggctgtttttgatagagcagttgtgctgtgttggggatcccatcagccccttgttggtttgggctctccgaggcccacaggctgaactggctgaggtgcccaacagccaagttggtggcccgccttcccctctgggcactctgtcccagggaaaaattagaagtctgttggccacagaacatgggcgggggtggctggataccccagctggcatgatctacccgtcaaggaaaagtggatcagggtcccacttaaagaagccatctggccatgcctcaatagaacagccttgttgtgctgggaaactgcttctgcccttgttggcttggactctctaaagcccactggttggaatggctgagtcattcaaacagccagcttggtggccctcctttcctcccctcctcccctcccctcctccttccctcctcgcctcccctcgggcatgctattccagaaagagatcaggatccgtttgtggaatacaggcagagatggctggaggccccggttgggaggtccctcccagtgaagaggaatggattggggccccacttaaagaagcaacctggccacgttcaggcaatgccgctgtagtgttctgggaagacccttccttgtttgaaccatatggattctccgaagcccatagactgaaatggctgagtcaaccaaacagtagagatggcagcccacccctcccactggggactctgtcccatcacagagtcgtgctctgtcacccaggctggagtacagtggcgtgatgtctgcttactgcagcctacacctcccagttcaagtgattctcctgcctcagccttccaagtagctgggattacaggtatttgctaccaaacctggctaattgtttgtggttttagtagagatgagatttcatcatgttggccaggctagtctcgaactcctggactcaagtgattcgcctacttcagcctcccaaagtgctgggattataggtgtgagccactgtgcccggtcccactgagccaattctcttattgccactttggactcctcccagtgaggacaaatagacactgaggacatcatgatatgcagaaagaaacttggagtgcaagacaagagacctgcacctttctttcagctccgttccaagctgcttgatcacagacatctcttctgttagatgaggataacaggatctgctctacctgccctggaggatctttgcaagaatgaagttagggggaaaaaagtgacagaacatattgaaaacttttcataaatatcagatgccttatttgttgtgacactatgggtggacagatgatttcagttgagagaagaattaagattcctatgccctgcgtttaactgggtcttggttaccctgaaagactgagagagcaaaacccaaatatagagggagtttttcttaactgtcctcccaccatggcttatttgcttccttctgaaagttcaaaattgatgctattaatttggggtgtcagcagttattaatggatccttgggccagcagatttttgttcctgctctggagggcaggcataactctgatgtgaattggacgtgttgaatactggagtggattactgaaagaaggaagaaagggaaagttgcatttcttgagtgccaagaatggatatttgaaacttcatttaattatacagtagttcagtgaggtagcaatcaccatcaacatcttggagataacaggctcagggaagcttaacatgttctcagtgacagaacatcatacacacaaagtggcagaattggagtttgaattagaatgatgccaaagccaattattttgttctctatccccctgaggtcttagggctcatctaataccctttttttggcctctaaaacttctccctgcattttcaggtgagaaaactgagttcactccacaatgactgaactaatctacactcccaccagcagtgtataagtgttcccttttctctactacctcatgagcatctgttattttttgactttttagtaatagccattctgactggtgtaacatgggatctcactgtggttttgatttttatttccctaatgattagtaatattgagtatttttcatgtttgttggccgcatgtatgtcttcttttgaaaagtgtctgttcatgtcctttgcccactttttaaaggggtagtgtttttgcttgtatgtttgtttaagtttcttgtacattctggatattagacatttgtcagatgtagagtttgcagatatttatctcccattctgtaggttgcctgtttactctgacagtttcttttgttgtgaagaagcttgttagttcaagagcttctttagggtcccatttgccaatttttgctttattgcaattgcttttggcatttttgttgtgaaatctttgccattttctatgtccagcatggtatcacctaggttatcttcgagggtttttaaatttttaagttttgcatttaggtctttaatttatcttgagttgatttttcgatatggtgtaaggagattttcaatcttctgcatatggctaggctgttttcccagcaccatttattgaataggaaatccttttaccattgcttgtttttgtcacctttgtcaaagatcagatggttgtaggtgtgtagctttatttctgggctgtctattctgttccattgttctatgtgtctgtttttataccagtaccatgctgtttcggttactgtagccttgtagtacagtttgaagttgggcaatgtgattaccctagctttgttctttttgtttaggattgccttggctattctggctcatttttggttccatatgaattttaggatagttttttctagttcagtgaagaatgtcattggtagtttgataggaatagcattgaatctgtaaattgctttgggcagtatggccattttaatgatattgattcttcctatcaatgagcatgaaatattcttacatttgtttgtgtcatttctgatttctttgagcagagttttgtaattttcgttgtacagctctttcacttccctgattagctgtattactaggcattttatcctttttgtggcaattgtgaatgggattgcattcctgagttgactcttggcttggatgctattagtgtataagaatgctactgatttttgtacattgattttgtataccaaaactttgctgaacttgcttttcagcccagggagcttttgggctgagactatgggattttctagatatagaatcatgtcatctgcaagcatggatagtttgacttcctctcttcctatttgcatgccttttgtttctttctcttgcctgattgctctggcctggctcctattattttaaagtatgttccttggacgttgaattttatcaaaagccttttcttcatctattgagataatcatgtagtttttgtctttagttctgtttatgtgatgattcacatttattgatttgcatattgtattagtctgttctcacgctgctaataaagacacaccagagactggataatttataaaagagaggtttaatggacgcacaattccacatggctggggcagtctcacagtcatggtggaaagcaaaggagaaagaaaggcacatattacatgacagcaggcaagacagcttgtgcaagacaactcccgtttataaaaccatcaactctcatgagacttatttactaccatgagaacaatatgggggaaatcacccctatgattcaattatctccatctggctctacccttgacatgtggggattattacaattcaaggtgagattttggtggggggacacaacccaaccatatcatgtatgttgaatgaaccttgcatccaagtgatatcaaacctcttcctaattcccttttcctcctacccttcccagtctctaatatcctccattcattctattttgtactcctgtgagatcaacttttttttagcttccacatatgggtaaaaatatctggtgtttagttttttgttcctggctagtttcacttaatattatgtcctcctgttccatccatggtgctgtgaatggcaggattttattggttttatggctagataatagcccagtgtgtatatataccatattttctccatccattcatctgctgttggagacctagattgattccatattttggctattgtgactaaacaataaacatggggttgctacaataaacatgggggtatacatgcaaaacatttcttaacatctttttttctaactcttctaccccttattttatcaccaaaccctgcactatctcctgttttttttttttttttgaaataactggtgcttgctttacaggaagccccagaaaacactgtgccttggaattcctaggcacttaacttacaaatataatggaaccaaggatcagaagctggatttgaagacattgcaaggaaggtgtttcctagagtaatctatagatggaattgattctgtagaaaggtgataaaccctgaccattgagtgttgaagctaagatgaggagactactggtagaaatattcaaaagtaactaaaacacataggtgctggggatggatggttagtcagattattgactctcatggcttgtaattagtttgtgatctgaatttaaattacttaggaaaggaatggcttttcagcagaaaaatatatgcatcaatagcacctaccagtcccaacaaatgattctatatatttttttaagttggtgaattttattatattttgccacaattaaaaataaaaaataatttgaagggaaatgattttaacaaataaaataaatggagtggaaggaaatatggagggttagtaatcaacaggcattaagtccagcaagatgaataagctctagagatctgctgaacgacatggtacttatagtcaacaataatttattgtacacttaaaaatttgttgagatctcacgttgtgttcttgccacaatacagtaaaataaaaataagttttacacattttttaaaaggttatacacctcataaaagtgatagagaaggagacagccaaatgctgcccaggccattgtgcacattgagcttatctaaacatgcccacagtgaaaaattctgtcccttaacacatgcgtagtatgtgtagacaagctccttgggttttcctactttactgtgcattacaactcatgtgtcaagttcaaagacattctgtccctgaacacatgcatagtaagggaaataaatcaatatggagtggctcagactaagggcccacctgtgcactgggacaatggggtggacccacctggaatccacgccttataaattggggagaagcctggccttttcagctcatgtgtggtggcctggtattcaatctgtgaggtggaagcctgttgaaaggtcccccttttttctctgagagctttcttttaattctgctctctccacctttcaatgtgtccacgtacctaatttttcctggttgtgacacaagaaccagattttagctgaactaaagagcaaaaaatcctgcatcaaaaggagagccaagactcaaaaagagaaacagtctttcgaatttttcattgattttaattcagtgacttctctgaacaataaagttgcaacttatttgaataaaaacactcaaaataaagggaacactaaaacttacaattgaatgtgtcatttgcctgattataggtctttgggaatctgcaaggtaacctttattcctgcaagatatagatcttagcttttctttttttaaattattattattatactttaagttctagggtccacgtgcacacaacgtgcaggtttgttacatatgtacacatgtgccatgttggtgtgctgcacccattaactcgtcgtttacattgggtatatctcctaatgctatccctccccactccctccaccccacgacaggccccggtgtgtgatgttccccttcctgtgtccaagtgttctcattgttcaattcccacctatgagtgagaacatgcagtgtttggttttctgtccttgcgatagtttcctgagaatgatggtttccagcttcatccatgtcctacaaaggacactaactcatccttttttatggctgcatagtattccatggggtatatgtgccacattttcttaatccactctatcactgatggacatttgggttggttccaagtctttgctattgtgaatagtgctgcaataaacatacatgtgcatgtgtccttatagcagcatgatttataatcctttgggtatatacccagtaatgggatggctgggtaaaatggtatttctaattctagatccttgaggaatcacaatgtcttccacaatggttgaactagtttacagtcccaccaacagtgtaagagtgttcctatttctccacaccctctccagcacctgttgtttcctgcctttttaatgatcaccatcctaactggtgtgagatcgtatctcattgtggttttgatttgcacttctctgatggccagtgatgatgagcattttttcatgtgcctgttggctgcataaatgtcttcttttgagaagtttctgttcatatccttcgccaactttttgatggggttgtttgattttctcttgtaaatttgtttgagttctttgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttagtgttttagacatgaagtccttgcccatgcctatgtcctgaatggtattgcctaggttttcttctagggtttttatggttttaggtctaacatgtaagtctttaatccatcttgaattaatttttttataaggtgtaaggaagggatctagtttcagccaagactcaaaaaaagaaatagtctttcgaatttttcattgattttaattcagcgactatttccctgagcaataaagttgcaacttatgtgaataaaaacactcaaaataaagggaacactaaaacttacaattgaatgcatcatttgcctgattatacatctttgagaatctgcaaggtaacctttattcctgcaaggtatagattttagctttggtgaatctgacaattatgtgtcttggagttgcttttctcgaggagtatctttgtggcattctctgtatttcccgaatttgaatgttggcctgccttgctaggttggggaagttctcctggataatatcctgaagagtgttttccaacttggttccattctcccagtcactttcaggtacaccaatcagacgtagatttggtcttttcacatagtcccatatttcttggaggctttgttcatttctttttactgttttttctctaaacttctcttcttgcttcatttcattcatttgatctttagtcactgatcgcctttcttccagttgatcgaatcagctactgaagcttgtgcatgtgtcatgtagttctcgtgccatggttttcacctccatcaggtcatttaaggtcttctctacactggttattcagttagccatttgtccaatctttttctcaaggtttttagcttctttgcaatgggttcgaacatcttcctttagctcggagaagtttgatcatctgaagccttcttctctcaactcgtcaaagtcattctccgtccagctttgttccattgctggtgaggagctgtgttcctcagttggaaattttagaccaatatccctgatgaacattgatgcaaaaatcctcaataaaatactggcaaaacaaatccagcagcacaacaaagagcttatccaccatgatcaagtgggcctcatccctgggatgcaaggctggttcaacatacacaaatcaataaatgtaatccagcatataaacagaaccaaagacaaaaaccacatgattatctcaatagatgcagaaaaggccttcgacaaaatccaacagcccttcatgctaaaaactctcaataaattaggtattgatggaacgtatctcaaaataataatagctatctatggcaaacccacagccaatatcatactgaatgggcaaaaactggaagcattccctttgaaaactggcacaagacagggatgccctctctcaccactgctattcaacatggtgttggaaattctggcttgggcaatcaggcaggagaaagaaataaagggtattcaattaggaaaagaggaagtcaaattgtccctgtttgcagatgacatgattgtatatttagaaaatcccattgtctcagcccaaaatctacttaagctgataaccaacttcagcaaagtctcaggatacaaaatcaatgtacaaaaatcacaagcattcttatacaccaataacagacaatcagagagccaaatcatgagtgaactcccattcacaattgcttcaaagagaataaaatacctaggaatccaacttacaagggacacgaaggacctcttctaggagaactacaaaccactgctcaacgaagtaaaagaggacacaagcaaacggaagaacattccatcctcatggataggaagaattaatatcatgaaaatggccatactgcccagggtaatttatagattcaatgccatccccatcaagctaccaatgactttcttcacagaattggaaaaaactactttaaagttcatatggaaccaaaaaagagcccacatcgcccagtcaatcctaagccaaaagaacaaagctggaggcatcacactataaagtactttattttattctctttgaagcaattgtgaatgggagttcactcatgatttggctctctgattgtctgttattggtgtataagaatgcttgtgatttttgtacattgatattgtgtcctgagactttgctgaatttgcttatcagcctaagtagattttgggctgagatgatggggttttctaaatatacaatcatgtcatcggcaaagagggacaatttgacttcctcttttcctaataaatattccaaataaataaaattccttttatttatttgtcctgccttattgcccaagccaggacttccaacactacgttgaataggagtggtgagagagggcatccctgtcttgtgccacttttcaaaggaaatgcttccagtttttgcccattcagtatgatattgactgtgggtttgtcataaatagctattattattttgagatacattccatcaatacctaatttattgagagtttttagcatgaagggctattgaattttgtcaaaggccttttctgcatctattgagataatcatgtggtttttgcctttggttctgtttatatgctggaatatgtttattgatttgtgtatgttgaaccagccttgcatcccaggggtgaagcccacttgatcatggtggataagctctttgatatgctgctggattcggtttgccagtaatttactgaggatttctgcatcgatgttcatcagggatattggtctaaaattctctttttttgttgtgtctctgccaagctttggtatcaggatgatgctggcctcataaagtgagttagggaggattccctctttttctattgactggaatagttttagaaggaatggtaccagctcatccttgtacctctggtagaattcagctgtgaatccatctggtgctgggctttttttggttggtaggctattgattattgcctcaatttcagagcctgttataggtccattcagggattcaacttcttcctggtttagtctttggagggtgtatgtgtccaggaatttatccatttcttctagattttctagtttatttgcgtagaggtgtctagtatttaggtattttatagtattctctgaaggtagtttgtatttctgtgggattggtggtgatgtcccctttatcattttttattgtgtctatttgattcttctctcttttcttctttattagtcttgctagtggtctgtcaattttgttgatcttttcaaaaaaccagctcctagattcattgatttttttgaagggtgttgtgtctctatctccttcaatgctgctctgatcttagttatttcttgtcttctgctagcttttgaatgtgtttgctcttgcttctctagttcttttaattgtgatgttagggtgtcaattttagatctttcctgctttctcttgtgagcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttacatgtagttgagctgttttgagtgagtttcttaatcctgagttctaatttgattgcactgtggtctgagagactgttataatttctgttcttttacatttgctgaggagtgctttacttccaactacgtggtcaattttggaataagtgtggtgtggtgctgagaagaatgtgcattctgttgatttggggtggagagttctgtagatgtctattgggtcttcttggtgcagagctgatttcaattcgtggatatccttgtcaactttctgtcttgttgacctgtctaatgttgacagtggggtgttaacgtctcccattattattgtttgggagtctaagtctctttgtaggtctctaaggacttgctttatgaatctgggtggtcctgtattgggtgcatatatatttaagatagttagctcttcttgttgaattgatccctttaccattatgcaatggccttctttgtctcttttgatctttgtcggtttaaagtctgttgtatcagagactaggattgcaacccctgcctttttttgttttccatttgcttggtagatcttcctccatccctttattttgaacctatgtgtgtctctgcatgtgagatgggtctcctgaatacagcacactgatgggtcttgactctttatccaatttgccagtctgtgtcttttaattggagcatttagcccatttacatttaaggttaatattgttatgtgtggatttgatcctgtcactatgatgttagctggttattttgctcattagttgatgtgatttcttcctagcatcgatggtctttacaatttggcatgtttttgcagtgtctggtactggttgttcctttccatgtttagtgcttccttcaggagctcttttcgggcaggcctggttctgacaaaatctctcagcacttgcttgtctgtaaaggattttatttctccttcacttatgaagcttagtttggctggatatgaaattctgggttgaaaattcctttctttaagaatgttgaatattggcccccactctcttctggcttgtattgtttctgctgagagatccgctgttagtctgatgggcttccctttgtgggtaacttgacctttctttgtcttgctgcccttaacattttttccttcatttcaaccttggtgaatctgacaattatgtgtcttagggttgctcttcttgaggagtatctttgcggtgttctctgtatttcctgaatttgattgttggtctgccttgctaggtgtgggaatttctcctggataatattctgcagagtgtttcccaacttggttccattctccccgtcactttcaggtacaccagtcagacatagatttggtctcttcacatagtcccatatttcttggagtccttgttcatttctttttactcttttttctctaaacttctcttcctgcttcatttcattcatttgatcttcaatcactgatcccctttcttccagttgattgaatcagctactgaagcttgcacattcgtcacttagtttctttgccatggtttttagctccatcaggtcatttaaggatttctctacactggttattctagtttgccattcatctaatcttttttcaaggtttttaagcttctttgcgatgggttcaaaattcctcctttagctcggagaaatttgatcatctgaagccttcttctctcaacttgtcaaagtcattctccgtccagctttgttccattgctggcgaggagctgtgttcctttggaggggggagaggcgctctgatttttagaattttcagcttttctgttctgttttgtccccatctctgtggttttatctacctttggtctttgatgatggtgacgtatagatggggttttggtgtggatgtcctttctgtttgttagttttctttctaacagtcaggaccctcagctgcaggtctgttggagtttgctggaggtccactccagaccctctttgcctgggtatcaccagcagaggctgcagaacagcgaatattgctgaacagcaaatgttgctgcctgatcattcctctggaagctttgtctcagaggggtacccagctgtgtgaggtgccagtctgctcctactcgggggtgcctcccagttaggctactcatgggtcagggacccacttgaggaggcagtctatctgttctcagatctcaaactccatgctggaacaaccactactcctcttcaaacagggacatttaattctgcagaggtttctgctgcctcctgtttggctatgccccgcccccagaggtggagtctacagatgcaggcaggcctccttgagctgcagtggtctccacccagtttgagcttcccagtcactttgtttacctactcaagcctaagcaatggtgggcgcccctcccccagcctcgctgccaccttgcagtttgatctcagactgctgtgctagtaattagcaaggctctgtgggggtgggaccctccaagccatgcgtgggatataatctcctggtgtgccgtttgctaagaccattggaaaagcacagtattagggtgggagtgacccgattttccaggtgccatctgtcacagcttcccttgggtaggaaaggaaattccctgaccccttgtgcttcccgggtgaggcgatgcctcgccctgctttggctcacgtttgctgggctgcacccactgctctgcacccactgtgctgcacccactgtctgacaagccccagtgagataaacccagtacctcagttggaaatgcagaaatcacctgtcttctgcatcactcatgctgggagctgtagactggagctgttcctatttggccaacttggaaccgcccctaccgtgataatttataactagaccagtcttctcagggatttgaggatgaatggaaagtctgagatgcaagaagaaatggtgatcaaatatataatcaaatataagtaaacactgacaatataaaataacaataattataatgcttaattggtggaaaaaatcaaaataagatagaaccaaaatactatgcagctaaaatatctaaattcagggagtggcattaattagatttaaacattctaatgtctttatagtgtttgagagaagggtaaaaatatttatgaaatttaaagcttgttaagtattcctgaaaaaaaaaaaaaacaaaagaatagactagatgttccatttcctgaacacctcttgaatttttctcaagtatcatgagaacttaagttgtattatccaagtccttgcagttaggtcataaagggaagcaaaagttctcacaatataaaatattcattaatgaactggctaataatgaaattagttctcatataagcatacttccccttttctctatatccatgattgtaaacatttgaatgcaaagtaaattaagtaataagtaaagctgcaaatcttgtaagagagtcaagatatcaaaaattcagtgaaagtaaaattagagaaatacttaaattgcacttaaagcttttgaaaaaggagtctctggcagagtcagttcagttaacagctgaagaagagtgaattagtcgagatgatagcatgactagatgactcaaaggagaatgattttgaaacataaagattaagagagcccttgagaaaactgatgaatctttaattgtctctctaactgtattaattatgggaaaagctaaggtgctgaaaaagtgacacccaaatacagtgatttaaagatgaaagaagtttatatctcatgtaaccatctagctctttgaggtcaatcatgggtccacattccctatatctctaatttctcatagggagagatgctcatttgcatagtcaaagctggatcatatggcatattcatgttttagtacaaaaaaagggaaaagagagaaagcccagggcaagcaatttccttttgaacaagtaagatagaaggtgtgtacatatcacatccccccacattccactggagagatataaatcatgtggccatacccaactgccagtaaatctgggaaatgtctctagctggatgacaaagggcctaagaataaggggagaatggattttgggggaaaactgataatctgtttcataaacatttatgcaaaaaattattgtgtgatcatagtctgaaaaaacatgaaggatgatgtacatataattaggtctgataaattatgcctacccaaataaatacctgattcattctttaacttaaaagagatcacatatcaatactcacattttataaattcagataaaatgaatttatttttaaaaatgaataaaacacagtgagagtttactaggttatgaggtgcttaatagcctgttttatattttctagtaggatgattagaaaaattcttatttctccttcatatctgtagttggtatgattctccatccacagtctctgtgttcaagaattttaaccaacctaatttttgtctttctatttctgtttttcaccatcatgtattttggtctgagatatagcaatttaatttcaattcatggttcctctttttactctggttgcacctaagttctggggctttacatagcatccaggaattattaagggaagctagtcctcagtattatctgtctaacctagcatttgctgagatagtcatctgtcatttgggcctaattcattcagagaatacttaaaacaccgacatatgccaggtactgaaaatagtgttggtcaagagaaacactttagtcccttttcttatgaaagatagtgtttagtaaattttggtgcattgcaaaaaattctggaccaagggcaaagccaagcatacacacgtgtagagaaaggggtcatttaaaaagtttgtcccaaaatgaggagaagaaagttaatgatcaaatgaaaatttgtggattatttatgattttccattttcaatgacttttccattccaccataacctatgaaaattgagaattggtgatgtttagaagtcaggaaagacttagagaagataaggatgagtgagaaagtgtgacttccctttctcctgggtaattcctcttttagtgttagggtgcctggagaaggtcttctgtaaacattcaaactaatccagtagtatttaaccaacctctttcttaccacataaccttcacttcctggttgctgtggataacaaggggagtatgagacacagttctgaaagttggttaaagtctctataccaagaaaaattatagccaggacaggcaggaaacagaactacactaataaaaaagcactgtggcagaaataaagcctattttggattgcagagaggaaggggagatgattaccagatgggagaatggtgtagtcaattaattgcaaaggtgtggcaaaaaacatggtggacagagggtctaggtggagggaggacaggcttgactggagctaaggtttgggtagaaagtgtgattctgtggccatgctctctcttcatctgctcatgctgtgtagcattgcaagcctactcccatgcccccagtttaattgcattactcttcactatagcttagggagtgggagcactggctgtgtagccagacagacctgagtttgtcttactcagtgtctaaccactgcttactagtgtctaacctcagggaagttacttaacctctctgaacctgattttccttactgcgttgcatgtttctgacagtttaatgagttaccacatgcagtgctcagcaagagttttcaaagccctcaataagagcagtaccataattacggcctaccaatgaggggttgagtgctgggaccaggatggtagcatgaggcataaaaaaataagtgttttcgtttcagacagtcatgagtgttcacattccagctgcatcacttcccttctaattcccactctgcagggattaaattagatcatgaatatacagtattccacacagggctggagtaccagtgagtgcttttagaaaatgtttgtttccttcctcatcacttacccacactcgtttatttctttattcctgagcgtacatctagtcttctagttttgtgtttgtgcatggaatagggcaatggacacttactaggatgtctggatagttctgatgtaacctgttggcacagctttgttatgatcttccctttctgaaaatgtcctatgtttggacaataaattaccctagtgctgcttagggccttttactctctagtctagtgggtctggtgtgatcctaggcttccttttctgaggaggaaatcacctgggggctttgggctagagcatgtccttgcagcgttactgctgagttgacaggcatcccctaggcaaccccccgggtgtatgtcttcttcatcatctgggggtccccaggattaactgtcccacgttctgctttcggccaccacccattctttcccctggggtttctctcctttgcctggagctcttgctggaacaagatacgaggcgtgatagagtttcccccacccccttctttcctactcgtttgaattgtacaaaacaatacactctttttctggttgtgtaggtttctaagatatgtctaggaaaaggaagacagggcaacaaagtaatacacaaggaaaagttccaactctttatgacattaaaagttatcctaaccttcgtaggcatttgaatagaactagagttggtctttcttggccctcttcactgattcgtctcttccagtgaacttctgaaatccacctttacctgattgtcttttccctctatttttattcttgggactttatgcaatggtttccctcactattttctttagcttattttttttgggggggcgggtggacttaggtactcaataaatattcttttctagagtggtggtaagcaatagaaatgaattgaaatggaacaaagttgtgactgagaattttaaggaaatgttcattgctaccagaaagaaaccctggtccagccagaatgaaactccagataataatataacaagtgtaaatgcttgttaaaagctgtatgccaggtactttacatgcattatctcatcctctcacagcaaccctgtgaattgaggtactagttacagtcattacactctttcccacatttattaataagaaaattaaggcttaaaaaagttagataatttgcccagttacttccataattcttccattatggctgaaaagcttgaggcaagctgggattcagattcagccagcctgtctccaaagctcttgctcttaaccattacattagactgtctccccagactgcaggaaccagagactccacccagaggtgtagccctgcttgaactggagaaagccttgtcaaggatgggcctttgtctggggtaagagtgggccctatattactgaaaagaggcattacaatttgatgattcatttctacatgtctcaccatggtcttgcttttaccccacttcctctgatagctttttgtaccagttttaacgatcatattttcatttcacctttaatagctattaaaaagacaccattatggtgactaatcagaaggatcaccctccttccaaccttagtgggcactcatttttcattgtagttcattcttgccaaagtatgtactgtgacagaggagagaccatatcacaaaggtattcatatgttaggatgtactttgcttgatggaagaggctgctgcacctatgagggcccagggaaggaaatttgtatgcatttaacctaaaacctctaaatcttgctaattttaaaccagtccttcctctgaggtcagtcttggggaaatgctcttgaatactcccaacctttggccttccagtatcaagatctcaattgcctgattgtatcgtgtgtggttatttttctttattgatgcaactaactttccctgattaaggttgggactttttccctttgtcatttcagaccgttttggtgaagttttcatatcttgtcttttgcctcaaatgtttcctttacttagtcaggctttattttaggtttcatttagtactccctacccacccacccatgggagagtacccattataggagaccaaggttttcattctgatctgtagtcaaaataataagaagtaagacaaggaccacacactggtgatctattggagggagaaaatatacctccttgatgagttcttttagttggagtaaatccaggattataatgctactgtagctttggagatgactgactataagaatagctaatatttattgaacacttattgtatgctatgccatgcacattgcctgctttgcctcacttaacccttacataaagccttgacaagaaaacttccaactttaagaggagaaaaatcaaggtttagagaaattaagtgacttgctcaagggtcatacaactagtaaatagtggccctaggattaggattcagcaaccttaacctctatgctactgtgtaaagaaaaatatcacataaaatgagttagccaagtgaccaaggccaagttgcataacctctctgtgctttagtttccttgtctataaaatgagtaaaagaaaatgactcttggataattattgtggtgcttatatgaggagctgtgcaaaactgagctcttcatttgcaaactgcctctccctatctgctcctctttggtcttccccttaatctcagtcaatggcaccaccacacagttactcagcccaatgatgtacaagttatcgttgatgccttaatttccattacttaccgtatctaatccagtaagtcttattgctctgcctccaaagtatatcccagatctgataattcgtcaccctcttttgccatggcctagaagtcaaggcactttacatcttatctgggccactttacatcttatctgagagtcctttaactcatctctctgctttaactcctattccattgtggtctgttttgccacgcaaaagccaactggcttttaaaaacatgaatctgaaatcactctcctaattgaaaccttccaatggctttccgtaaaattcatgatccaaaggctccattcagtctagcccctgcctacttgttaatgctatggcctattacttagttgtcctcacacctgctttactctgctgtagccactttcttttcttcaggcatgccaaagttgtttttgtcttaggctttcagacttaccaataccagccctactgcctagaatgttcttccttcccctagctctttccctgactgacccatgtgaaggctttgctccactatcatctccacagagaggcctttgatggcccaatcaaagtgatgccccttcttgtccctgtctatttcattactctgtgggttttgggtttgtttattttattttttttggtgagtgtgagtatgtgggtcacagcatttaaccactttttaattgtcttcgtcagttcaggcagctataacagaatccttcttgctgtatcctcacatggcagagggatcatctttcttgtgtcttttctagtaagggcactaagttcatcatggcacccccaccctcatgacctaattacataccaaagcctccaaataccatcacattggggattaaggcttccacatatgaatttttggagaacataaatattcagtccataacactaagattattcatttttctgtgcatacagttattgtctattttctccaacaggaatataaactctaagagagtaggcactgtatttgctctttaggaggaactgaataaatagtttttagtaatgaaaaaatgtgcaaatgagcaaagtaagcaaaattcaaagcttgtgtgcagtacctacctatgtttaaaacaggttaatttcctttatcttttaactgctccttgagtttttgctaagagaaatattctgagccctgagatccaattcagttttatctgggggctcagagtagcagaagaaattttgcttttttttaaaaaaaactttattttcatcaagagaacgatatttgaaggttgctgagtttctactgcaaagaaaccactttgaataaaatccctttgttttgggaaggtgaatagattttttttttagtctttacaatttttttttattttaataggtttttggggaacaggttttgtttggttacatggataagttctgtagtggcaatttctgagactttggtgcacccatcacccgagcagtgtacgctgtacccaatgtttagtcttttatccctcagcccctcccaccatttcccttgagtcctcaaagtccattgtatcattcttatgccattgcatcctcaaagcttagctcccacttatgagcaagaacatacaatgtttggttttccattcctgggttagttcacttataataatggcctctaatttcatccagattgctgcaaatgccattatttcattcatttttatggctgagtagtattgcatggtgtgtgtgtgtgtgtgtgtgtgtgtgtatcacaatttctttatccacttgttgattgatgggcatttgagctggttccatatttttgcagttgtgaattgtgctgctataaacatgtgtgtccaagtgtctttttcatataatgacttcttttcctgtggggagatacccagtagtgagattgttggatcaaatggtagttctacttttagttctttacggaatctctactagtttacattcccaccagcagtgtaaaagtgtccccttttcactacattcaagccaacaaaacagatgatctttaaaggtaaatagtcactaatttccagggaaaaccaggtgttgtgaaatggtctacaagcaagtatttcttactagtctcttgaggattatatttaagtcaataaaaacctcgagataaccacccttatgcagtgataaagaatttaaccaatggaaaagtgttcaaaaactcctgtgttagctagcaggcttctgaatgtactgctgtggtccacagagaaggctagagaaggtagcaaggagatgctgtatcagctactacagccttaaaacaaagtaggtgtctctttggactttaaaattgttcctatgaagcttattttatttttgtttaatcaaataaacaagacagtttttccatgaaaaaaaaagaatttgaatataatacaattggcaattggctctcatcctctgcccaaccctattcccaagggaaatgatgcagctaaagttcttttggtgggagtgggaaggtgtgaggaggttagaaagggactaatttgtggttacttgggactttctcagtttagtatgtaatctattacatatattttatgtttcttatggcttacataagttgttagtattaaccaatctcctatacaagtaataaaagaaaatgaatacacttttctgtcttttatttttctaagcagtaactaagagatcaatgaaaaaaaaatttatatatatttgctaagttggcaataaccaaatgccacattttacacattatagaggagcttcgatgtaatgtaagggttagaagtagggaattttttttttttaaattttaggggaattttgttcctcatatctggggcagggatggaagactgggtcatagtaactgaagagagagtgtgaaaggagagggggcttctgagtataaggagtcttgggaattttttcattgatgggcactgagttggctttcccactgccatctgaaagctgtgaggaagtgggcggtggcccttgaaatggtgtactgagctcttgggtgctgagactagtcatttctagtacccgtggaggggacctaacccacagcacataggaacaagcaaatagagaggtcagtctggaatatcaaagtgattagatcatgggagggacctgaagattcaggaagaacaacagttcagagagagaacagctgacagaggtgacaagcatcagcctggaccaatttgtggagcatatgagtgctccctggtattcctagaaatacctggggaaccacactgagaggtgtgacggcatcatcctaccatgtgtgttagggtctatctagcccagcactgtccaatacaaatatcacaaggtaattcaaaaatttcagctgggaatggtggttcacgcctataatcccaacactttggcaggctgaggcgggaggattgcttgaggtcaggagttcaagatcagcctgggcaacatagggagaccctgtccctacaaagaataaaaaaaattagctgtacatggtggcacgttcctgtgtcccagctactcaggaggctgaggtgggaggacgcttaagcccaggagttcaaggctgcagtgagtcgtgattatgccactccagcctgggcaacagagtgagaccttgtctcagaaaattttgttttgtagcagtcatatcaaaaaaattgaaagaaacagataaaattaattgtaatagtgttttatttaccataatagatccaaaatattatcatttagatatgtggcactagcctagtcatttgctggtaaagcagctctctgaaaaaatttataatgtttaccaatttccatggtataaatactctcatcatggtcaattttaagctacaatagtgataactaacaattattgaatgctaatatgtatcaggcacggtagaaggtgtgtgccttctacctatatttatttatctatcatttgtggatgactaaatgaaagataggagctaaataacttgctcaattagaaatagtaatgcttttacttgcatacagatctgacttttgcccagagtgtcaaaaataaaatcaaggtaggatcagagaacagtggggagctgaaggggcagaaggaaagaaggaactctgaataaaacttcaccccacaatccagtctattctgttcatgtgttgagcacagctatggattagtgctggaataagcaggggaatatgaagatgaatgggtcttggagtttctccacccaggggagacaagcacatacatgcataaccctgacacagggcagactatggtctgtgctaagagaagagtgtaattattcttccccaaactgagtccggagcagacgggaggtggtgtggtaagaaacagggttgaacactggggagagggatttttgggacctggagcttgggcaattcctataaggacatcctttgggacttctgggtcagtgatgaagcagaaagttgagatctcttccaaatataaccagggcgaatttgagccaacataggaagaataagggtaagaacagcagaaaacaccagggaacatggcagacagtaggaaggaaaggtctacagtaattccctgagccaatttgtagaaagctgaagaggtttttgtttgtttgtttgtttttcatgtgtgtgtttgtgtatgtgtgagatttgcagaaaggacataccccaaagacttctgagcacagcttaaggaggcagaaaggggtgaacaaactgtatacagtggtaatgagtgtggagatagggaatactacctccaaaaagagagagagagaaaatcatggctcattgctatacttctctccatccaccctcagtctctgatcataaggaaccattcatttggttctttatgtggcagggcactattttgaaattaataatttatttttttccctggctatttccttttatttcctggccccatttagttagcttgcctatgttcattacctttgggggaaggaatgtggtggcacaaagcagaaaaaaagattctcttgactttagagtttcaaaagctctgtcccaaaggggagcagaaaatgttcgatgagtaagtggaaagctttctggccccctgatggtgtaaagatccctgggctggagaaagaagggaattaaggggatgaattgggtgcatagatgagggtagatgcccatgtaaggggattcctaccctgctgatgcctagggtggggatggggctcagccaaaactcatgtatgttttaagatgtaagatgttgttatggaaggaagtttctagtgtcttgtcagggatctgcgcttagtcttctgagtctttatgaactcactctttctgttaataatttaactaagtgcttttcaaatttcatgtggatgcaaatctttttaaaatctggattttgatttgataggtctggggtggggcctgggattctgcttttctaacaagctcctgagtgacgtggatgcagccatttgtggacacagaccacagaccacacttatcgcaattattgtgcaccttctatttgtaagacagtgctaatgggtgtaaacattgtcccatgtaaaccctatagcaaccccaagaggtaaatcccattgaggatttgaggcaattttaaaactagagcttactggggttcagtgtctcatgctatgattgggataaagatgttgatgattgctgattgcacctgaagaaagctttaagagatgtttaatgcaacatatgtcagtgaaacaataaacactaaaaaggcttacaggttttttgtttgtttgttttgcaacaccataacatttgcataggcctactctgtctagacatgctgcttagtgtattacgtagactattttattctagctccaaaataggaaagacatttaagaatattcttataaggacatcgaaggtaacaggataaaattcttgttatcatagagaatgataggtaaaattcttgttaccacagaggataaaattcatgttatcacagaagaagttagagaaacttcaagaagcaatgctcttttggtacaattttataatttccagccatcttagtctgcttgggctgccataagacacccataatgtgggtgcttaaacaacaataatttattttctcacagttctggaggctggaactctggatcagtgtgccaacatggttgggttctggtgagggttcttttcttggcttgcagacggccaccttcttgctgtgtcctcacttggtggagagagagatggctcaaggtctctggtgtcttttcttctaaaggccctaaattccatcagaccagggccctgccctcatgactcgactactttccaaaggctccatctccaaatacaatcacattggaggtagggcttcaacatatgaatttggggtcgggggttgcaggaacacaaacattcaggccataacaccagcaattgagtggtctggtacagttaaacaagcaggcaaacccagatgatcttggtttaactcccaatgctgttgtgcttaggttaccctgagattctggttccttgtgttaaagatgtgttagtaataaccaggcagagtgttcgcaggaggattgaatgaaagaaagcttttgtgcctgacacagagaaagcacacaataaatggaagatgtactcccattcatcaataatctgaaaagaaaagatctaatttaagtttgttcaacccgtggcctgtggtccacatgtggcccaggacggctttcagtgcagcccaacacaaacttataaactttcttaaaacattatgagacatttttgcaattcttttttttagctcattagctatcattagtgttattgtattgtatggtagcccaagataattcttcttcttccagtgttgccagagaagccaaaagattgaacacccttgatcgaattgacaggaagaagttatttttttcttactggattagtagctgtgtgcatttggtgtattaatatctgcttagataaactttactgggcatctaggccagatgcagaacttatatttcatttaaaaagatcagtagtatcacacacagtttaagaacaggctccagagtaaacaaagctggattcggataccagctctgccatgtactaagtgtttcagacaggacaataaacatatgcaaaaactcagagagtgaatattgtattgcctcattcctaatcaattatgagcatggatgtatccacatcagggtttctccacctcagcactcttgacattttaggctgatagtcctttgttgttgatggcggtgaggtattgtctgagtggaatgtttattaacatctccagcctctatccactagatactagtggcaccctacccccaatccagataaacaaaaatgtctctaaatattttcaaatgacccctagggggcaaatctacccttagttgagaaacataggtttatgctaattctaatttatactcagttggatttattctgaaaagaagaggggattaatgtctcatatattcagtatagatttccttttggaatgatttctatttaaagaaaattatcttttgaagatgaattaagtttatcttgattgtgttggtggttttgtgagtgtatacaattgtgaaagctcatctaattgtacactttaaataatgcaatttattgtctaaaattatattttaataaagttgatttttttgaaaaagaaaattgcttatatcctattgtgagttgaaaaatgtacttatagatttttacatgttcttgtcgttgcacacatattttaaatacgcaatttaaaatgtaattttttgtgtgtcaaaagtctgtctagatatttgctttctataatggtgtggcacatcatgggtacagttccattcagagaaaaatttcagtagctgttttgtgccactaagttttagaatctgtcatcatgccctaaaataactgccagtggtcaagatttaaaaaaaaacaaaactaagcaacatgaagaatgaaagggaaaattggcatcagaacaaaaggggttgacaagtgagagactagtgagtctgaaacccaaatggaatatcatcacaggagttcacatttgtatttgaactaatggtgtgcatccggtttcaatgaaaagtgtacatttcaggtttgctaatctttcacctctaagatcaaagtccagctaccaggagacttctgtatttaatagtgctgttttcagtattgtttagactctcattatttctggtcctgtgaacagtgtgtttcagctctattgcaggcaaattcaatttggccctctgagagtacaatataggactcctaacctcaggaacttgcagcatcatgggggagactgaaatagatttatttatttatgtatatttttgaaattttatttttattttattttttatttaaaaaagttttaaattaattaaaaaattgtgaatacatagtaggtatatgtatttatggggtatgtaagatattttgatacaggcatgtaatgtgaaataagtccatcatggagaatgggatatccatcccctcaagcatttatcctttgagttacaagcaatccaattacattctttaacttatttaaaaatatacaattaagttattattgactatagtcaccctattgtgctaccaaatagtaggtcttttgattctttcttttttttttttttgtacccactaaccatccccacctcctccctcctccccgtgaaatagatttaaagaattacaagatgaaacagagcataataaatgctctcaacacagaggtgaaaacagctgcattcttctgggaaatccgggtgaggcttcctatcatagaaagtaatggtgaaagagaccttcagtggttgtttagggagattcacaagtctggctcttatggactattttagaaatatggcttcaaaaggcatcactccaaacctactgctatggtttcgatgtttgtcccctccaagccttatgttgaaatttgagctccagtgttggaagtggggcctaatgggaagtgtttgggtcatgaaagcaggtctctcatgaatagattaatgccctccttttggggtgagtgagttctcactgtatttgttcctgcaagagctggttgttaaagagagcctggcacctctctcttgtatcttgctttctctcttaccatgtgatatctccacactctagctctcttttaccttccactatgagtagaagcaccatgaggccctcacaagatgcaaatgttcaaccttgaatgttgcagccgtcagaattgtgagccaaataaacctttttttccttacaagttacccagccttgtgtattcctttacagcaacacaaaatagactaagacacccaaggaatcagaatttctagagtgaaggtattaggagtcagaatcattaaaaagttctcctagtgattcagatgataaactaggctttgggagccactgatcctatcaacaatctactcaatgctagaattctctgaacagaatttcttcaaggttttgtttagtacttctagaacacagcaagctcactacctcacaggacagcccttcatggggaatgtgtaacgtgtagggttttgatagtcagaggtggagggtaagggtgtttgaggcagagtgaatattagaaataatcagaaaatagagggagataagtttggaaggaaaacttggaactcctgcaggaggaaacctgtgccaggatgaagggcttggagagctgactgcaggagctcaagtgaggagtaataagagtttggattagaagcaataggaatggcaaagaggaggaaagaaaaaactgcattgcagggctagcctacaaagcttgatgactgggaacgaggatgattcaaagttgattcttggattttgaggtcctggagtacaaaaacattaaccaggacagtgacattaggatcaggaataggttgaaaaggcagattacaaatcagattttgacatttgaaaatgcatttgtttctgtcacctccgacatcactctatcacttgtcccagggcagagtttatctatgactccctgtgtatgctcagagattggcactgagtacactctcagaatgtctggtgaatgaagagccactgtaagtgtcttctccatttgtgtcctccctgctttagtttaggaccttatttctcacttgaatcattgcagactcaaggtccctagcttataccactgtctttgtgtgttttagaacaaggcaccccctgcgggtttataaattagaaaaagagcctgcatttaaatgagtacagccctttgttcagggcttaggaagcaaagttcacctttgtgggatgataaacatatcccttcctgcaggaggaaacttcctgtaccaggatggagggcttagagagctgactgcagaggtggaattttagatctcactcattccctcagctggcacagagcaccctggaaatgtctcccagttggccaacttgatcctgccttgccatatctgtctcttttcccccccctagaattatttcctgaagtacctgccatttctatttccctcagtcagagtgattttttttgtaattctaaaatgtaatcatatcatatcatatcacattctgcttcaaacctctccatgtttctccagtagctgcagcatgaagtccaaagtccttaacttgtaacaaaagtccatttacgacagattcttctgagcctcttctccagcagccactctccttcaccatcttcctcttcagctgtagttccctgaactgacactgcacaaacaggctccactgccctcactcctggcccaacaggcactgcccctccccagtgccccagatggccagactgcttctcgtttctcccagatcaaggaagctgttcctgtcctaattccagtgtagattagcacctgtccccctgcacccttcccttctgcactgatacctaggacccagaactttccaggttgtggagattccgctttcctgtctgtgacctccctgaggactaaaaatgtgttttgtttgtgtcttttcctctagtatttggctcagtcttgttgaatggacaaatgaaaatctgacttagagataaatgaaaaatgtagattttttttatcaccaaaaaaccccaaaaccaaaacccagacaccaaaaaatccaaacaacaacaaaaccctcaaaccaaagaaaaaaaaaaaacccaaatgttttttgcttctttctgaacatgaggtatcttgtgagtggtcaaagcccttttcttttccatattttctgtagtcttgaaatggctattcatttaggaggttaatagtctatgggaagataattactttggtttattttacatcctgtggctttattttaaggctgatttgctctggtgtgcttatgtatttaatatttgtgagatactttaagaaaaattgccaccaggcttggtggctgatgcctataaacccagtgctttgggaggccaaggcaggaggattgcttgaggctaggcatttgtgaccagcctggg

SEQ ID NO: 5064 - DNA, 261 bp, Homo sapiens
atggcgaccgccacggagcagtgggttctggtggagatggtacaggcgctttacaaggctcctgcttaccatcttattttggaagggattctgatactctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcagga

SEQ ID NO: 5065 - DNA, 980 bp, Homo sapiens
tcatgtcttggtttgttgatcttgctggaaagacagaagatcttttaaactgagttgatcaaggggctgcaacagctctcagtaggaaagacaccaccaccagcaacatcatatatagcaaaaatactgactatactgaacttcacagaagttcaaatacagatttgacatatcagacttgacctgtagctacttatacttcatcagcaactgataacatttgaaatcaaaaagccaccatcttagctggcactgcaaatgtgaaagtaagatctaggacaccagtggaggcctctcatcctattgaaaattcatctgttcctaggccttcatcccaatttgtgtgaacaagaaagtcagaacctgatgatgagctgccctttaatttccttaatagttcacagaaggagcctactgggagggtggaaatcaaaaaggaaaaaggaaagacacctgtctttcagagttcttggacgtcaagtgttagttctgtgaaccccagtataaccaccatcaaaaccactgaagaaaattcttttggaaaatgcatcatcaaatgctgcctgcactgagcacatcccaacacctaatgaagatggcaaatcacatgaactatctaaccttcgactccttggtctttcaactggagcacctcaaacagcagatggactctgcctctggaagtagtagtaacgggtcttcgattaatatgtctgaaattgtcaatggtgaaggcactcttctgtgaaatgttcctgttctttttaatggcacagaaactaatctggcaggaatgtacggaaaaattcacaaagctagttcaattgaccggtttagtattcgtctgggaatttttctccaaagataccccatagcatgagtttttgtgattatatatatggcttggcttcacctctgggtcatgattgttctgttgacttatacaccagaaatgcaccacgaccaaccatatggcaaat

SEQ ID NO: 5066 - DNA, 278 bp, Homo sapiens
gccgggcgcggtggcgcgtgcctgtagtcccagctacttgggaggctgaggctggaggatcgcttgagtccaggagttctgggctgtagtgcgctatgccgatcgggtgtccgcactaagtttggcatcaatatggtgacctcccgggagtggaggaccaccaggttgcctaaggaggggtgaaccggtccaggtcggaatgaaacatttacaaaaattgacatttccttatgcatagatatttcactaggtccttaaaacccacgtgaatctgtgat

SEQ ID NO: 5067 - DNA, 4780 bp, Homo sapiens
ccgccgctgtcggcgcttccatcttgggcgctccggttgcggggacggcccgggggctgtgggagggcgggtccgcccagcttgtttaccgaccgccggccgcccgtggctggacgcggtgccggtcccaccgccgctcttccgccagatttccccacaacttcttttcctgccggagacggatcggcgagtggggtttcgctcccactccgcaataggccgtaaacacttgggtccatcgccacaagttggttctggtgtctccaaacttgtatttcagtccctcggccgcttgctttccacctcctgcggtggcctccagttgccatttgtaggaaaataaaggtgggggacgacgaggcgggtggggaggaggagctggagctagtggaaagattcgtctacccctcctgctcgcagtaacgagtgttcagtgcaaggatctgttttttctctgctatggtttggtgcgggtcatttcacagacaaaagaactgtagtgaatgctggcattaagcgcaagggacaggcagtttaggttaagcctggaagtttgaaccggcccattatctttgagatacactggtgttttgaaactctcttgctgaggatattgtatttcagtcagttgattacccttttctgtaactccgtagactatcgatttaagcgccgccccatcttaccagtattttggtttcaccgtgtttatgatgatgttaataaatctaatgtgcaaaaataccgttttaggaacacaattggagataatttttttttgtatttgagacggagtttcccccttgttacccaggctggagtgcagtggcgctatctcggctcaccgcaacctccgcctcccaggttcaagcgattctcctgcttctgcctcccgagtagttgggactacaggcatgcgccaccacgcccggctaattttgtatttttagtagagatggggtttctccatgttggtcaggctggtctcgcacctctgacctcaggtgatctgcccgcctcggccttccaaagtcctggattataggcatgtgccaccgcgcttggcctgagagaaatctttaactctgggacctattatataatgagttatttctttacctgtgtgttttagttaacttcttttatcacttgtgcagcatccagcagtacccctgttttggtcaaacatggatgactcagtgtacaaaccataagccaggggaaaccataaggaattttgatcttggcttgtgccaaggctcttgggaaagtcatctgaactatgggagaaataaagctggatcttgtctccttgttattattttgaattaaatgagggaattctaaaaaaatttagaatcctattgacttttggctctaaagataggcagtctctttatactaaaatttcataacattgtttttattgggctgttgggggtttacgagatagtaggacagtaatgacattttgctcttttgaggaggatgttatctgagtgtcatgagggattttatttctgttgctgtttcgataccttttattaatgcctcagagcattgggacacccatttatttactcttgaaatgtgcttgggtgtgatgaactcattcatggtaatatattttaagctcatggccttgatccatgtctgtacactgataggggttatggatgtcacatttaaagtctgaggattaacatagttttggaactcatgatctagttgtacaatatatgaggcaaattgcttcatatgtgtaattgatacagtgagagcttgtccatgtgctttataataaatgtaaactttaaatgtgaattacaaaagtagtccactggccgggcccgtggctcatgcctataatcccagcactttgggaggttgaggcgggcggatcgcctgaggtcagtagttcgagaccagcctggccaacatggtgaaaccccgtctctactaaaaatacaagaaaatttgccgggtatggtggcgtgtgcctgtaatcccagctactcgggaggctgaggcaagagaatctcttgaacgccggaggcggaggttgctgcgagccgagatccagccactgcactccagcctgggcaacggagcaggactccatttcaaaacaaaacaaaagtagaccactattaatttggttcaggtttttttttttttcctcctcctcctccttttttttttttttttgagatgtagtctctctctgtcacccaggctgaattgcagtggcgcgatttccgctcactgcaacctccgccttccgtgttcacgccattctcctgcctcatcctcccgagtagctgggactacaggcacctgccaccacgcccggctaattttttgtatttttagtggagacggagtttcaccgtgttagccaggatggtctcgatctcctgaccttgtgatccacccgcctcggcctcccagactgctgggattacaggcgtgagccaccgcgcccggccccccccccccctttttttttttttgagaccttgtctcatcactgtgttgcccaggctggagtgccgtggcatgatctcggttcactacaacctccgcctcccgggttcaagcgattcttctgcctcagtctctcgagtagctgctgggattacaggcgcgtgccaccacgcctggctaatttttgtatttttagtagagacagggtttcaccatgttggctaggctggtctcgaactcctgacctcagatgatcatctgcctgcctcggcctcccagaggctgggattacaggcgtgagccaccgcactcggccggatttggttcagttttattatatgggcattgctgcttgcctcttcctttccaataataatctcttgtgtctgggctttgaatacttatcctctcattgatttggtattcgatttggaatatttgtgctccacttatgccttatgccttgcacatttgaacactcttacctcctcacatcacaacataaagacttagagaaaactcctttatacaggcaaaataaagttcaagcttcttggtgtggtgttcaagtttctctgtagtctggaactgatccattcttcagtcctaactctaatttatttgtgaatccctaactctagccacactaacttgcttgttgttcctatgaagtccctcctcttggccttgctttatgccattctttctgtttgaaatcctcttctgcttgtattcatggagacaatgttctgggccaagagaggtcctgtctctagagaagccttttttgactactttaacccaagggatctattcagtcttctcttgcgtgagactttcttttcttagaatatgctagccttgatttcagttatctttttatgtttctattttgcttcccaactagttttttaagacttctgccaaatgggtatatctctataccctgtatctatctatggagaccatatattcagcactgaaaatatgaatacatggtctgacaaagtatttttggttatagaggtattctaggatatgcagtttgtactgtagtaagtattggtgtttctgggactttatggtttatgagacaaatacttgaaactatggctgtctctttaaaaatttggttggtatgtttatatgtattatcagcatacttctttgccctgtagaggatgttcagcattttgatagtgtttgtgtcatattattaaaataaaaattaaatattatgtttctctggtttacttcagatttgtgtctggggcagttacttgggtcttggatgctaagtttggtcattccatattgtatggaggtaacatttagcatcatgggaaggagaaaataatctgtagcctcagtttgtattcttaacctcagatgttggcagcctgtgtcactgatgataaggcagatgagacaggagaatatgtgattcactactgctacctgtcaaccgtcttgaatgaaaaataagctggtccacagaatttttgtataccaaggataacacatgtaattatgtagtacataggtgaatgctgatgcatttggaaaataggtgtgtgtgtttctcttgtattggatgagtaggaggtatggtattttatgggtacacagtctcttggcactaaaccatcttgacttacctactacatctatgtggaaacctgtcctctttctccagttcaataaaatatttttccccttgaaattcatttttagaaagtatataaaaagtattttttttcaagtgtcagaaaccttttagcatcattgaagttaaaatgactgtccataaacttttcagaaatagtaggcattttaggctactagatttgtaaaaggtattttcatagaattataccagtgatttcaccacctgaaaaatctggatccgtaagcattctttgctttttggaagggtggtattttggttaattccatgaagtttttgacaggagccataagtttgaattttaaaatgggggttggccaggtaaattgaatataaaattaatattttttctgctgcctagtgaattaaattaaaaaaaattttttttgacacagggtcttgctgtgtctcccaggccagagtgcagtgctgatcatgactcaacaaactgtcctcccactttagcctcccaagtagctggaactataggtgtgtaccattgtgcctggctttttaaaaaaattttttgtagagacaagatctctctatattgcccccaggctggtcttgaattcctgggctcaaccaatcctcttgccttggcct

SEQ ID NO: 5068 - DNA, 5427 bp, Homo sapiens
ctgaatattcctttactgtagcacaatctggcatgactgcctttaaatgaaatctgtatttcacatcaatttgaaatcagcacatcatacaatttttaaaaggaaatttagctatttacccctctacagaatcactgatttgacaataaatatttttgagaaaatataagaaaataaactttctaaataagcaatttacattgatattctatatttaaattatgttttataaaagcatgcgctttggagtcagatctggatttgaatcctgattctaccactcaatatgtaatatatataaagagcttagcagcgttcaaggcacacagtaaatcctcaaatgttagctgttattatttctaatcaaagcagtggtggctgctatttataaacactactatgcatgctttatgtacattattgcatttgttcctcctaattattcaattaatattatccctgttgaatacacaaaaacactgaggttcagaaaaagttgagaaacaggcccaaggtctgagtgtgtcagaagccaaagcgccaatgctactgaccactaaattgttgcttcttaaactggggtccatgttgatgaaacattttaaaataatattcatgctctgaattatttggataattgtattaaaaccaaatattggcagaaccatctcagtgcttaggtttgtatttgtattgacttccctgttaaggcccagttctacattagtggtggaaggcttatggagaacagaggctgttttaataggggaatgatggattcaggctagatgaggaccaaataacatcactatgtgctgaacaaattaaagtaatagtctgaataggagaaaacagggtgaattgggtcatcacatagtacatggcagtacatgcctgttgaactgaaaagagcctgtactgtagcactcagtaccataatcacattacaagtgacaatttcattttgtcaaaacatcactatttaatactattttaaattttattagttttatagttttgcttgtgttaacccataaacttgttttggttttatacttgtgcaagacatataaacataaagcatttatacctagttttatgtttatatatatttagataacattataataaatataaattaagcaaaaactgaggagctaagagatttttttccttattaaaaagtgaagtacattattcagtttgagaaaactggtctacacggtcggtcctgcttgtgaatgtcgtcttcaggaggtaacttctattatcaccaacctcacaggatttgtaagagcattagaagagacgatgaacgttagagtgcctggaccacaggaagaattacaatgacagttctgtctcctttccttgaaagagaaaatctggaagctaaatgcagtctatactcttttactctaactatggtctggggaccaggagaattgataacacctaagagcttgttagaaactgataatcccagaggccaccccagaactattgaatctgaatctccatttaataatatcctcagctgatttgatacatgcacatgaaagtttgggaaacactagtccaggtctccacagagaatgttgactaaaattcactgagtttttaactactcttaaggttaactttggtaattagagaaagacctcatgtaaatggtcaaaaaataatgtcccatcctggggttcaatataaacactattatttcactattgattcttcataggctatatttgtatagagtgagaccctctttaaaagggatctaacttctaattcagaatgagcaaaaaatattttaaaatacaaagttttcataaaagctttctgaattttcagtaagcaaattgtaagatctgtcaatttaagcatttttaggtttccttcgcccaataccaattaaaatcatttatatatgttaagctcttaaatatttagctcacaagatctggtctaacaaagtcctgtctcagtctgtgatgactgtgtgcttacgttaacgaaacacattacaaaaaaaaaaggtatgactgtgtatataaaatgtattagctttactgtccaacaaaagtatcagatcacattctgcagttgtgattttgttagtgtaattcacctacagaatacctatgcttttcttcctgaactcagtggtcctatacatttaaggcatactgtacttgaaaagattcaaagatgctgttcttaaaagtgtaaaaaataactaatatacaagagagtcactaatatctaaaatgatcttgataccatctgtttaaggactagttcagtaagactcaaagattgaactaggttatttattgctctatgttctctacatatggaccacagaagtccgactcaaagaatgtaaaacaaggcagattatgcatatatgtgtgtgtgcatgcatgtatatgtatatatggttaggcctaccaggcaatccttatcatctctgggtttatgatatgacctagattataggtatgttatgaactgaatgcttatgttctcctcctcgtctgcaaattcatatgttgaagccctaacatacaaagtgatggcatttggaggtggggcctctgggtggtaatcatgtcatgagggtggagccctcatgaatgagattagtgcccttataagaagagacaggaaagtaacgatgtctctctctctctgccaagtgagaatacagcaagaagccagaagagggccctcatcaggaattgcgctggatggcactttgatcttggggtttctcagcctccaactgtgagaaataaatgtgttttgttacgccacccagtttacggtattcacccaaaatgactaaggtaaggtaaagccctcctttcattcttcatggtctttttgcaaaacaagagttaattatatgccaagaagcattagtgccagcacagttaaaacactctagcgcacgttaattatgatgattacaacttaagaaaactataatcagaaacctggccaggcacagtggcttatgcctgtaatctggcactttgagaagccaaggtgggcagatcacctgaggtcaggaattcgagagcagcctggccaacatggtgaaaccccgtctctactaaaaatacaaaaattagccgggcatggtggtgcatgtctataatctcacttactggggaggctgagacaggagaatctcttgaacccaggagacagagattacagtgagccgagatcgtgccattgcactccagcctgggtgaccaaaaaaaaaaaaaaagtacagtaaggccctttaaaaaaaaaaaagaaaaagaaaaagaaacctaactaactccagttttcaaggtgtttttatattatcctgcagttcttttggtccttaatacaatcaatccactgccactagaaccatgtaactctcctctatatagtacttcaaattctaatcatttctgtgcatatattaagcaatttaaactctatatacatacatactgtcaatgtatcggggaaatacaaagagtgatctttagtttatgctgaatacttaattttatcacttctccattaactgttataaagacaagactaaacctacagtttgaattcattaaacaatatccaagcaaacagaaaagaagaggaaataggcaagccatgtttttctactagagtgactatacttatccctctttaaaaagaagtgatattttcaatttcagaaatttgattaaaaaactacatctatttttcctaccaaaaatactcaaaaaaccctctgctaattactctcaaaatactgcagatgtattcctttgaaaaaggaaatacaggatgggcacggtggctcatactggtaagcccaacactttgggaggccgaggcaggaagatcacttgaggtcaggagtttgagaccagtctggccaacatggtgaaaccctgtctctactgaaaaaaaaaaaaaaaaaaaaaaaaattagccaggcatggtggcaggcacctgtagtcccagctactagggaggctgaggcaggagaaccacttaaacctgggaggccgaggctgcagtgagccgagatcacaccattgcactccagcttgggtgacagagtaagactgtctccaaaaaaaaaagaaaaagaaaaaggaaatataaagcatccgccaatgaaacataatatacattaaaggagaaaacgtctttaaaatatgtaccatttgccctcacgagtctaataaaggctgaaccttttttaagaggtaattttcactatcaagaaacttggatatagatgaattaagaacccaaatacacgtggaagcaagaagtgtacttgttttaaaaatcatattatgccttgcatgattaataaattaatattttataacttgtgtcttcaacaattcaattagcatttggcatgaccaaagtttaattaaattaaagacttggtggtgctttgaattaacatcagatgctggtggtcatctccatccagtatcccctttatcctctaatatgtccttgaaaatggcatgtattattcaggctaaaccttttcacaaaggcagattggtataccaaatgttgcttaatcatttcaatatcaaggtcattatatttctcctctaggatttggtactttgaagcaacttcattctataacactttagacatctataaaagcatgaacttggtcccacatcaaatttagtttcagtgagaagagtggtccttatctttctttagtcatcattgaattataaaacacagttgatatgtatatagttctgtatcacctttataccctaggacatcaattgtactaaaatctcagcatatgtagaatcctgcttgtgttactaaacattaatatactggtatgaatatagcaaaggaacatcctttcaaaatcattgcctgtaagaaattgtatatataaatttgcttcctttcaaattggcaaagtagcttacggcctctattatctctacagaaaatggtttgggccaggttcttgaggtagccaagttcccctttaacaaagaaaagttggcagactttcatagctgctccttgtgaagaagatacctcaaatatgatctcacgattgactgtagaagatgaagttaaagttgcagacttttaaggtacagtgcccaaggggttaaaaaaaaagtactgtttgagagaaagcttaacatccgacatctgactggctgcctggatgtgatgacctaggggacataagagaaaatcttaacatagatgtatatataaggatcaagtaattttgaggtctgacacaaagaaaatgtgttcaatacatgcaaaagataagaacctttatctaaaaaatgtaaagtctcttcttgtttatatgggaaaatacaggatgaatttaatgcactatagggg

SEQ ID NO: 5069 - DNA, 4527 bp, Homo sapiens
agagttccgactgaaatttgagaagctctttgctattcaagtggatatgtgcagttgacagtttgagagatgcatctagggttcagtaaagacaacacaagcctgtctttagggtctacctgtgaactgtgaacacagcaatgagaatgatggacatcacctttaagtatttttctagactttattactcatgtgtttgtcatgaggtgtaacttagtagttcatagtcctataatgtatgttattgactaggtagcatttatttttctaattgtttctgttatagtgctgccacatgtgtttcccagaaacgcattttacccacagttcttagggttggcctgattagtttaattgctgtctgaacctgcttcttactgtgattagttcaggaatctagatcaaactcattggcatttaacatttcaggaagtgaactgagtaacaactaactcagcaggggagtgtagtatgctattatcttttgggaaagcagcttatttgctttcaagaggcagcaggaggatggactgtctttaggtatgaaggcaagaatgattatagacaatatgcagaggaggacacagtgtgggagaatcagggaactgagccactcatggagttcagccaaccttggatccctgctgcacctttggacttccagttaagccaatttgtctgacatatttacttataccagtttgaatcttgaaatatttcaggaataataatttcctagataaaaggaaagacctttcatgaaaggtctcaagtcaaatagggtcaattaggacagagttgctccaattacatatttggaacagatgtccaaatgttaatacttgactaaggctaaagactaatattaccatcacaggaaaaatgtccagggttttttttcagatgtgaaattttatttaaaaattttaaataaactaaatcaaaaaattttagtagttgtactaatttcctggggctgtcaaagtaccacaaactgtatggcgtaaaacaacacaaagttattctttcatggttttagaggctagaagtttgaaatcaacgtgttggtagggccatgctctctccaaacccactaggggaagactcctgtctttcagtgtctggtagccccacttgttctttggtttctggcagcataactgtaatctctacctcagttttttcatgtatgtctccatgtttttttactttctttcttgagatggagtttcactcttgttgcccaggctggagtgcagtggcatgatcttggcttactgcaacctctgtgccccgggttcaagcaattttcctgcctcagcctcccgagtagctgggattacaggcatgcgtcagcacgcccggctgattttgtatttttggtagagatggagtttcatcatgttagtcaggctggcctcgaactgacctcaggtgatccacctgccttggcctcccaaagtgctgggattacagatgtgagccactgcacccggctgtctccatgtcttcttataagggtatcagtcatactggattagggcccaccctaaagacctcattttaacttgattacctctgtaaagaccctgtttccaaagaaggcaaaattctaagcaactaggggttagacttcaacatatctttcggggggacacaactcaacccataacagtagtcaatggctgtggcaggctaaatgtggctcccaaatatgtccatatcctaatccctacagcctgtgaatattaccttatatagccaagaggattttgcagatgtgattctgagattgagagattatgccagattatccaggtaggccccaaatgtaatcaccacagtccttataggagaggcaagaaagtcaagtgtagaaggaggcgatagaaggagagagggatttgaagattaataggctgcttgctttgaagacagagggaagggaccataaaccagaaataaacctctagaagctggaaaaggcatggaaatagaccctcccttaaggtctctggagggagtgcagccttgatttctaccgagtaaaattgattttgtacttcagacctccaaaactgtaagagaatgactgttgttttaaaaccattgagtttgtagtaatttgttgcagcagccacaagaaactaatacaacatctatatagaattttttcaataattggagaaatttgaatatggattgcatattaatattactgaatcagcattaaatttgttaggtgtaataatgtgattgtagctatttaggagaatatcctatttttaagagacatgccaccatatttagggagaagtgccaacatatttgcagtttattttcaaatggttcagaggctgtctgtgtacatgagaagacaaagataaggcaaatgcagcaaaattgtaataattggtgaatccaggtgaagggactatggctggtctttgtacttttttttccaacttttctgtaggtttaaaattttcaaaataaaaaaatgggaaatactttaaaaattgtaatcaaagacattagtacagaaactttcataatgtattttatttttacagtaaaattaatttatgtaaattgatagaattttactaatttcactcccaagttacattaaaaggcttacatatgtttgataatagcatatgtaaactagaactctgaatgatatccattggtcataatacgtactatgtagcggtaatggtgacttttgtgattgcacaagtctagagatgccccaaatgacattgacttagacatctggttattctaaggctgaaactgaagttgaatagaaggttttagtcaaatactgagatgaaaactgaggcagtcctggcgggggggagtgagtgtgtgtgtatatatacacacatagacatcatgcttctaaacatttacagaaagaaagggtagattatctacaaaaaaataagaatcagactgatatgagatcttacaaacctaacccccttctctttcctaaactccagattctcatatttctgacttcctatttgatatttacacttcgatatttaccaggagtcttcaacattttgttcaaaacagtactcttggttttcttcctccaagactactccttactcatatcagcaaatagcagctcttttcaagtgctcagtgtaaaaacctacaattaatccttgatttctctttcagtcagcctatactaaatcaatttcatttaaaatatctcggctactactctgcatctccactgctaccatcggcctctccagtcacattctccaagagcactctatctcatttaaaagacaaaatctctgcagtggcctgtgatgctccttaatggcctacataatccagccctcaagcacctccgtgatctctgtaaaactttcccttggtcactgtgcttcagccacattaaccagcttgcatatttctcacattcaccaagcttgttcctgccttggggcctttgtacttaccatgttctgttctgagaatactctgcctcaagatatcctacaactatcttactgtattcagctctctgctcaagtattaactgatgaaacctgtcatccctactccactccatgttctgctttacttaacagcaattgcacatatggccccctgaataatatacatttagtcacttatttttacttatctgctaattaaaatgtagactttttctattctgtttactgctgtattcccagcatgttttatccgaatgtgcagtggtttcttttcttctcccttatcgtgggaagtgatgtgcacaaatacacataatggagcctgaatgtcatattgctttcatacctgtgtgaattttggtaagaaaggaaaagtagcgattgacaggtaatataattacattaagtcactctcatagttagctgtttattgctttcctgctcttattctcagtccccaggaccaaatgttgaccactaccttcccccacatataattaggttatttaccgaacgccatgcaggtggctgttaaaaggaagatatatacttaccttataaactcaacttttccctgttgtctttctgtctcacccctacctccatgctttaaattaacttttcaggcttaggccttatctctcagtagagccatataaggtatgtgtaaaagcaggaaaatgtttcctggggatgaagctttgaaaagcttttttttttttttcttttggcaataaaataaggtagattcagcacaatacctaataactaaaaaatctgtttttaattgggtggggcagacagcaagtgtgtcatcctggaagatactatttgggattttatgtaggtacataagagaaaaaagtgaacaaaagcaaggggctaccaggacgccgcagtatgcttaacatgtattttctaagtttgtattatgcctttatcttggtacttttatcttctgttctcacttgatctttttgaaatgtattttaaatcctaataaaaatatataaagtctggaattaataaagga

SEQ ID NO: 5070 - DNA, 3980 bp, Homo sapiens
gggatcatacaattgtattgtcttcaaaacacacacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacattta

SEQ ID NO: 5071 - DNA, 7028 bp, Homo sapiens
ttgtgatataactggaggtgcctaactacaaaacactggctgcagctggaataaatctcagcggttcttacaaagcatggactatctggaagaatagcaagttatttctgtctttttctgcatgttttctttacttctttccaagaaacctgtatttacaggatctttcctcttggtaggtacctgtttgatatatcagttacatcaattagttacttcccctggttccacagttctctccagactgttctctccacaataatggcataataatagtttatgcctgtggttcattgaacacgtgctcgtgccctatactgtgctgttttgtttttgtttttttccatgacatgccatgattctcaactgtgttgttttaaatacactgttctttcttcacaacagtcctgcctcaggaccttggtatatctatctatgccctctacctgaaagtttttgccaggcatcctcccatgcatccctcaagattctaagaaatcactctgattctccagactatttgtaaccctccatcacacacaacactttttttttttctttataggactggtcatataaaaaaatcattacacagtttttaatgtctgaattccctggtagatttaaagttactgctttgacaacttggactgtttcttagaatgctacatccttcacacttagaatggtgcttggtgcatatgaggtgctcaataaacagttgttgaacaaacactatatgaggtaagtactacagtatctccattttagaaaggaggaagctgaagagcgaagaagttaacttgctcagtattacttcactagaaagtaggggagttgatattaaaaaaaaatctaccacatattccggagacctttagttttacatagagctcttctcccacaaactacttagatggctgattaagagtactggtaaaaagttataaaggaagtggtgtgacaaaaaaatatctaggacctctgggatgaggaggaaaaccttggggactgaagggcttgaaggaactttaaggtcagttaacaaatggtatgtcaaaggtattatacaaagaagaatgaaaatacttataaagtggactacagtcttgaaggagaattgggggatcacttttgaagctgccactaaatgcagtgttacttcttgcaggaaatggttaatgccactcatcaagaaccatacttctggaagtctaatgtagagaggattaaagcataatgggccttgtagtcagacttccggatcagacttccagctctgctacttactagctatgagatctctgggaagtttcttaacctcactgtgcttcagttttctcatccacagaaatcagaaataagtacttttatcaaagttattgagaggattaaaatgatatagttaaaatgcaaagatcagtagctgactcaaagtaattatataaacgtttgctattttattattttataaatgacagatgaaagcttgataatcaagtttttttttttggatggagtctcactctgttgccaggctagagtgcagtggcatgatcttggctcactgcaaactctgacgcccggattcaagcgattcttctgcctcagcctcccgagtagctgggattacaggcgcgtgccaccaagcctggctaatttttgtatttttagtagagatggggtttcaccatgttggccaggctggtctcgaactcctgacctcaggtgatccacccgccttgggctcccaaagtgctgggattgcaggtgtgggccactgtgcctggccttcataatcaatttttaaaagcaggacatgaaaaggagtgaaagttaagaaaccttagctgtagtgtttggaattaacacttgggaagtcatgattgacaaatagagaaatataaatatgtatatataactgatataaaacaaattagattttgacattagaaacacatatacacatactgtaatatgtactttcttcattctctttaacctatattctggttttaagtttcctggagcccgtggagtaatgggacaggaaggctcagagggtctctttactgatagttaagatacaaaaaaaactaggccaggcgcagtggctcacgcctgtgatcccagcactttgggaggccaaggcgggcggattatgaggtcgggagtttgagagcagcctggccaacatggtgaaaccccatctctactaaaaatagaaaaattagccgggcatggtggcaggcacctgtaatcccagctactaggtaggctgaggcaggagaatcacttgaacccaggaggcggaggttgcagtgagccgagatcgcaccactgcactccagactgggtgacagagcaagactctgtcttggaaggcgggggaagatacaaaaaaaaaaaaaaaaaatcgggggaatcttcaaatttgttaagtggtagacacttccatattttattaatacagaactcttgttatatgtgggattacatggcttttttcacttctatattagagatgagatggggaaagtatgtcttgaacagttacttcagcataaatactttcgtaccttcattttttccgtttggaaggtaagagggttggatatttacagaattgctcattgaggaccagtctttgatatttacttgctctaatgttagttggccaatcagaattatttgcatttaactaaaaccatcagcataaagcaagcttacataacctacatttatttcatagcttagtgattacattacacagtcagtcagaatcctgattctgctatttactagctaagtggccacaaataagttatttaaatcctctaagcctgcttctgtagttgtaaaatgagagttatagcagcacctaccacctaagattttgaggtttgaatgagaaaatgcatgtaaagctttgggcattgtgcatgatgtaaacactcaaatgttactgaagtcaataaatgttaactattttttagcacacttcagtgggcttatatcaccagtcaaaatgatacacagtattttatttaatggctttatgtaaattatattttactagctattaataaattaactcttggaacttttgccatggttaatttgaaaaattgaaaataaatggaaaatcataaaagttcatctattttggattacacataataaccactatagtgttcaaagttaagatactaatcatggctgggcacggtggttcatgcctgtaatcccagcactttgggaggccgaggtgggcgtatcacttgagatcaggagttcaagaccagcctggctaacatggtgaaactgcatctctactaaaaatacaaaaattagctgggcatggtggcgggcacctgtaatccaagctagttaggaggctgaggcagaagaattgcttaaacccacgagacggaagttgcagtgagctgagatcacactactgcactccaacttgggcaacagagtgagactctgtctcaaaaaaaaaaaagatattaatcacatactaatgttctcttttaaatatttccacattaacagaagaactgagcttagatagacatagtcctacctctaaatcttcatcttcatcaatgttttgtatattctggtaggcagcagtgtagacctctaaagctttgccgtgaaataacatttcgattgtgataaattcagaaaatatagtctaaaaaaaaccaaagaattgaatttaaacaatgatttaaatttctttatgaatatagtaactttattcctcactatagtcttggtattttataaaatacagaagtatctgtttttctatagggtaaataaagtacaaaagataactgaaaaacagttgtgaagaccttttgctgccaaaccttcaaataatacaaagtatttcctttatcaccatccacttccctcttattttttattttagttagttctctttatacctagtaattgacatttataataacataagatctgactaaaatgtatgctactatataattttaataccatatgcttattaagtattagagcagttcagttatgaagctggtgttttagcaattccaactgatgtttaaacaggagaacgttttttaaacaggaattatgttccacactgtatgctacttgtattctctaaacataaaggagttacttggtagtaatgacactcctgccactgatgataacaccatatatttgcatagagcgttctagtttacaaatattgacttgcccagtgttgctcacaggtcagactctttagacacagatctgattctaaggctacaaggttatagctcatttaaggtttttttgctattgcccactgaactgtgctgttcttgccggaatcaatcatttccttcacagataaaccgtgcaggtaacctctataagcatgatggaaacctatgacaaggaagatcatgaacaaagagtatgagtgaagatgtgcatgttgatctaagcagggggtgaggtaatcagtaggtgtggaaaagatggaaaccaggcaagtttttaataaatatgatcttatcattttgttaattataacaaaataagcaatgtagagagaactgggctgaataagaacaaggcagaaaatactcaagcatggattatattagtaggcagtagtcaaatacacattttccttcatccctgctctcctaagataacccagaaaggagtggtcatatactttggaggatagccatatagatacttatcagtggcctgtgattctttcctccagccccattcttcctagatgattggaaaaacacttaagggagcattaagaggctctgattgctactcagtgatatacgtcagtctgagaggacagggcctaggtaaaaaagacttgtaacgatgattcacaatgacccttactgtcacttcatgtaagttatagagggctcaggtataccaggctggcaactgatggataaacggcattatgctaaaatacaattttggatttcatattaaagtatctctagatacccaggaataccttagaggaggaatggcttctgaccagggctgggacctactcttagttgttagtgtccttatgatagttgcaaaccagaaaggagtcaggttttcttgagtgtggaaactcctagagggaaaactgaacgaagagtcgatgacaagccaatacacccatttttaatgctcaagaagtaaactagccaggcacaatggcatgtgcctataatcccagctacttggcaggctgagggaggaggttcccttgggtccaggtgtcccagaccagcttgggcaacatttggagacttctgtctcaacaagaacaacaaagtcaactagctaaattggatgtaatgactaacagtaaagcatccatcttgtttgattaacaaaagagatctttaacgaaaaggttttaagaacattttcgcaaagaggaaatgacagctctccagcgtataggatattcaataaaggatgtaagagaactgtttatccatttgaaaattaaagttatatatccatgtcgtaccacatgcaaaacacagctgccagctaaatatttaatgtttaaagtattttaaaaatcaagaaaatataagcaagtatttatataacctaggggatgaaaacctttctaagcatgacaccaaggaagaaaccaaagataagaagatggatttggcaataaaaagaaaacttagaggtggcaaaaacactaagcagtaaaatgagaaaatacatttgcaacatactttctctttaatttgaagggctaattttctcaatataaagaatttttagaaattagtaagaaattccaacatccaacagaaatataggttaaggaaaaatataatttactaaaggaatgtatcgctaaatacatttaaaaagctcagcagtaataacacaaatgatactgattttttacctattattaaaaatactgcaacttatggtgtcaacattgtcatattaaaaaaaaaaaacaacaaacacaggccgggtgcagtggctcatgcctgtaatcctggcactttgggaggccgaggcaggtggatcacctgaggtcaggagttctagactaccctggccaacatggtgaaaccctgtttctactaaaaatacaaaaattagctgggcatggtggtgcacgcctgtaatgccagctacttgggtggctgaggcaggagaatcacttgaatccgggaggcagaggttgcagtaacccaagatcatgccaccatactacagactgtgtgacagagcgagactctgtctcaaaacaacaacaaaaaaacaaactcaccattgtacctgtgcttatgcaaggtttagtaggaacgtaaattggtttaacctttgtggacagaagttttaaaaatatatattaaaattaaaagtatgctctgaaggaggaactccacttctggtaatttatctcaagagaataactgggccagcacaaaggctgctgtttaacaatgtgtaatgatgcagtgacagctacaattgcaaaaataacctagacattcaccaatgaggactggttaaatgaactagtataaccatactgcagaatatcataaagataacaaaaaaatgatatggatctgtttcttggcataaatatatccataagttttaagaagagatgctatatatacggtggtcccattgatgtataactgttaggactaaaaatagtaccttcctcataatgatgttttgaggaattaatgagtttattcatgcaaaatgcttagaatggtacctggcacacagacaatgtttaagaaatgtttgttattgttattactatgtctctgtatatatgcataggaaaaatctggaaggataaaataaaaaatgaatatttttgggtggtgagactaaatttttgtctaattttatggataagttttatgatttatatttataataaaaataaagctataaaaattaattatgatgtttcttgctcatgtcag

SEQ ID NO: 5072 - DNA, 3972 bp, Homo sapiens
gggatcatacaattgtattgtcttcaaaacacacacacatacacacacacacacacacacacacacaccccttccaagaaagctgatccttcagaaaataaatcttatttttaagcacttgggttttcaggccagaaaattaataaatcctaaacctgacccatttttgtaacagctaaaaaggagaagaaaaagctagttaaattttgtgtggatccatttatctcttaaaatatgccaaagcaatttgaggtgggggtggaaacaggtatttatctctcatgcgtgattctctctttatatttctatctgttgggaaaagggtaaagaactattcttggtcattattgatgtattgtgttgccactttgtatggtgcctgctgtgctttatcccgaggcatagcagtaatcgttactatcttgactctttccttcatcacaagagagtaaatatgaagtctgaatgtcgttcctcacccccaaattgtttaactctgcttccaaactagtttaagaaatgcaaaatgggaagagctagcttttcttagatacatttcttccttttttattctttcttgggagacgttaagtataaaagggaaaaagtcagttccttcttctctctctttctctttgggtgacagcaatgctcacttagtaattataaactggaaataggagagtagcttgagcaggttatgatatatctgcccaatgtgtttcattccttcaaacataaactttgagagtaaaagagatttttataatttaaatgccaacgacaggaatggcctcatgttttaactttcaaataataaatggggagttggtatttgggcagagtttgcattttactaatcctatatactttgagcttagtttttagaattgtgtcaaatacatcaacatatcaggattatagtgccaaaaatagttaaagtgccttggtcctccctctgtaggcagcaaattgaaactaacatgggaccatgccatccttctagcataatggagaagtctgaactgaggagtatctttgatgaaagacatttaggaccctagaaactaaatcttgtcaccaagactttatagtaaagtagtagcaaaattatttttaaaagactttcttccttttactacccatttcctctcttgggaaagctgatgagcaaattatccaagactcatttctttattaggcaaagtcagaatatttcccctctgaaaatctgaattatgccctcattctttttcaagaaatatctcaaagagcaaatagaattaaacatgacacttgattgtctgattatttggcatgtataaaattatcatgtggcttaatgtgccttaagtgaaaatttaaacttagacctgaaacctttacagttggatgtagcgttgagcttttgcatgttttctgtataataaaccacttttgttttgtttgttttgtcttttaacctacacctttatcattactctaacagatttagggcttctctttctctacagctaagtaagggaatatgtgcaattatgagacatacaaaaaaggaaagggaaaggactttctaagtagcaaatctgtgccatgaagtagatgtggcgtgaagatacagagcctgaggatagtaattttccctgagccacgcacacaggcttttatttcatgccttttctctttctgtgccgtcacctttgagaaaaacgattgcaccttctccaagtctgcctttttaacagctacagttaagttggcaagacttccccagctctgaatatagccatttgccgactccggcctctttgcgagactgactcaaatctgtgatcttctgttcagcatacacatcagcaaagtgagaagatgagcactaaatataggctctattaactttacttttagatttactgccttcaaaaagtgcctattctgagcaacataaacgttattccttacatatgtatgtacacacggtacccagagtcgtactgtgcagccttcaaaaacataccatcagaaagagtaggtgctgagataaggaaactttgccaaatgaaagaaagtcactcacttccaatatcccctctcaagcggctaccgtgaaacgggctgcaaacacattccctgagcatcccttgctgatacagcttctttatatttatatcctactggatggtagcatattgctaaggtttcctgtactctgcttcaagggaatgtaagctttatggcattgaaacatttagggaaaaaaaagatgtttaagagaattaatagagccgtagtctgtattaggatgtgtgtcatatgtgtgttctataaactaagcatcggtgggtttagagtgttaaagtgtcagcacattccttctccttttgtctctcaggctaacatgagagaaaatagaaaagtcttggctgtggggattggaagctcagggggccaaatgtccttgccagatccttagagcattactttgactcctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataacattccctgacttagggaaaggcacacaaaaacatataaagaatatgtctattttcatatgtgtgatactgacagagccatggtattcctaaaatataggtttctcttttttcttgtattcttagcaaattgcatttattcactacattacaaaccatcactgatgtatccaaaatagcacacatagttcagtatgaaaataagagaataaaatctgttataagcaagtgatttaggtattttcttttgtgtttatgcattatctgactatattaaaacctgtttttctatttaccttctatcagttttctctaccaattatgttttttcaatgctctataagaatgaatatggaaattatatttcttttttctgtaaaagagttgcaactactttattatatttagaaatccaataaacttcttattacatt

SEQ ID NO: 5073 - DNA, 1013 bp, Homo sapiens
agagtccactgccctcgcccgcactttcccgcggcgttacgaggggccaactccgggtgcccgagcccgaacccctccccggccgagaaagtgcgcggggcccggctcagccgccacacgtcggggcttctgagcccgctgggcacttaaggcgctcctccctcgtcccggggctgggctttcaagagagctcaaggctgccagagagtgatccgagagatggatgacttcgcaaagccgcgcccacagacggcccagcggggtgagcgcgtcgcagcccgcactcaaggaggtcttggggcgcggcgaaggggctccgggtcccagcccgaaggcgacctcagttcccccgagagcggccccgtgactaggcacatttttgccggcaccgaggcgggggagccgcgcagccccggaagggccgggccgcgccggctcagacggccagcgtccgccccctcttgccccgccgcccaccgggccgctcaaacttaggggctccggagtcccagctctcgggcccggggacgcggctggattctcccccaaggcccacgcgagcgggctcagtccccagaccttcccgcaacttcccacccgttcgccctcgggctcgtggtcggtcggatcacccggccgcgtccccgctgcccctccccgccctgccccggcgcaagcgcggcggctctacccagcgccgcggtcctggctctggccagacgtgggggaagccggttgcggctgtccctcccgggccgcggttccctagctcccccgcccccgtcccggcaccaccgcagggcccagagggccgaggcagcacctgctgggacgggagtcccggcggcggcagctccaagtccatcatgatgagctgtggaccgtgtgttggggctccccgacggcggccctgttccggctgccgaggcgcggcgcggacagggcggctctggtggcggcggcggcggcggtggcggctgcgtcggcggctcctccgggctccccggcactcg

SEQ ID NO: 5074 - DNA, 216 bp, Homo sapiens
aagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtgg

SEQ ID NO: 5075 - DNA, 11796 bp, Homo sapiens
gtacagcccagagaggtatcagctcgtagcccctcgagtcctgccacggactccgcagaggtggacgcgccgcggagttgggggacggctcccccaagcagcccgctcttcaccgcgcggaagcaaacttagcggcgcggccagccccacagccattttcccgggaacccgaggaagcggacgaggaggcggctgcaactgcggcggcggttcctgcagttgctgccgctggtcaatggctggccccttcccttgcgctcgccgtgccacttgcctagcatccctctccccacctccaaagcttccaactgcaccgggacctcgggcagcagcagctgctgctactgccacttcgtccattcagtatccccggattcccctctccccacctaccaactgcgggtgaagtgcgcgctgtcagctccagagtcctcctcccctctgacctccgtgggcccccgtccgggcagcaccactcccagccgcggctgcagttcctgcgccgggttccccactcgccccgatttactgccacaatccaccaaataacaagctgttgagcagactcgcttctacacgaactcctattggctgctcatgacgccgaagagcttcggataggacctcgctacctgccgtcctcattggatgtagctgtgaaacttcatggattggtgagaaaaacagcaggtaggacatcttccacttatgattggctttttccgaaaaccaactttattggagagttggttattgagtaagcaagtcctgagaaatgattggtagagacgactccggatgtgcttgactgggcactgattggtgaattgaggggtcaggaagagcagttcgacacgaggattggcggcggagtgtcccatggaaacggaacccagaattgcagccaggggcttgcacgggggcggggcagggtctgtccaaggcgcttgcgctaaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgcttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgatttttctctgggatttattgtttttcccattccttgctaggatttaactacagaaagacagatagtaactgctctaaatattctaatttcctttatttttttgagataaggtgtcgctctgttgccctggctggagtgcagtggcgtgatcatagctcactgtagcccccaactcctggctggggctcaaacagtcctcctgcctcagcctcccaagtagctgggactacaggcacgcaccacctcacctcgctaacattttgttttgggagatagggtcttactcttttgcccagcctggtcttggaactactgggctcaagcagtcctcccaacttggcctaccaaactggtaggattacaggggtaatccccctcaactgacataaatattctaattttcaaatttccatataatagtatggagagatgaaaacaaaaggaaaagagtagaagataggaacctagcatcatactagtaagtgtgcaatggaaaagaacataggtctaagactcataaggtctggatactgttcagaaccagctgattctgtggtcctatgcagtgtgtttaatctgcagttgagcttgggctaaatgacctctaagatccttttgtcagctttactaaaatacgaaacaaattaggttttatagggggttctagaacttagcattgtataaatgccaagcactaataagtattttctagaagctggtcttaaataagttgaatgagtaattagttgagcagggttctagtacagcattaacattaaatgtatgtgaaattgtatctcacttcagtttaccaaaacactgataaatggtatgcctgctttttaggcaagtttctgacaggtaatcaataatattgaaacagtatccatgaagtctttaagttgatcaacgcatggctaaaaggaaaaccaagtttttaagaaaactttttcacactaatagctgaattttgtgaaagaaaaagtgggtagtcgtaagagtgtaggctttatgccttacctggctaggagcaaagctaagagaaccggtggagcacagccagacataaaagctgtgttccaaagaaagaatataggaaaaatataactttttattaactcaaaattttaaacaaaattttcaaactagagctcacagagattcataaataggtttcaaggattttgtgaaatcatatcaaaagttgtgtttttctagattgaggctttatagcagttattcagaatctataaagggatgtataacacaactctacagataatatgttaccagctttcccattcagtgacttagcagcttcataaactctcaacatcaaaccacactatatccttacaccgagcttccccagccacaggccacatggggccaaacacaaattcgtaaactttcttaacacatgatgagatttttttttaagctcatcagctatcattagtgttggtgtattttatgtgtggcccagggaagccaaatgattggacatccctgccttagactgaaatgtctgtggtgataaaatttcactgcattaggatgacgacatagtaaaaattcaagcattaattattacctgaagcttctctatttccgtctttgcagcttgcctggctttgccgatggcacagccccaataaccctatttagaaaaaaatatatataatcactgaattagtacactatcatatgtaattaatgactactaatgtttctataacctagtgaaaggatgctaaatgacttttaaaagcaagtatagaaaaatatagtcaaacacattctgatgaatgccaaagggctcaaaaatactaaaataccaaacaattccaaaacaacctgtatttttaataaaggtatatccaaaaatatgtaaattatgtaatcatatacactttaagacattttggggaacaggaacggaaaagattttagcactatgacaatgaaaaatgaaattatatattcctgagagacagaaataaagttaattcctatgagttcagtactctaaacccccaattttattattttgtaaatttttttaaagataaggatgcacagctgggtgtggtgggtcatgcctgtaatcccagcactatggaaggccaaggtgggcagatcacctcaggtcaggagttggagaccggcctggccaacattgtaaaaccctgtctctactaaaaatacaaaaaaattagctaggtgtggtggcaggtgcctgtaatgccagctactccagaggctgaggcaggagaatcgcttgaatctgggaggcagaggttgcagtgagctgagaccgcgccactgcactccagcctgggcaacagagtgagactccatcaaaaaaaaaaaaaaaaaggatgtacacatatatacttctgttacagcaaaatatatttaagaatcttcattttcttcaattagtaaaaacgacaaaaatgtaaggataagaaaacagttaagaaacggtaacaggccgggtgcagtggctcacacaaagtgcttgtaatcccagcactttgggaatctgaggcacgtggatcacttgaggccaggagttccagaccagcctgggcaacatggtgaaagtctgtctctactaaaaatacaaaaattagccaggtgtgatggtacaggcctgtaatcccagctacttgagaggctgaggcacaagaatcccttgaatccgggaggcagaggttacagtgagccaagattgcaccactgcagtccagcctgggcaactgagcaagactctgtctcaaaaaaaaaaaaaaatggtaataatttagggaaagctcttagaaatcacatttaaaccttctctttaaaagggaaggcagggcaaggtggctcacacctataatcccagcattttgggagaccaaggtgggcggattacttgagatcaggagttcgagaccagcctggctaacatggtgaaacctcgtctctactgaaaatacaaaaattagccgggtgtggtgatgcatgcttctaatcccagcctactcgggaggctgaggcagaattgcttgaactggggaggtggaggtttggcgccactgcactccagtctgggtgacagagcgagacgctgtctgaaacaaaattaggtccggcactgtggctcacgcctgtaatccttgcactttggcaggccggggtgggcagaccacctgaggtcaggagttggagaccagctggccaacatggcaaaaccccatctgtactaaaaatacaaaaattaaccaggcatggtagtacatgcctgtaatcccagctaatcaggaggctgagacaggagaattgcttgaacctaggaggcggaagaggttgcagtgaaccaagatcgagccactgcactccagcctgggagacagagtgacactccatcttataaataaataaaataaaagggatgacatggctggacatcgatgctcacgcctgtagtcccagcattttgggagtccaaggcaggaggactgcttaaggccaggagtttgagaccagccctgggaacgtggaaagaccttgtctctatagacaccaaaaaaatacaaaaattagctaggcatggtggcatgagcctgtagtcccagctacttgggaggcttaggtaggaggatcgcctgagcccaggagttgagaggctgaagtgagctatgattgtgtcactgcactccagcctgggcaagaatgaggaaaaaagacattaaatacagttttaagacagtgtttatagtaataaaggaaaatcacatattcaaaatactatatgcactatacagtttctataaataacatactgaaaaaaaatctttcctctgcctcgtatcagttattaatgataagaaaacatggctgggcctggtggctcacacctgtaatactcgcactttgggagacccaggtgggtagatctcttgaggactggaattcaagaccagtctggccaacatggcaaaggcctgtttctactaaaaataaaaaaaattagccaggtggtgcacacctgtaatcccagctacccgggaggctgaggcagaagaactgtttgaacctgggaggcagaggttgcagtgagctgtgatcacaccactgtgctccagcctgggccacagtgagaccctgttcccccaaaaaggaaaaaaaaaaaaattctgttggacaagaggttgttgtaaaaaaaaaaaaaagaaaaattactttccttgaatgagtttttttttaatttcatataatcttataatgagacttaaatgctaatgaaataccattaaactaaaatagaatttcaaatgattcaaaattactcacgtatgaaacacctgatgggtcaatcatgtagagttgcgcaccgtcattcacactgtaagaccctaacatgaaactgcatgaaagtatacaaacagcttaaaccatggcaataacataaaagtatttgtgaaaaaattattttaaaatgcagttatattttctttctgagataaattactaatacacatataactcagtaagtactttgaaacagtggtttcaattaattaaaactattacatgagattattcaaaattcatgtagcttttgtttgtttagtattaatctttctgatgaaggtctcctggaaagtctagcagtacagggaaaggagtaacgatagatgaaaaccacaactatgagagggcccaataaataaggcataaacacaaaaagatcaagggaacaaaattcctgacggagagtatactgaatccatgtgaaattctttccacccttcattctatttcccaatatcctgccaatcatttctctgcaataatcagaattggttcagtgtatttttctgtgctcaacaaattaggctattagctgattgtatgaaatactgattttctgaaattgtgacatacagtgggcactgtttccatgagttctgcatctgtggattcaacaaaccacagatagaaaactttcaaaaaacattgcttctgtactgaacaactgtgattttcttgtcattattccctaaacaatacagtgtaacagctatttacactgtgttaggtattgcaagtaatctagagatgacaacatacaggaggatatgcacaggttatatgcaaatacttaaccattttatatcagggacttcagcaaccttggattttggtattcatgggaggtcctaaaaccaatcccccacaaataccaagggacaactatatttgccttagagtagaaaagaaatcagcagcatcttacacatcatcttatatgcggaatattttaactattcaattcccatccctaccgtcatttccttccattttctaccgatatgagacttatccttcaggatatatagctcattgtcactattttaaagcctttcaacatttctttgaagaaaatcagcatggagcacagacttttatatgactggaccccttcctacatcagtatcatctctaaacctcatactctacacaccaagcatacttaactctctctggcgcacgtattttcataccagttcctgtgcttgcaactaccaagtctccctacatctcacactcttccttgcctcctgtccagaaagagtccgttccctaattgttgtccctttatcatatcactaatattttatcaatgtgacttcacacctgtgtctccacatttatgactaactcagtgcccaatagatgtttactaaaaaagttctctctggcccagtgcggtggctcacgcctgtaatcccagcactttgggaggctgaggtggatcacttgaggtcaggagtttgagaccagcctggccaacatggcgaaaccctgactgtactaaaaataaaaaaattagccgggcgtggtggcaggtgcttgtaatccctgctactcaggaggttgaggcaggagaatagcttgaacccgggaggcagaggttgcagtgacctgagatcgtgccactgcattccagcctgggcgacagagcgagactccatctcaaaacaaaacaaaacaaacaaaaaaaaagttatgaaaaaaagttatctctactattcttactcccttaaaaagagtagagaagttaactgatgaactcagagctcagttgaaaggtattttacatggtctgaaaacaaagtgtttcataatgtaatttaactgagaagcttaagaatgactaatgtcagcctgggcagcatggtgagaccccgtctctacaaaaaaaaattttgttaattagccaggcatggtggcccatgcctgtggtcccagctacttgggaggctgaggtaggagcatcgcttgagccaggtcaaagctgcagtcagccatgatggcaccactgcactccagctcaggtgacagtaactgtctcaaaaagtaaaaacaaaaccctaatgtaatattaccaatagaataaaactcaagttttctttaatatcttagtaattaaatatgactgatgataaacaactcaaaggtaggactacagctgagcactcagatgttagtatatgtattattttgaccaaacatgtttgactgttttaagtcataagccaaacatgtcttttcattttagaaaaatctagtcacaagtcttctctgtgaagccaaatttgaatatttatacctattccaggtctttatgcagctgaatctccactttaccccacaataaaatatcagcacttcaacagaaagagaaaccgtgcctaatgggaattgtgagacgtaatttttaaaattacctaagaatatcagggactaacaccgagagcttattataatcagattaaagtcattgttatcagttccttgttttataatcacttcagatctatatagtccttttcactattgaaaccttttttttttttttttttttttttttaaagaggcagagtctctattgcgccagctagagtacagtggtatggccacagctcattccagccttcaactcctgggctcaaatgatcctctcaagcagctcctaagtagctgtgactacaggcatgtgatactgcacctggctaaattttaaattttttttgtagagataggttctcactgcgttggccaggctggtctcatactcctgggcgcgagggatcctcccacctcaacctcccaaagtactgggattacaggcttgagccatggcacccagcctcaagtagtttctatgtacactgttttatttaatcattgccctaatacttatcgacgagtttctatttttaagtatgtaaaaggctaagatgctggggaacataataaatatctatagtacagatctgccttttgaataattcacaaaatttcttacctgcagccaaaaggtctaacagcactgtagagtgtatatgcatgcacatacatggccactctgtctgcaagatgctatggagggaagcagaagagcttattaataaacttctattactgtccaaaaggttcctcaatatgttatcaacttacttttagtggaatgttgtagccaaagttagatctgaagttggaagcttcttctcttgctatgtctgctaaagaacgagcatctgccaacaaacctgctactgcctgaaaaaaaagcaccaatttactagaggaacacattcctatcacaaatcaaagtctgcaattaataaagacttattaaacatttttttaacaagtattaccattcaaaataaacttttttggcttaaaggtctctctacaaggcattttgatgcttgagtatgaaattataatttagaaatttagtaagtataacttcattgctttgtccaatgttcatattcaggacatttccttttttttttttgatacggggtctcgctctgtcaccagggctggagtacagtggcatgatctccgctcacttcacactctgcctcctgggttcatgccattctcctgcctcagcctcctgagtagctgggactacaggcgcctgccaccacgcccggctaatttttttgtatttttagtagagatggggtttcaccatgtcagccaggacggtcttgatctcctgacctcgtgatctgcctgcctcagcctcctaaagtgctgggattacaggcgtgagccaccgtgcccggccaatattcaggactacttctatcataaatcctcttcccctgatttactaccactacctcattataacgaataaaaaccatgggtcttggtcagatttttttttttttttttttttgagacagagtctcactgtgtcacctaggctggagcacaatggcaccatctgggctcacttcaacctttgcctctcaggttcaagggattctcctgcctcagcctccccagtagctgggattggctaatttttatatttttagtagagacagggtttggttttgtcatgttggccaggctggtcttga

SEQ ID NO: 5076 - DNA, 2335 bp, Homo sapiens
gcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcagatacctgctttcccacaacagcaaggaagaaccatggcccaggggtcactgtcattcggggacgtggctgtgggcttcacccggaaagagtggcagcagctggacctggagcagaggaccctgtaccaggatgtgatgctggagaactacagccacctgctctctgtgggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccagaagaagtttggcaagttgctacccagccagatagccaacagcaacacgaagaccaacatttgagccatacgtttctagacaagaaagactggaccggaaatgagcttcatgaatgtaacgaacttggaaaaaaactccatcagaacccaaacctccttccatcaaaacagcaggtccgcacacgtgacttgtgcagaaagagtttgatgtgtaacctggacttcactcctaacgcctacctggcgaggaggagatttcagtgcgacggccacggaaacttcttctctgttcgaaacttgaaactccaccttcaggagcgaatccacgcggaggtcaccagtgtggaagtgctttaagctgtgacgagggagttcctgcagctcagggagccagtagtgagaaaccccacgaatgcacgaagtgtgggaaagccttgtgctgcagatcggacctcagggtacatcacggggtccacgcgggggagaagtcctctgcgtgcagtgaacgggggagtggtttcagggagaagctttgccctgacaaacagggaactcacacaaaggagaaacccgctagagacagcagaagtggtaaaacgatcttccggaagacacgcctgtgtgtcccgggcacagttcacgccggagcgaagccttacaagtgttgggagtgtgagaaaacctcccacaagtcgcgcctcatcgagcaccttcgctcccacacgggggagaagccctgcggctgcagggaatgcggaaaggcctttttccagaagtcacacctcatcctgcgtcagaggactcacacgggggagaagccctgcgactgcgcggagtgcgggaaagctgctcccaggactcctgcctcctgacccacaggcggactcgcggggaagaaaccgtacgagtgctccgactgcgggaagacctcccggaaggcgaacctcatccgccaccacgggatccacacgagggagaagctgcatgggtgaagagaccgtgggatcgtcacaaagtcacatcacgaggtcgccgaacctctaggagggacatcgccagggaaacagccctcaaccaaaactacgacgccaccctaggcagaggtcccatatcggggtgaaattcggccactttggtggcttaaggaaggcatggtcagctgggcgctgtggctcacgcctgtaatcccagcgctttgggacgccgaggcgagtggatcacctgaggtcaggagttcaagaccagtctggccaacatggtgaaagctcggctctactaaaagtacaaaaaattagccgggaattgtggcaggcgcctgtaattccagctactcgggaggctgaggcaggagaatcggttgaacctgggaggcggagattgcagtgagtcgaggtcgcaccactgcactccagcttgggtgacagagtgagactcagtctcaaaaacaaacaacaaaaaagcatggtctgttaaaactaacgacggaagggtaatggtatgctagagtgatctattttcgtaggtgtactttttttttttgagacggagtcctcgttctatcgcccagtctggagggcagtggtgccatctcggctcactgcagcctctgcctcccgggttcatgtgattctcttgtttcagcctcccgagtagctggtattacag

SEQ ID NO: 5077 - DNA, 932 bp, Homo sapiens
tcatgcctgggcagttacaggaaggcttcagctgcctggtcaccaaccgattcgaccagttatttgacaactaatcggaccccttcgaggtgctgaaggcaggagagaacaagaaaaaagaagctggcgggggcggcgtctctggggccaagagcggcagctcaggctgcgacccagaccaactccaaggcggcaggcaaatagctagctgcgcaaggagtcccagaaagacagcaagaacccgctgccctccagcgttggcgtggttgacaggaaagaggagacgcagccgtccatggtgcttaagaaagaaggaataaaaagaagaaggaataagacaagttggaagaagacctgctcaacaacttcacggtgaagggaaaataactgatagaagaccagaaaggagaccaccttgtgaacgaagacttgaaaagccacttgatgaaaggggtgaaggaggcgaattttcagttgatagactgattattgaccgacctattcaaggtcatggtggtcttggaagaggtcgagagggcagtggacgtgaaatgggccaaggagatggatttgattctcgtggcaaacgtgaatttgataggtatagtggaagtgatagatcttttttttcacattacagtggcctgaagcacgaggacctgtaacgtggaggtagcagatctcacaactggggaattgtcaaagatgaattaacagagtcccccaaatacattcagaaacaaatatcttataattgcagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggactgggcaaaagta

SEQ ID NO: 5078 - DNA, 3188 bp, Homo sapiens
cagtggtgcaatctcggctcactgcaacctctgaacccctggttcaagtgatactcctgcctcagcctcccaagcagctgggattacaggcatgtgccaccacacccagctaatttttgtatttttagtagagacggggtttcaccatgttggccaggatgcgctctatctcctgacctcaagtgatccgcccgccttggcctcccaaagtgctaggattacaggcgtgagacacggcgcccagttgactgttttgttttcactcactcctccatatgggtagttgaggatcactatgactgtttttatgtaggcagaatttttaagaaaacaacataaatttagatatttgttccgtaaagttactaaaaagtaaatatattaaaggtgattgtcacataagccttccaatcacagtgcctgtgatttcattagacaaaactgaacatataaaaatgtagttggctacctgggagcctgaagcactttatttacagatactttcttagggctaactcaaaacacatctaatcagaaccatgccataagcttgccagagaatgacaatgcatttaaacatcgtaaatagccaaatttcaccttccccattgaagacagcatttcagatacaagtacatggcctggtaatgtttttccagaagagatcctacttgtatcaaagtcagcctgtagcagtgcaaactactgacttaaagtttagcagctaaaaatagagtctgaaaagattcagaaaattgagttattttacccatgaaacaaacatctgctcttttagagcaagcagctctttataccttatgagaaagctcaagaacaaaaaagttagcttttcattttaaggtaccatggttgattttagacagttctcatatcttcaaattattatcctggggaaaattatgcaggacaaaagtgttttttagaaatatttagcaaaaatatatgaattactgccttttcataatgcagccaggacttgcatcggaatatttgattatcctatgaccaactcacttataccttccacagaatactatagcacaacgtgtagtatatacaagctccagaatgcttggagatgtacctcactttagcactaagtagctgtgtaactttgagcaagttgtttaacctgtgtctccattcctctcgaggatcataatagtctttctcatggggtaaaataatacatgtggaacactcaacaagatgcatggcacacagtaagtactgtaataaaagtaatttagagaaacagaagatactttgcttaacccaagataccttgaggtaaatttaaaagtcacattttaaatacattcctattgtttttcatacaactatcacttctgtggtaatcaaatggtgtttaaataatctatgtttatgcctacttacataggttaacataaacagtaaaaatattttcattcactacccaagcacagtctattgaaggcacttccaaccagccccttatcagtaggaagaatccaacctaggactagtttatcaatagatgtacttttccatagattgtaagcagttctaagtaggaaaggtttggctctcaggagctttcagcgggacatttatatttgtaaataaaaaggaaatattctttgggcagtgtttcagaatcacctgggatgatctgcatgaagattcctggcctccaccaaagacttactgaatcagaaaggaggcaagaggatgaggaatgcttaagaatctgcattaacaaactttacaaatgaatcttacaacatacagaagcatggaaactactgcctcaagggattatctcaacttgagtttaaacataggaattgctgactacctttaaaatgtaaaaatagtatctttatgggagggatgttgtttgggggcagctactaaatagtgaaatcattcctttaaaataccctctcaagtctgccccagttatccattttactggatagtcttggtatccagatgatttagggaaaaaaatagtagtagcaaactctgaaaacactcagtaaagttcattcttggtcttctcttcctaaatttgttttcaattgttagatttaaacactaaacaagaccaaaagagaactttattttacatgtctttattttacatttagaaccgttttatgatttacttaaaaaaaaaatcttttactattattagaagtattttttaaccaaaatcttgatttaggaagacttaagacattgtgcattattttaaatattttcatttcagtaactattaaaaataaattcacaattagggtttcaaatgtcctaatcatatctagtttgttctcatttaatattttatcaatcccatcatgtgcatacagaggttaaggtgatgtataaattttatatctttcaaacacattgatgctaatcagctcttgatctaattactatttcatttattcagaaatagcatttagacataaaaaccaatgtctcactttgtaaaataacctttggctaatttacacacatctaatacagcgtgttatataagttttaagtaatacaatgagtcactactatcattcagttttaaatatttttagtgttaacagggctgagaatatcatgtggttcagtcttctgaaggaagttatataataaaagcatagtgcctttgaacatgaagactatcctcaaggccagaaatcctacaaaggaactgaaaggagagattccagagaattgctctcctcatttttaatatgtaaagtgactgttttaagtcacttcattgaagacttaaggaagaaaacagtgttattatgccactgaataaagctacttaaaccagagtaattttgggatattaatcctaggctacataattaataggtcatcaaaacaaaaacctgtcagttattaggtgtaagttaacttcctatgccaagtaaggggtcacacttcacttcccccatttgtaaaatgaaaaggtggccaggccagtgccatttaggattctctgctaactgtaaaatgtggactgattttcttctgtttcttatagtccaggtgtatataaacttccagttctttaagtcaaaatttttatgcacataaccatgtcagtgtattgcccttagtttaaaaatgtacaactacataaataaaaactattgtttcttcaa

SEQ ID NO: 5079 - DNA, 691 bp, Homo sapiens
acatgtgatgtctcccccggaagcccagctttaaaatttctctcttttgtactctgtccctttatttctcaagccagccgacacttaagaaaatagaaaagaacctacatgattatcggaccagtaacccaagagcacccactcagggccacggctcaggcaggaacctgggatgcaaggatggatggcacatggtcctccctccaggagatcacagtgtagggaaatcaacgaggacccatagtgagcccctccatcccacgtaccccctcctctatccacttgtgggcactgcagcctggacttctgcatcagcagctgtgtggaggtctgttaccctgagatctgcagccaggacagggggctgtgcccaggaacaagggagactggctgctgactgtcctcttactgctgggcctgtcccttccaatcagcgcccggggctctgagcacattgctttgctggtgtctgtgagcagctggagatggtggtgaacggtctgtttgcatttcttggaagaagatcttttattctgctgctcaacccaggtctctgccttccttagagactgaggcccatccttcagtttccctgattctggaagagcaggggggttgaatggagcaggaggtcatgatggagacttgggccccagcatcccgcagcatttgcagcgcctccttatatagg

SEQ ID NO: 5080 - DNA, 2685 bp, Homo sapiens
ttacaggtgtgagccactgcacccagccaaattttgtcaagcttttattctgcatctatttaaatgttagagttgtgatatcacaactaatttcacataaatagtaaacatcctcagagactactatgcacatctctatgcatgcaaactaaaaaatttagagaaaatagataaactcctggatacatccagcttctcagcattgaaccagaaagaaacagaagtcttgaacagagcaacaatgtataaagtatataataagattgaattactaataaaacaagctaccaaccatagaaagccctggataagatgagttcacagccacattttatcacatatacaaagataacctggtattaattctactgagtgtattccaaaaatcaaggtggaagtccttcctaaattatttgaaaacattattatcttggtagtaaaacctagtgaagacacaacaaaaaaggaaaattaccggtcactattcttggtgaaaattgaaacaaaaattcatgaagtactagcaagttgagttcataagcaaagcaaaaagttattttgccacaatcatgtaaacttcattgtatgaatgcaaagatgtttcatcatatacaagtaaataaatgtgattcaccatgtaaagataatttttaaaaaacaattatcacatgcagaaaaggcattcaagaaaatctaatactcatttataaaaacattctcaacaaactaagcactggagaaatatgcctgaaaataataagagccatccatgacaaatcctcagccaacatcatactgagcgggcaaaacctggatgaggtctccatcagaataaaaataaggctgggtgcagttgctcacgcctgtaatcccggctctttgggaggctgaggtgggtggatcacctgaggtcaggagttcaagaccagcctggccaacagggtgaaactctgtctgtactaaaaatacaaaaaattagcctgtcgtgctggcaggcatgtgtaatcccagctactcaggaggctgaggcaggagaatcacttgaatgtgggaggcagaggttgcagtgaactgagatcatgccattgcaatccagcctgggcaacaagagtgagactccatctcaaaaaaaaaaaaaaaaaaagacaaagagtatccactctaaacacttctattcaacatagtcctgaaagtcgtagccacagcaatttaacaagataaagcaataaaatgtattcaaatagaaaaagaggaagtcaaattatcttcactggtgatataattctctacctgggaaacttcaccgaaaaagatttcaccaaaagatttctaagcctaaagaatgacttcagcaaagtctcaccatactaaatcaacatacacaaatgagtagcatttctgtgcaccaataatattcaagctgagaaaaaaagaacatggttctatttacaatagctacaaacaaaaaaatatgtacctagtaatacattaaatcaaggaggtaaaatatctctacaacaagaactacaaaactgctgaaaaaaaatagagacaacgcaaataagtaaaaaggcactccatgctcatgaatttaaagaatcaatataattaaaatgtccgtgctgcctaaagcaacttacagattaagtgctacttctctcaaactataaatgcaactttttatggaattagaaaaagaaaaccattctaaaagtcatatggaagaataaaacagcccatttagccaaagcaacattaacaacaaagcaatcctggaggcctcacattacctggcttgtactacaaagctacagtaatccatattacatggcttgctacaaaaatacacatgtagaccaatagaaagaagagaaagccctgaaataagtttacatttctacacccaacttttttctgacaaagtcaacagaagtaaacaaggaaaaattgtctatccaacaaatggtactgggaaaactggttaatcatatgtagaaggagaaaattgaaactgtacctctcaccatataaaaaatgtaattcaaaatagattaaaaacttaactgtgaaacttaaagctataaaaatcgtagaacatcaaaaaagtactcttctagtcactggcctctggaaaggatttatgactaacaccataaaagtgaatgcaacaaaaataaaagtgaaaaattaacacctaattaaactaaaaaacttctgcacaccaaaagaaaccattgacaaatatgcagacaacctagagtatggaataaactattttcaaacttcatacaagaaaaagttaatatttattcatatatattatgtatttatataatatataaattaagttaatggttagaatactataaaaatttaataaggaaatacacaaatgatctgagtagacacttctcaaaaaaagacatgagagttgccaataaacatgcaaaaaattgctcaccatccctaatcatcagagacatgtaaatcaaaatgacaatgtgatgccatttcatagcagttagaatggctgttattaaaaagtaaaaatattgcagatgttgaagttgtggagaaaagggaatgtatatatactgttggttgaaatgcagtttaatgcagcccttgtgaaatgcagtttggagatttcttaactgaaaatagaattgccgtttgacccatcag

SEQ ID NO: 5081 - DNA, 1169 bp, Homo sapiens
tatttttaaccaattaaatgataactcatctaacttctcattaatcttctcctctgaccctctaacttcgccccttgtaatctttacaacctgactactacctcttataattctagcaagccaatatcacctttccaatgagtcacccccatggaacaaactctatatttccatattaatttccctacaaatttttttaatcatagcattcacagccacagaactaattatattttatattctctttgaagccacacttattcctaccctaattatcattacccgctgaggtaaccaatcagaacgactcaatgcaagctcatatttcttattttacacactagtagggtcccttcccctacttgttacacttgtccatactcaaaatacctcgggttctctaaatataactgtaataatatttaccacccaagaactattaaactcctgttctaataatcttatatgattagcatgtattttagcttttatggtaaaaatgcctccatatggacttcacctgtgactccccaaagcccacgtggaagcccctattgctggctcaatagtacttgcagcagtactcctaaagctaggtggccacagtattatacggcttacccttaccctcaaccccctaacaaatatatagcctaccccttcctcatactatccttatgagggatcttatgacaagctctatttgtctatgacaaactgatttaaaatcacttatcgcatattcctccgtaagccacatagcacttgttattatagctattctcattcaaaccccttgaagctttacaggtgcagtcacccttataattgcccgtggactcacttcatccttactattctgcctagcaaatttgaattatgagcgagtccatagccaaattatattacttgaggccttcaaacactgcttccactgatagcctcttgatgacttttagcaagtcttactaaccttgccttacccactgctattaatctagtaggagaactcttcctcgctatggcttcattctcctgatcaaacatcaccattatgcttataggacttaatatactaattacagccctttactcctcacatatgctaaccacaacacaacgagggacacttgtgtattacattaacagtattaaaccatcctttacat

SEQ ID NO: 5082 - DNA, 641 bp, Homo sapiens
ttcaagcaattctcctgcctcagcctactgagtagctgagattacaggtgcacaccaccacgtccggctgacttttgtatttttagtagggacggggtttcaccatattggtcagggtagtcttgaactcctgacctcatgctctgcccagcttggcttcccaaagtgctgtgattacaggcttaagccacagcgcccggcccaaagtgttcttttttccttgaaaagaagtacagattttttaaaaagctaatattgctgtgattcaactctctagttacttgatgctatttcttcatttctattgtattcacatgtgaaagcatgtgatcagttgtcacggcatcaaagataggagagtttctttttttttaggtgggcattatttatgaccttttctttggaagagtaaggacattaaaatgtaacatgcatgatgaaaatctaagtggagatggtatttgtggttaattatgatattgagtggtgcatgaggtaggtgtttagagtaatattcttttgcattatagtaagaacatttaagttttgttaaaattaaaaaattagtacgttattttactatttgtacttttatgtaataaaatgcagtacatttttaaattttcagatgatgtgtgaac

SEQ ID NO: 5083 - DNA, 1374 bp, Homo sapiens
cacagtttattgaaatttaataaaaattatttccaaagaatgagaatcctggggtagcgaggcaattaattaagcaattcatcttaaaagatggaatacttggaacaccttagccatcattcaatgccaaaatgtttgggtttttttcatatcacatccgtcctatcttttcatcttcagtgaatcattcctcatgtttgtaattaaagccatatttaccatcataatctgcagtcacccgagctcattttgctctgaagccagtgatattaagctgttctatttctaacgtgtcccttaacttgattctagtaaaagcagcaagcagtggtatttaatatacaaactcatcaaattccacataaaacatttaaccacagttttaaaaactcaagtgtcctttacactagctaccttggaagtagtactgcacttttctcaccatgttgtcattgtgttatgcattcttggaatttcccttttgtaattaccttaagatccattcataaaccacagaagaaatcagtcttgctttataatcctatctaggttggcatacaaaaatagcattgtcccactggatctcttactttataaaccagatgtggcgctactgactttggactctttagaatgacttcccttcccactccactcaactgtcattgttgggtgagaacatgctggagggtggagccaggacattccattagaatgtctaatccctcaaggtgaccactgatggagacaacatgaatttgcatgttctaataaatacatacttttaaatggcctctagagtagttttccttccctaatctccattccttccaattcaagggcaaattataaatttttatttttcaggctgctttttaaatttcacttttcagaaacacaacaataagagttaatgtagtcctcctttaaactagaaaatactggtataggccaggaattgcagtttaaaaagaacaggaagaggattctgtcaaccggttcagaggatacgagagagggggctaaagagtgacgaggaaaatagcaggaagggttgggctcgtgcaccgacggggcccaggggagtgaggggacaaaagtgtgaagcggacacagagtcaccgggccaggtgaggcccatgggtcagtggggcagaaggggaaggaaagagcccgagaatggggagagattcagggcaatgcagagagacacggcaggaaacccagccaaggctcgagagaagttggggatttgtgggaggagaggggtggccgcggattggccatcgcgaagagaggccgcgccccctagcgtccctccgggatgagccagaaccctgcccgggcgaccctgaagctctccaaggaccgccc

SEQ ID NO: 5084 - DNA, 1927 bp, Homo sapiens
gtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgt

SEQ ID NO: 5085 - DNA, 6886 bp, Homo sapiens
gagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaagtatttacttttaaaacttgaatgtatatctttaccgtatgcctagtacagtagtgcttggaagaaacagattagtaagacaaaatatatgtcttcaagaacacttacgttctgagaaagaattctgaatgcagattctaatgtctggtaaaatgctttacagtgtaaagaatgcatatatgattcttattttatggcattttaaactttccaccccacggttttaaagtgttaatatatgttaaaaatatatgcaatttataaaggagaaggaaagcccagcttgatttttgctgccaaagatggtatatttaaaattaaacgtaactaatggcaaaaaataatgggaatggtgcagtctttgagctgtatccagttggcattattctcttggactaaaaggaatagtattaacttcctcactttgggtaagccactttagatttttgggctgcagttttctcaggtaattagagactttatattatgaaagtttggttcacaattctttgagtctcttttgggaacaaagaaggtaagaggaggatatgtgccctcctctcaatcaaggggtttcttgaaaccctctaaggagaaaaatctgaaactgcctttcctaaaacgttcatgggtttgtcattctgatgatcaatatcgtcccactgaagtatctttttgaattcctagttaggaatctttatgttaagataaactgatcactctctccttcgtggacagtttatctacctaaagatgataggggaaaacactgtttttgaaagacgaaataaagacatgttgtagcagttattttattgccagttagtattacaaaagttcctaaggaactccccattaacttggcctcatatgaactacgcttgagtcccgttttaaattgagtcttgatcgtatttactgacagtttcaaagcagcgtttttttttttcctccatagtaaaaaacctacaggataccaccaccaaaggaaaaaacaagtttttttcagtaaacctcacaagagcatacatttgatagaatacacggattttctaatgaaagctcgccgtcaccattttataagtcagaacatgaaagtcaaaatatctcatacagatgtcttttttttttgagaaggtacacaaggcttgcttgtagagatggagttacatggagggacagaaggtcactggtcagtgattttaggtttttatacttctgaaaacaggtaattacagattctgatcagtttatcattttctttagtcttttattttctgctgaatgctctcaagggaacggatccatacctgtttatcaggctcacctggaagagccaagtcatccactcaggtcttcctctggacctgcataatttcctcatttactagattgggtttcttttatgtgtgggcttttaatgcttggtatctctggtcttcctaatatgtaatgcttagcataataattttagccattattcatttttgtagtaggcttcactagcttcctgcttctcaaatcccttgaaaagatgagatttttttttcgtggagttcacgtctagtaagttggtcttgattttttttttctttcagaaccttctggatttcagctttggcaagcttcctctgtttctgagacacctccatcacctgggttacaatcccatccatgattttccccatctccaggcatttttcatggaaagctcctcatgctttttaattccagtttatccatttgtgtggctttaacctccacatccaggtctttctggctaaactgcagtatatccacaatggggccaatggacacataagggaggccctatcacaggaacacgaacacccggagtcgctagaaatcagattccaccggctttgcttcaggccgacttcctaaggaaggcatggtagcatcacagatgctgtttgtctcagtttcctgagaagccagtttcttagagctgtcattcaagagtgggtcaaatttgagatataaaaacctttctcaaggtagactctttggcccctatgcctagtatgtcagctgggcctctgaagctctcctctttgaggtcctggcaggctctggcccctgttgagaaggggaagcagtcatgtgaactcatgtgctggaagaatccactctaccccttccctggcttctctgctgcaatttttgtctttaaacgtattttcaggtgattccagtttgcatacataattgagaaatataagatttggtccccagtagagagccaggtgaacttaagaaggagtccatctaagaaaattgcacaattatctagtttcacttgggtttagcttttatggcttacttgatttagtaatcaaatgattttcaaatgattttgatcaggtgactcttcgtaaactagagaatgaacttgagagccgaattagcacagtttaaaaataatcatttagtttttgttctctattgtgtaaattattgaggtttgactgtcttggctaaactaaggctcatctaatatctttatttttgatatcctaatttcttgccaattaattgaaggtaacatactagcagaccagataactacttatgcaaacctcagataaccactaatttaaacaaaattaaatcctttgccttccccagatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaaggtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaacgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgccctttgccttctttttcctttcttcatttttctgcctggaatgcaaatgtgatggctaacaccctagcagccattttagattatgaagatgagagtcactccccaggaagggtggacctgaaagctggattctagatgtggaatgacaataccagccctggactacctacctgtaggctgtgtgtgtgtgtgtgtgattgacagagagagagagagatagataccacaagtaacacaaagcatcatacctgggactgggaaggttaatgtttaaacattttaaatgtggcattggtttgttgaagacagtcaagcagtaggtgctgcaggctttgttgaggctagaaagctgttggtctttattaggtgatggcaaaacaatggatcacattttcatgtgctgtgtcttgggaggcaaatgatgagaatgtaggattggggaaaatggtaaggaaaatccaaaatgttcatgttttctaaccccttcttgccaatcttaaaagaaggacaaacaggctagattaagcaagtctacagttacaattggaaggaaacacagccgtactaaggaagtactctgtctgtggcctgcagtctagtttgactaggtcctgtatttgagctttgaaagagtaaagaatacaagtgctcgtatacccctgaagtagttaccagcagtgactgcaaggaggtaatcttatgggatgaaactataactctgtattaaccatcatatatagcatatatgtgtatatgtatgtgtgtgtgtgtatatgtgtatataaatatatgtgtgtgtatatacacacatgtacacaccctacaacccagtgatttcaaaaaattaaacatttgtttagctcatgaatctgtgggttgggtgaacatttctattggtcttggctgggctcacctgtacccagtcagctgcagggtctagctcttcttatcttggctgggatctcacacatgtctaggatcagctgctttactagtctaggattgtcttggctgagacaggtggactactcagttctcctccactgccttatccttcagctggccagcccagaaatgttgccatgtttacagcataagagcaagcaagaaagaataatatgcaaccacttttccaagcctaaggtgaaagggcgggcagaacctgtggtgttaggaggcaactcataccagcccatgggtctaccgtttaattttcagaaatttggcaagctgattgttaacacagctgttgtttaatttatgtacttgtaattaaataatttacattaaaacaaagataataggtactcaaaactcatgactttctagttattttattatattttactattgtctgtcctcttaaggtgtttgtttctagtgtatctggtggaaacactacttcatgtttcagttgtgtcaaaccagtagcttgaaatcagccactgttggagtgtttataccacagaaattgatagaagctacaaatgaagtg

SEQ ID NO: 5086 - DNA, 11076 bp, Homo sapiens
aaattcacatgcccttttctcggtattactccactttttcatttactaatagcatattccagtttttgacatcttatcactagttgtttgtttattgcctgtttcctgtaccaaaatataagctccttgaagggaagaactttgttttgttcacttctttattctaagaaattagaacagtgccttatccacagcatagattctcagtaaatatttattcaatgaatgaacgaatgcaaggatggatgaacaaatgaatgataagccagccagccaactgcttatgaggataaggagaaactggggcaaagtttaaggatgtcgcaaagtctgggtggccttcagtccatgaaagagaacacatctgttctatctcaggctgaggtcatctgcatcctcatcaataagctgactgagcactcattacctgccagacacggtgcctacatgctctaaatgcacggtctcgtttattctcagcaactttccgaggtaagtgctgttagcattcccattccacagaggaacaaactaaggctctgagaagaagtaatttgctcaagacctcacagcctgggatcatgggtatgaatcatctgggtgaatgatgaggccaaatcccaagtccatgtttatgacacttagaaataaccatttaaatgtcctttgaagggtcaaaaccatttagaggttttatctctttcttacaatcttcaaagaagtttaacaccttataataaatatctcacagataactcaggtcacttagtgaatattagttgaattgcttttgtattagatcctacctgcagccaaaatataaatctatgttaccctccagctcaaatatcttccatggctccccattgccgtcaagagacaatttaaactcgttactatggactttttactccaagtccttgagatccatctgtgccacctccccagcttccatcctcttatccgttctcctcacagtctcacttcagccatgctaagctacctgccattctctctgtggaccctgggctcttgcacttgctgttcttctgggagcccttttgtccaacgcttattcattctgtgtgagttaactcaactgtcacctccccaaagtggccaacctccacccactgtggtcttgcgccagtgccttcccctgagtcccatgacaccctgcatttgcttctcttacattgtattattattatctttttgcctgcctgtctctcccacagacatgaaagcaagcttttatgtacttaggttggatttcaaccttggctctgccatgtgtgttcttgggcaaagttgtttttttctctgtgagccttagtttcctcagctgccaaataagcagtgaacaaagttaagtcatgtgacacacaatacctggcatatagtgaggttcaatgttagctttttttatctaagcatcttcagggccagtctttggaccaaacatgctgttgatgctcagtgaagtggtagctctacctggaccagtggttttcaaattttctccttcattggaacctcctgagaggctgctaaaacacaggttactgggtcccaccccaagagtttttgattctgcgggtatggagtggggcttgagagtttgcattcctaacatgttctcaggtggtgctgaggctgctggtcctgggactgtacttttagaaccactgggctggttacctgggaagggtagatgtctggttagggtgatcagacattcagagctaaaacaaattcacactagaggataaggcaatccacaatgggtgtggccacaggatatttgtttagcaatttatccattcaaccaatatttgttgagtatctaccatgtccaggcattgtgctagacactgacaatagaacaatgaatgagcaagacaagaaggttcagatcttgataagttcacattctagtggcactgctttggaaggtgggggccgtcattacacaaatcccatgggtgtgaattgaagggacacagttagtttggggaatggttagccttaaagccactgataccaataatggctttactgtctactgtatcattgtattgccttctcaacatgatttcaccaaaatgattcattgaaactgattatggtattcccataatccccttgcctggaactgcatccatcattcagcacagttttaggatgaagtcaacccatggaacatggcagaatggagtgtcagagaaccagagccaggctatgagacttaacaccagttatatgaaacgatacatttcctcattatcgttgttagctggaagagagtctcagagaatcaaagccaaagatgttatacaacacctattatatgaaatgataaatacccttattgttacgattatctgccaattcaagtaggggttttctgttacttggtgctaaaagttccccatgatagaatagcttgcctttcctaagtgcttacaatgtgccagccactgcactaaatgtttggtatgcaccatctcactgcatgctggcagcaactccacgagtaggctctattattagcccattgttgagggaggacactcagagtttaaatcacttgctctttagttgggagtggagaagatgagaggtaaggctgctttgtggagcaggatgggccagtaaggattacttaaatgcattgcaatgacaccaactgaaacgttttgcaatcacacaatcttccttgagcttcttccaagatagagcagataaggatggaaacacaaaccaaccaaccttatcttcatttggaggactgagaatcatagaaggcaactgacttgcccagttcagctttctcgttctagttctcctaattaaacttgactgctttctagaagttaatcaacaaatacactctcaggctgctttggcccagtttcccggttaggcaatcagggaaaaagggctaggcattgtaaaaccccaggtcctgcagctcccccacgtggctgcattttgacaaaagcaagcttctgagagagtagatcacgtaaggaaccagcccttccatggctgtcattagcagaagtgcagctgggggccattttgtcaagaagtgcttatttggaaaaacaaaacaaaacaaaaaatgaaaaaaaaaaaaaaaatctatacaggtgcatgccagtcccccggtaatgaaatgtaacaaaggaagcacttaagttcagtgagggaaatacagctttaaattacagattgtacccagagcactttataaacggtaatgtgtgataatgtattatccttacttctgtgaaattgtggactgcaacttctgccggggccagttaaagggccaggagatggagagggttgcgtgaatgccattcaagaaaagggcaacagaggctaaggggttaaactccccagaaaaccaatttatgcaaagggctggatcctgaccggcattctgcactaaagatctgaattacaaatttagagaatttgctgctcgacaacgaatgcaggaaggacctcactggctgctgggaacaactgcccttttgaatgaattcttttatggttaccagtcaaaaagtcaccgtcagctggaactggaagggaggggcatttcttatctgggcaaaaagcccctgtacccagcgaggtgaaacttgcaaatgatactgtcaccttcctcaatggactgcagctcaggagctcaccaaaggttgcagcagacaacccccacggtgtttggagacaaaggaatagcagctgcctggtttccttgaatcaccccgtgctctgacgatggcagtgatgggcctcccaccaatggcttccccaagtgctgttttcctgcttcatgccaagttaagcattctgatactaagcggcacgagatagttctcaactgggtgaggcacaggtgtgagtaatctcgaggtatggtcaggaggtttgaaaaaactaacccagctgcaaggaaaagacctctggtctttattggaaacacgaatttgacctgtccaagctgggagctaataggccccagcagctcaggatcccctcctcacttacgcttgggttttgagtgataccatatttttctgaacacattttccaaatgcctatttgccaaagccgtggtgtaatttgcctaagcagcaaacttgtccttagagtcgaggtccatccacatcaggagagtatattcaatgtttatctccgatcaatgtgtgatgaattgcatatgagatagatttgtgtgagccaatgtgtgtgtgtggatctgtgttagttacatgtgtttatttgcatgtatgtaaatatgactgtgtgagtgcatggatctattcctgcatgatatatatttatatatatgaatatgtgcatatatatgcaaatatgggtataaatatgtatctgaacatataggtgtgtatctgtagtggacactgtcaatgcactcatcctccagttacttaggcatcccagcttctcagctcaatgggggccgcttgcccatccccccacctcccagggcagcccagaattcacctaccagggttcaaaggctggctcccttgactcaaggtcaaactatctgggtggtgcaattcatgctccagttgaaaccaacccttgcccaactcttttcttgccctcttctttttctcttactccctttccctcggagcccactctcagtatatcctatgcgtccaaatccccatctcaggctctgctccaagcaacctggcctaagacagcactattctatacatgcatgtgtgtgtacatgcaaacatacaactgcacacatttgtgtgtgtgtgtgcccatatacaaggaaatccgggaagatctgggagagaatgatcttccaaagaagataatggagaaagagtatggattttataatgtagaagttagagtcatctcagatatagagtgggactgctttgaagttgaaaattaaaagatactttagaagtaaatgtattttttattaaatcagaaaaagaaagatacagtttacatgactgtcagtcaatcatatgctactttgaattacattttaatagactcagggtcctatttactcctttgtacaggtattaaaaacaactcaggtatttgagaagtcttctgtaaatttttattaactgaggttatggggagggttttatcagagcacatcctgagaacattaggaatgacagacacacttgagataagtgtcagacggaacagatgaagcgagcccctcagccatctgagaaacattaataatgtaagatagcagagaccaaatctttgttagggatacagtattacaggataaaaatggggaccttgccgcccccttgtgttgcaaaataaccgtgcaacttcctttattttttatttattttttttttttaagttgtaatctttgccgttgtcactgagcctcaaaagcaattgttttcccaaatcattttaagccctccccagtcaatcttttccctctcatcaataacttacaaggaccctatttgaaaaacaacgcttattcattcctttttctataccccacacattccgttctaggaaattggcaaccacccaacacagcccgggttctccctccttgagatgtgaatttaaacaaatggattttcgtctcccttcttcaagcttagaggataagcacgcatttactacaacgcttaattccttctagcagcatttctcttctataacttacttgccactgcctttttttttttttgatagaatcttgctctgtcgcccagggtggagtgcaatggtgcaacttcggctcactgcaacctccacctcctgggtacaagcggttctcgtgcgttgggctcccgagtagctgggactacaggtgtgtgccaccatgcctggctaatttttgtatttttagtagagacggggtttcatgatgttggccaggctagtcttgaactcctgacctcaggtgatccacctgcctcggcctcccaaagtgctgagattacaggcgagagccaccacgcccggccaccactgccattttcatcacttaacccgaacacattcctctattccctccctttcctgcttggtgatcatcgactcttctgacccaactaggtgacctgctaaaccatctttactgttatttgccagaaaagactggaccagagacgtaaataatacacctcaatatacaacagctcgggcttaatttctaggcagaatttcatttgctggccatcagaagaatatatacatggagcgtgtttggggaggagatggagtaaggagaacacatcttggtggcaggagaacctggtgggaaccgtgctgatttgtttacttggatttgccaactggtccgatggatactgggtctgtttgcacttgagcatccaacatccgctttggtccctggagaaaaacagaaagacgtggcagcctattgaagctctgtaatgtcaacagcaacaatggccatttatgtagcacttactctgtgctaggtgttgggctaaattaatatatctcattcctcagtgctgggtaagagaatggtctccagtcagatgcccgggttcgatacccagttacatgactttctagctttgtgaaatcttggacaaattacttatcatctctttgcgctttggtttctttatctttaaaatggaaatgacaaacttatctcagagggttgttcccaagataaagtgagttcatgcttataatgtacttagtacctagggggtactaattctacctcactttagctccctccccagttaccatctaggttcaccaccctgttttattttcttcttttttttttattatacttttaagttctagggtacatgtgagcaatgtgcaggtttgttacatatgtatacatgtgccatgttggtgtgctgcacccattaactcgtcatgtaacattagatatatctcctaatgctatccttcccccaaccccccatcccaaaccctattttattctctctcagaacataccactctctgaaatgatcttattatctaatttatttgtctaacatctgtcttctacaccagattggaagctgcaaggattctgcgtgtctcagtgccttgcaggttcctagcacatggtacctagccttaacattgactgaatgtgggtgaaggaatgttgtcaggcagatacaattattttattttatttttttgagacaaagtcttactctgttgcctaggctgaagtacagtggtgggactatgttcactgtagccttgaagtcctgggctcaaatgatccccccacgtcagcctccccagtagcttggactacaggtgcacaccaccaaactcagctaattttaaaattttttttgtagagacggggtctcaatttgttgtccaggatggtcttgaactgctgggctcatgtgatccttctaccttggcctcccaaagtgatggagttacaggtgtaagccactatgcctagcctgagtactattattattattattactttaccgtttctgtcaagtataacttataagtagtaaagttaaccttttctgtatttggttctatgaggttagaccaacacaaatagccccctaaaaccaccatccaaatcaacatgtcacatggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatatacacacacacatagagagagtatagtatagagtagtataataacgtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagtatatagtataggaaagggaagtataatgtactatcacaaagtatgtatggtctagtatatgtacatagtgtcatatggtttaatgcagtagaatatacatgatatcgtataatatgtaatatagtatatagagtgtattatagcataataaatagagtgtagtttagtatacatgatgtatatagggcacatatatagtatatgtatatagtacatagactgtgtagtgccctgtataatctagcatagtatagtatattgtatttactacatagtgtagtgtaatttcatgtaatttaccaaggaatcagattgctggtctttgaacgccagacctgccacttcctagctgggtgactttggtcaaattgcttaaccctctacttaagccttaattttaccgttgataaaatgggaattcacagggtagttttgaagattaagtgttagtatatgcaatgtactttgaacaatctttgtcacacagtaagtgtgataaaagagttatgattatttttagtggtggtagttgaattcactacttcattcaacaacatatattgaggacctactgcagacaatacattgtgttattaatagttttggggcatcaagagatgaccaggacaccgtgaaataccaaaagcttgggctcaggagtcagctgtgggtttggggatgctccatccctttctggttgcatgacctctggccggtccctcaccgctgagagcctgctgcctcatctgtgtgaggtcttagactgccatcccacccggtcctcactgcagcccacgaggttgacgccactgtcgctctcaggctacagaggaggctgctgaagcccagcgagcccaagccacttcagtcaaattcctgccaatgcagaaactgaggctccaagatgacctaggactaggtcatgcggtaacggcctggccactttgacttggaatctggccctcagctcacctgttgtccccggctctcttctgttcactgcccgctctttccaaccctcggtctcaggctccttgcagtgactgcgctgattgtcacaagcctcggttcagcccacaccagtgtggacagatgtcttcccttttcaagcctccatttgttcacctgctaaacctgcctgcagattgcgctgcacacaatctagcacttcaggggctcatgaaaatgggaaaggggaaggctgggaaagggccatcaaagaagtggtgcttaggggaagggagaaacccagtcttccatcaatcagaatagtttcacttttatcatatgtgtctgtgtgtgcgtatatgcatatatccgcacacacacacacacacacccaggttttgtgacattttcttttgtaaacaaaaaagtccctttgctcaaaaagaaaggaaaatgttttcaaacagttggactttgtgaatgccaagggcttccttccagttcttttcagatttttgaaaaccaagtgggttgctctcagttagaactcaagtagcatgatggagaaggaggaaaaaaggacctgactaacgaggacgtcactgtgagacaaagatcatgcagggatcggcctgcggtgtgtctcatttcctgtgggtaacaggcaccacaatagttctgtgggtggtgacaggctcggctgccagcattcccctcccaggaaggcggtcaggcaaccctggggaatgtgtccagcttgaaagtcttcgaggcttggtctttggaaagcggcagggaagcccccctccgtcctccatcattgctggaggccttgtgacactgggacgatgcaggacttggggtctagggggcctgagctgaatgctgcctctgtctctgacaacctgtggaatgttcagcaaaagacacagcttcttggaggcctggcttatgtgtctgggaggtgtggcagaagcagtcccagcctgaagggatgctgccatcctaaagagatgaggtctgtaaaggagtgtggtcccagaggagggactcggtgtctagaactgtaattagtgtctcaaacctgtccacttcttgtcacttcttcaggaatcaccaggccaatctccatcagctctcccaagaaatatgacctgtattaactagctcctaatgaccttcaacagccattctccaccacagcagcaaaataaaatcttcgaatgttatcaacaggggccaagacttcttacttaatatctgtaagtgcaacagctcaatgcatcaaaatggtacttccatagaacacattactaaagaaatcacaacaatggagcatgtggttgttctaccttcgtatcctttctgagaataccagctgcagaagcacaggaagcagcaattacacatgagtcaaagggtgagctttagaacaacaaaatgacaacaaaacaacaaactgagttggaattctggctctcccgcttaccagctcccggaccgtggaaaaatcccataaatactcactagtctctgtgtccttatgtccatcatggggcagagagagcacttgtttcctagagttctctattaataaatgagatactgcgtgcaaagtgcctagcagacaataaataaacggtagctctcattgttgttactgccgataactgaaaagtgctgaacgactacagagaccctcttagggtagaaaggaatgcaagtcattggtagggacaggaattgaccaaattaatgcttccttcagaaatctttccttaaagagcaaatcagtattaacattttaatgctcagagaagaatttcatatggaagactttcggttttctgttttgtaactaccgtcacagaccaccctctttccacctccaatagtacatttcaac

SEQ ID NO: 5087 - DNA, 2646 bp, Homo sapiens
tgaagaccacgggtgttccttgaggagccagtaagtcaagcatctgcaactcccctgtgcacagtgtagggcagggggaatgaatgaggctatagcggggtgtggactgtggtatactgggagggcagcacctactctgcctgaagggggagcacctgctttgcctgaaggggcggccccttgagcatcaggggactgtagggaggtgagcccaccttcatcagctctgccagttttacaaatagacactgaacacctgaattttttttcatgcaaaatctttatgttttaaatgctgacaaccaaacttaacggaaatgtaaatcatatttgtgggccaaacaaaacatctgtgggctgatatactacaagtttgtgacctgggcctataggggttctctgcactggctcttttgtataattaatatcaaattttcaaatcagaaagtgagtgttgaaatggtgcttggagttcctgtagttcagtctcccactccatgtaaaaaagtcctttctacaataggcacactgaatttaaggaagctaataattcaagccagacacttgcactttcttcgttgcctttttattttaaaagattatggagtgaggagttaggtaaagagatggaggtagagggaagttttgggaagcaggccaaaaatttaggactggaagtggcttcaatgttgattttgggtttttggatgattctctcttacggttacccctcgtatttttcaaccctaatttatcaaaatgcatcagcaaggttggggcttaggttttccagaattcccagagggaaacagaattttaggcctggagcagaccttagaattaatgttgtcaaattttcttattttacagatgagggaactgaaatccgtgagctttaaaccgcttgcttgaagacacggctgacatttgtggctgaatcctaatgtagttaattttcctttcaatgggtcaacttgcaactggtaagtaggatccaaacaaaactacaatcaccttgaaatatcctgtagccttttctacctcacatctcaatagctctcactttttgagagacacaaagatttctttttaaagaagcagctggtatttatttgacttcatgagctaccttatcgaaataatgagataactaatagaagctatttcgaaatagagccaactaaagattgcacatgattctggaaacagggttggcatgaaccacagataatccccacaagtcatttcactagttcccattgtcctaataaaagcctttggaggggtgctaataagtgtcaaattaaacaatgtgtgtttcatttcctctatttgccctctgaaagagatgctggcaaaatggcagatacagcagtagtgggaaggacaaggaggagaaatgaaggcaccaaagagctccaaaatttagacagtccatccctaaatgatcgaaagttgtgtgtaacatggcacaaattattatgagttgaaattttttggtcactagggacaaggacacaaaacagagcccacgagtgtgtgagaagggcccgagggatcattcagtttgtttgcattgttgggttttgtttttctcttggtatggcacctacacacaaatttgacgagccaaaatatgaataagaacataggcagtcacagtgaccttttattaaatgcagagacagttatgtgtcacatgaaacatcaacaaaagcccagttctggtagccagcaagatttttttgccacatttatacttggtcctctttaattatacagagttgcccccagagtactgaaatgatagactagaacacgatgacttcagcaggggatcagagctttagagcttcatcattcatgtgagccaagtgcgaaatttcagcctgtctctcctctaaatgcagttaggagtcttcgaaaccttttgtgtgaatccaggagggaaaattgtctggcaaagtctgataagcatcgtgtcaagagcacatttgtactctggtaagaagcccaggccaattgctgctgggttgtcatggcaacagaaatacacaccatttacacatcagcttctgaaatgagcacaaaataacaaaaccttttcgacaggatgggaggtgaagggaagagcagcatcatctgtgcagcctggtgaaacggtgtttacgacagtctacacggcactactgggtatgctgtctccttggattgtgtcatatttttaacccagtgggaaattcataggatcctcttgactctgtaaaaactgtgggacaattcagtcacttttaccaaatcctcatttccttttcaaaccctgtttactaactgatgccaaatagtattatagtaattgggaaataaaggaagtccctctcctgcttattccttccaaagtacatttctttaccttttcatggaggtttggtaggatacttacatattgtagagggaggtggagaaaatactcatatattgtagagggaggtggagaaggaggaggaggtctttcatggacctacagaaaatgaagttaatcatggttggaaagcctccccttaaaaacgcaggttttttggttttttttttttttttttttttttttttaaggagtcttactctgtcacctaggctggagtgcaa

SEQ ID NO: 5088 - DNA, 15813 bp, Homo sapiens
gcgccgaccttgatctcgtagccggcgccagcagccgcgctttggggcgtcggctcacgtggggccggcaacgcgtcttccaggatgttcgcgcgctagtcgccgctgaggggccggcgatgcgcgaggagttccggcgaggaaggtcggtcagtggacatggccgaggcccgcggtgtccgcgtgtgggagctgcagggctgaggagaggccgcccgcaaccctcgggaatcgtgtgaggtgccactggggtcgcttcacatcaggaggccccgtctcgggggacgcgcgcaggtgaccctgctggtcgtacctggccggggtggcccggaggggctgggtctcggcgccaggaggggccgtgtgggccgcctgttaaaggacccctcgttcgctgacatttgattttgcattgggtgccttctcttctgtttttttcagccagtgagatccgtcctgggcactcagctgtagagcaggggaacgagtcctgcgctttttgcgctgaggtctcctggcccgtaggccaggcagcctctgagctcctttctcaccagcagcttgcgatccctcatccctggccctgtcactcccagctgtttccagtgccgccctttttttttttttttttttgagatggagagtttaacttgttcgcccaggctggagtgaagtggcacgatcttggcctactgcaacctctgcctcccggattcaagcgattctcctgcctcagcctcccgagtagttgggattacagtcgtgcgccaccacgcccggctaatgtttatatttttagtagagacgggttttcaccatattggtcaggctggtctcgaactcgtgacctcaggtgattccctccccccgccccaccacctcagcctcccaaagtgctgggattacaggcctgagccaccgttcccggcctcgagcgccttcttataaactggatggtggtttttgttttcaccttcaaagtcgaatctccctagtccgtttattaccagaaagaggtctccactcagacccagcgagaggcttcttggatgtcgcgtaggaaagaattcggggcgagtccacggactaaagtgaaagcaagtgtattagagaagtgagaaagcaaaagaatggcagagcagggcattcctgaaagcgggaggaggaaggcgcccgccttaggtacagtgcttgttcaaatctaaggtaacacagccaaagaaatcttgggggacatgggctctaccacgagggcccacgaccaaggtttcatgcgcgtccgtgtgaagagaccaccaaacaggatttgtgtgagcaacatggctgtttatttcacctgggtgcaggcgggctgagtccaaaaagacagtcagcgaagggagataggggtggggccgttttataggatttgggaaggtaatggaaaattacagtcaaagggggttgttctctggtgggcaggggtggggggtcacaaggtgctcagtgggggagcttctgagccaggagaaggaaattcacagggttaatcacttagttaaggttgggcaggaacaaatcacgatggtggaatgtcatcagttaaggtggggcagggccttttcacttcttttgtgattcttcagttacttcaggccatctgggcgtatacgtacaagtcacaggggatgcgatggcttggcttgggctcagaggcctgacacaaggattgttcatctttgtttactgactttggcaaagatctatattatctttaaagcgaaacctaaatgaagaatgcttttgatcttaagatattgttaggttttgaagggaagacgagagttaaagaatgacacacaggtcgggcgctgtggctcacgcctgtaatcccagcactttgggaggccgaggcgggtgcatcacctgaggtcaggagtgggagaccagcccgaccaacatggtgaaacctcatctctactaaaaatacaaaaattagcggggcgtggtggcacatgcctgtaatctcagctacttgggaggctgaagcaggagaatcacttgaacccgcgaggcagaggttgcagcgagccaaaatcacgccattgcactccaggctgggtaatacagtgagactgcgtctcaaaaaaaaaaaaaaaaaaaaaaaaaaacaaagggcagctcaacagcaacacaggtatatggcaaaaacctacagagatgggggatcagcttaatgccagagcccactgctgcttacaggctggggtacttatagggcaggaggggaatgggcagtatggcttgccatgtgaatatacttaccagtatatctatccataaaacgttctatgatcaggcagtttggcccttgttccctcagaaagtgacagtgatgttccttgcacctttgctgagcaaggtttgatagggatgttccttcaattgggcctttacccaacagggtttggtaagaaagttgggcaggaaatttctcacggcctgaacccccgtggaatgtttcgctttgaccagtgtctgcgaaatggcggggggcttagaaaatggtgcagtttggcagggcgtggtggctcacgcctgtaatcccagcactttgggaggctgaggcgggtggatcacaaggtcaagagatcgagaccatcctggccaacatggtgaaaccctatctctactaaaaatacaaaaaattagccgggcgtggtagcgggtgcctgtagtcccagctactcaggaggctgaggcaggagaatggcgtgaacccaggaggcggagcttgcagtgagctgagattgccccactgcactcccgcctgggcaacagagcgagactccatctcaaaaaaaaaaaaaaaagaaagaaagaaaatggtgcagtttggactaacagatacagcgacatcaaaatgtttcctgggtctgttaagtcctgggtttgtttagtgaacgttattaatctgttcctgtaaccctaaacatcttgtgactactaagaatgcagccaacaggtctctgcctgattttacctactgcctcttcaagatggaattgctctggttccaatgcctctgacaaactggctgcttgatctctaggttgtgaccatgtcagggatagaggcagcttaggtagaggtagactttcttgtactcaacattgaattgtggcttagttaaaatcagaactttcattcttggaataatacagtattgtaagggtaagccaaatgattaacacatttacttaattacacattgtagcattgaaataactgatgcctttctaatgcaaataaaaaagatttatgtatatgatagcactgtagctgtcttgcgccttactggatggatttcattgctggctaaaatgacaactttaaactggctataactcagaagaatggaggcactttgcacgcagacatctacctccattgaatttggctacttccttttaatgaagctcaagtctcatgttatgaaatactcctccaaaggtgttagcccttttttcctatactctgcctttcaaaaatccctttcaatttgcttaacccctgagagccaaaggactgtgatggttgttaggctgggtcattgtcatcatgttcagtaaataaatacccagacatgtcagtttacctactttacctgattccaaatgagtccatggtgatgtgatcctgcctttctttctgctgttagaggtccatgccaggagccagctttgtatcagttttgccacagtgatcaggtcataaatgtctcagatcattcaagcccagtttaacctagcaaagaaaatggcaagataatattgctgtgttctagctgtgttctggccttcattttaggtaggcttaaacctcgacctggagtcattcctgttacgatttaccagaaaacacccaacaggaagcctacagaactacactttgctcctaatgttaaggaatgaaaacaggaaatgttctgttatctgcctggcagtggggctttggagttaatctcctggccgtatcacttaccagcttggcagccttggacaaactgagctctgagctcaagtttcctcatctgtaaagcgagggtgtattatgtaccttcatttggttgtacagattaagtgtgaacacttaggtaaagcacacagtatggggctgagtaaatggactgttaaataagacagtatcacttgtttttaagttccttggagctttctcccctaaacagctcaaaagattttcatttttttctaatgctaatatttttctaattcttgttttaaaatattttactgtaaaatattttggccaggtgtagtggctcacacctgtaatcccaacactttgggagaccaaggcaggaggattgcttgagcccaggagttggagaccagactgagcaacataatgagacctcgtctcgtcaaaaaacaaaaatggaaaatttttaaaaaacaggccgggcatggtggctcacgcctgtaatcccagcactttgggaggccaacgtaggcagatcgcttgaccccaggagtttgagaccagccttggcaacatggcaaaaccctatctctacgaaaactgtttaaattagctgggcgtggtggcacgtggtggttctagctacttgggagggctgacgtgggaggattgcttaaccccgagaggtcgaggttgtagtgagctgtgattgcaccactgcactccagcctgggcgacagagcaagaccttgtttcaacacaagtaaaatatttgtgaaatgggaattcagtttcattttttttttaactgatcaaaaatataactttcacccccactgaggcttaaaagaacaaaaacaaaaaagtgtgactgacattcggcggttttggcttctagaccgccactaatattgagctgagttcctgtaactctggctaaaagcaaagagctgtgttttagccagagcagttttattatgagttagatttatgatttccagtaggctttttgaaatgttggccagaggtcagggactccctgtccccattcatagattctagactgaatctctttcaatatgaacacatttggctctttaagaaagacttaactaaactgggattcaactggattgcctcgagactttgggcagagcacatgacttattttgtcctagagattccaatctgctggacactcagaaactttcacaacttctatttttcacattttttcatattttaggcttcagtgcagaaggattaaaagtaatggctaagttttctaatgctgttatttattttttcttgaggctttatggtcactaaaaaagtaacaatatatagtacgtaaaaaaacttaaagatactgtggcttataaaagcgtatcttttttctgagaacaaaattagccaattaaataataaaaccatcaagagatgtcaccagtcaatgatgatggggcaaaaattgttctgcattccgaggagggagaaatcgatgcaagcagaagcgattaaacattcacatcttggagctaaatgacctcctaggatggatgggttttatagaggtggagaggtggggggagggtgctggatgaaataactggaaaatctcctttttcttactatttttcttcagtccctttataggcacaactgcttaaagaaaccagatggccccaggatggtgccagagcttcctgaccccttatcagataccagaggaagataagactgcagagcggaacaggataggcaacccctggttggcttcagatcattatcatgtcgttataatgctaaaattccttctcctaaaagaaagtctccaccattttgtgtacatgtgatgtatgaagacgtatgtttatgaattgtgtgtgcacatttagagtctcactttgcacatgctaacattcctctcctgtcccacacctagtcctaaaaactccatgccttctagtgtttggggagaaggggcatttagagttaagagccccttccctggccagcgactaaaacctggttaccgtttacagttgaatgtcctctgcgtaaatcgatacaaagtggggaaagagctgagtttaccagtgacgactggaagaccctctctttgagatttgtaccaaaccaggtctcagtctgcctgtacatgctctgtcattgctttcactgtgttgacctacttgctgctttaccctttgtgtctggccctctcttgtacttagttctttcctcctgtccgtctccaccctctttcacatactttttctcagttttgtgactttagcagaccttttcggctggcccccagcacatcccatggcctggcagcaggtggtttctgcctggagggctcagccatcaaaagatttcaagatgtatattttgtaaggcaaagcctatactcatagactttgtgaaggacctggttggggagacaggagaaaaaatggatgggaaaaaagtagtaagcagttttactgtgtgagatattagtgggcgagataacattgaagcagtgcttgattaaataccaaatgaagttccaatggtagctgagagaagggaggggagagaccatttcagactggggcctgtgttagtctgcttgtgctgttgtagcaatgtagcacagactgagtggtttaaacaaaagattgatttcctcaccgtcctggagtctggatatccaagatcaaggtgtcagcagggttaatttcttctgaggactctccttggcttttagatggtcactttctccccgtgtcttcatggtcttccctctctattttgtctgtgtctctaatcccttatacaaacaccagtcaggctgggcacggtggctcacacttgtaatccccacactttgggaggctgagacaggaggatcacttgaggtcaggagtttgagaccagctggaccagtatgttaaaaccccgtctctactgaaaatacaaaaattagccaggagtggtagctcactcctgtggtcccagctacttgggaggcaaaggcaggagaattgcttgaacctggggagggtgaggttgcagtgagctgagatcataccactgcactccagcctgggcaacagagcaagactccatctcaaaaacaaataaagccggacgcagtggctcgcgcctgtaatcccaacactttgggaggccgaggcaggcagatcacttgaggttaggagttcgagaccagcctggccaacacagtgaaacctcatctctgctaaaaatacaaaaattagctgggcatggtggtacacgtctgtagtcccagctacttggaaggctgaggcaggagaatcgcctgaacccaggaggcagaggttgcagtgagccgagattgtgacattgcattccagcctgggcgacaagagcaaaactccgtctcaaagacagacaaacaaaaaacaccagtccctggatttctaactgcctcattttaatttagttacttccgaggccctttctccaaatgtagtcactttttgaggtactgggggttaggtcttcaacataagaatttgagggaaataaaactgagcccatagcagggtaataggaaaggctttaccaagttaaagctgggattggaaataccccatttctgtgattaaaaaatgtacctttgacatttctgaaatcagtatatttctgaccttcagggtacagtttaaaaaggcatactgccctggttttaccattagtggttgaaaggatggacagtacagacttctactgggaaagaggtcttagtgttagatgcatcagcttcttgggtcaggggcaagatttttctctaagttgcctatcggaattgaatctgccttgcctgagcctctcctttcagactttcttccctctccccagccatcagtgacctttcagtcttcatcccaggtcctctttcttcctctgcctcagagcctagttaattgcttctattcagtgaaattagagttcaagagtctgggactgggattccttctcagagaatgcaggagtagaaggcaaacacatctgacttcttgcttacgtcatagaacattacaggatgctgtggactgaattgtgtcccccacgaattcgtatgttgaaaccctaactcctagtgtgattgaatttagagtaagaaagtaattaaggttaaatgatgtcatatggcatgtgaaaacacagccagaagctggccatctgcatactaccaggaactgacttgccagcctccaggactgtgagaaaataaactgttgcttaagccatcagtctatggtgttttgttaaagcagtccaagctaactaacacacagaggtacgagtccctctgaaaattgtcagtgttccttcagttctctttgggtcaacttcagtctaagaataggtcttaggccagtcaagctgtacccctgacactgaggatggttccactaattcgccatcccctaattcaggagggggaaggatagatacgtgaacaaaattgagatccttttgagaaggaagaggaagggaatcagtgctgggcgcacatttagcaatgtccagatgcccatatgcgatacgaccatgatatgatcttaggtggcattaattgaatactatttagaaggaggaaaatggcctttttctactcccagcagttgagaccaaacttgtagtaggcacaaggagaggcagcatagagggtagaggctaagcatgcagggccctggagattggctgcttgcattttaatactgtctttcacatcctagcattgtgactttgagcaggatacttctgtgtctcctcatctccaaaatggagaataataatagtaacctagctaatgggattactgaagattcaagtaatacaattgaaatgctttaaacagagcctggcacataaatactaaataaaaattggtgtttataattagtctgctctgggaaacattctttcaagaagcatacagactaagtgcaacagatttagagaatgtgactgaaaagggaaggggacaagccatgtcatctaagtgaaggctgaaggagccaggggtgttaagactagaaatgggaaaacaggatataaaacatttgacacatctggaaaagtctcatattgtttgttgtctgttatgtgtgttttgtgtgactcagaagtagataagacgaatagtcctagaaggaatgcagaagacagtgagatggagttgagagtgtgatttcacagtcataaagactcaagtctgaattccagttctgtcactgattagttctgtgcccttggaggttttactcacattcatggaacctcagtttgtctgtctgtaaaatggaaataatgacttctgctgtttggttgagcgaggtgatggggatggttcatggtgaagcagaaaggtactaccagatgagtttactggctgcgatctggccctcaactttgcaggtctaaacttttgtaattacccagagatgagcttggtggcagaccgacactaatacctctttcagggttgtagtgggttgaatagttagtggccctcaaaagatatgtcagcatcctaacccactcaactggtgaatgtaaccttatttggaaaaagggtctttatagatgtaattaaggaacttgagatgatcctggattttccaggtggacactaaatgcagggacaggtgttcttaagggaggaagagcaggcagccatgggaagacagcaagagaatggaggtatgcagccataagccaaggaacacctggagtcaccagacactggaagaagcgaggaaagattctccctagagcctttggagggagcgtggccctgctggattttcaactttaccctccagagctgtgagagaataaatttctcttgttttaagccaccaagtttgtggtaacttgttagagcagcctcagtagccactaaataaagtccagttgattagggaaatctatctggcttaactaatgataaaaacaaatttaagaaaataattcctttgggaggccaaggcagcaggattgcttgaggctagatgtttgaaaccagcttaggcaactaagcaaaacgccatctctgcaaaaataaaaaaaaatagctgcacatggtagcacatgcctgtagttctagctactagggaggctaaggtgggaagattgtctgagcccaggagttggaggctgcagagagctgtgatcgcaccattgactccagcttgggcaatagagtgagactctgttgctccaaaaaaaaaaaaaatagccatcagaagaaggtgttgttaataaaaaccagataaactgggtttggaaaagaatattttgccatatgaatccatccctgtccaggtgaaagagatgaggagcctagagacgaaagattttggttactactgaagtgttctgttcagtgggtcatggacgtttcattattaggctgcttcctggtctgagtgaaatctcttcaagacgattcctttctttgctgcagttcagcatttatcaaaaaatagccaatggaatgccagtgctgagaaatgctctgaagtaaaagtattccatggttaaataggctcggggtgtcgtatctccccagtcttagagcttcacaagcacatcatcataggagccaagaagttatgacataaagctgtttgaactatttaatattttcacaaatgtatttgagcccaggacctttgtatagcaaaataataccacattagaaacattaataattacatttcccaagtatcctggtatggggaaagaatgccctggttaagaaattcaagacaataaaagctgagtgcggtggctcacgcctgtaatcccagcattttgggaggccaaggcgggcagatcacctgaggtcaggagttcgagaccagcctggccaaaatggtgaaaccccatctctactaaaaatacaaaaattagctgggcgtggtggcgggcgcctataatcccagctacttgggaggctgaagcaggagaatcacttgaacccaggaggtggaggttgcagtgagctgagatcgcgccagtgcattccagcttgggcaacagagtgaggcttcatccccctcaaagaaaagccaaactaataagattcaaaatgataaaataataaattggtgtttttttatactttgccctatagtagtttccttgcctcttccagcttctggtggctgccccagcattcctgagcgtgtggctgcgaaactccagtctctgcccccaccttcacatcatcttctccatgtctccttaccttcctttgcctctgtcttgaaaagacactgtgatggcatttaggacccacccagctaattcagtgtgttctcatctgcagatccttgatcaagtcacatttgcagagacctctttttcaaataaggtaacatttccaaattcctgggattaagacttgatatctttgggtggtcattatttaacctactacaattgggcctatccctaggccatgccagcctgggtgataaagcgagactctgtctcaaaaaaaaaaaaaaaaaaaaatctttaattgctgaaaagcatgaaatgtttcctttccgtccctgaattttctcatgtcatttttttcactggaatgccttctccctcttctttgtttatccaaattctactttatcttccaaagcccatctcaccttctccagtaagtcttccctgagtgctccagcttttgatcagctcctcctcagaatcctctggcaccaccggtatcattcttctgagccctcttcatgtgcattgtcttggcatttaaagtaggagtttgtgtgtacatgaacacgagtatatgtacacatgtgtgatcttcccatttacatttaagatcctcgagcagtgtttttcagctttgggctcctctggtctctggggattacgaagaggtagtaatggcttcattacagcttatcacagggacactgctagagatgtaaaaatgagtgagacatggtccctatctataggaaattcagagtgtgggacgggctccagtcatagaaacagaatttcaatacggtatgctgagagctgtaatacagacacgcacaggatgcagctgtaggtgtgtgcgcttcaggaggtcttcttcagaaagtttatcactggtcacatgtttatcccacaacgggttttcacattttaattagaatgtcagctttttctcttggttggcatttttttcaactcagtatgatcattctagatgtttcctgctgatgaaatttgattgacattttgtctttgatttaaaaaaataaaaaaaatgatgaagttgtaagctaataaatgcagtttggcagatgaaatctttaaaagcctgggagttcattgggtaaaagtataaaagttgtccaaaaggaatcacttctctagaggtgaatgttttaaacttaacttgtgttatgcatgtggtagttgtttgctagagtctgggttgtgtccccccaaaattcatcttttgaagtcctaatccctgtacctcagaatgggattgcatttggagacagggtccttaaaaaggtaattacgttaaaataaagtcattagggtgagcgctaacccagtatgaatcctgtcttcttaagaagagtgaatttggatgtagatgcgtggacagagggaagaccatgtgaggaggcgtcggcaagccgaggagggaggccttagaaggaaccaccctgctgacactttgatcttggacttctggccaccagaactgtgagaaaagaaatttctgttatttagccactaggtctatggtagtttgctgtgacagccctagtactaacattttgtttaataaccgttttcttatatattggctctcagggcccttcatagacatcttgccctggtccgtttactcagccttctgtcctgacagtccctcacaccttctatgcccgctgacctctcagtgttcactgaatacatcctgcctttgaatgcctccgagtccttcctgaggattctctctgcctggattgctgtttcttctcctagttggacttctttgaaaaccttagtcaaatgtgtgctctggggagccttccagggctcccaggctgagttagaagttttttatggcattgtattttcatgaaagtgtctcctcattagacagtgtgctcctaaagtataggacttaggtctgattcatttttgtacctctagagccaaacatggtgtattagtttgctcagactgccattattaatacaatatcacaggctgagtagtttaaacaacgaacatttattttcttacagttctggatgctggaagttccagatcaaagcccagcagagttggtttctagtgaggagtctgttcctggcatgtagagagctgccttctagctatgttctcacgtctttcctcaatgcatatgtgaagacagaggtcaggccagggggagggagagagggctctctggtgtctcttcttataaggacagtaatcccacatgtggtcaaggccctacccttatgatctaatttaaccttaattacttccttattggtcctatctccaaatgaagtcacactggggattagggcttcaatatatgaattttggggggacacagttcagcctataacacatggtcaatcatgatttaagctgatttggaaaaaattaagtctcaattgttagtgaacaccagtctctatattgatatgagctattggcaaataattctatttgaataaaaagaatattttgaataaaaggtagaatcaaatattgacaaccatgaacacacgtggaataagatactctaggattatattatctacataattatatatgcagagtccttgcaccaagttgtattaggcaaggatattacaatcactctcattggaatcttccagaagaacatattacgtttcagatgtttataatagcaataagccactcagtctctgactcagcttaactattttcataattgttttaagctttaggctcagaattttttgccagcaaaactcacacttgacaaacacagactgctgaatgcaaaacaagtttttagtatttacaattggataaacttgatatgaaaagaacaacttagagcttttttataaatacagactagaggataagctactgagtaaagttctatatcatagagactaatgaaatcccaatttagattttattttaggttggttttgtagtgaaaaaccaaccttcaaagaaaggagtaatgttcaggtgtgcacttaagaaaccaaaataatctaagtgaaatacctaatatataaggccgggtatagatgcttctcagcttacgatgaggttatgtccctcatcataagttgaaactattataaacctaaaatgcatttactacacctgacctactgaacttcatagcttagcctagcctacctaaaacttgctcagaacatttacgttggcatacagttgggcaaaatcatctaacacacagcttatattaaaatgctgaatatctcatgcagtttattgagtactgtactgaaagggaaacacagaatagttgtataattactcaaggtatggcgtctactgaatgggtactgcttttgcatctttgtaaagttgaaaaatcttaagtcaattcattgtaagtcagggaccgtttctaccaataatttagagaccttgagtatattagggtacactgggttggcatctacatagattctaggtggagataaaatcctgacagctgtatagtttcatgattatgattttcaggtgaaatatacagcctgggagaaatgtaatgtttgaggatatcggagatacggtgcctataattactacacaaaaaaacctaagagggcattagtatattagtttttatcttcaagtttaccttactcttcatacatgtcactgatgctaagatctgttaaatgaaaattctggaaaaaatgaatatgatcattgtacagtgtatgaaccttgatattgtggcctagaagatattataaaacaagattgattctaactgaaaagcttacacattctctaagctccaaatcagatgtcgagggtaggagcacttctggaatagtggataaagacctgagaaaatcaacaattccataaaagcaacaagaccaagcaagatacatgaaataaaaagcaacaactaaagggagaaatgcaatacccacttttcaataatagataaaactaccaggcagacgatcaacaaggaaatagaagacttaacactataaagcaactagaccttatagacacctagagaacattccacccaagaacatcagaatacatactcttcacaagtgcccgtaaaacattttcaaagataggccatgtattaggccataaaacaagccttataaaattaaaaggattgaaatcatacaaagtatgctctcccctcacaagggaattaaatgagaaattattaacagaaggaaagttgggaaattcacagatatggaaattaaacaacaaactcataaataatgaatggttaaagaaaatcacaagggaaattagaaaatatttggaatgaattaaagtgaagacataacaccaaaacttacgggaagcaataaatgcagagcttagaaggaaatttatattaataagagatctcagtcacaatgtcttgtgcctataatcccagggacttgcaaggctgaggcaggaggatcacttgagcccaggagttggaagctgccatgagctgtggtcacaccattgcactccagtctgggccatagagtg

SEQ ID NO: 5089 - DNA, 2975 bp, Homo sapiens
acaaataaaaacaaacaaaagaaataaaaaattcccagagtaacaaagcaggaaataataattctataatccaaaaaacactgggtgatccttcagttggagagaggaggagtcagttaagtagctcacacagtagatatggacaaaccagagttgaggttggttgatgtggcttctaggagttaagttctccacctaaggcaattaagggataattaattgttcttgagggataattagtcatcttgaaaaaaggaaaaagtttgattgggagaaggcacctagggagggaggatggtgcatcacttaatattaaattgcctccctacactatgtggctgagtgtcatggaccttcctccctctctgcgcctttgaactcccactgttagcaaagctggaaagcacacacttgtatctcattcttacaggcatgtgtactacccctcagggtccatagctgttcagtatggcaaagggcagacttgctttctcttccactttgctgccttgatgaggttaacatactggaatgaaagaggagggcaggacatctgccaaagtgcaaggaataagagttattgaaacaattgggaaaaggattgacacttcaggaagctgacctcgaagttgacctcgaactgttcactggtatttaatctgatgcttccctcaagtcctgaatactctttctggaagcagagaggtgaggccaagagttgttctggctcctccaggccacccctccccccccccagggcccatcaggtaagtgcctgcagaagctagaggcaagtcccagctctcttgtatagctgatgtatgccctgagacatactccatttgtaggattctcctgtgctccaattcaccaaattctgctgatggctcagagcagggtaaagcttctcctagataatccctcccccaaaattgagtcctcggggacagttatttattgaataacctccaggttatctactttgggaaatgcagaaatgctataaactgaatttttttccagcagtggcagaagccagacaccttgaagtcaattgtccttcattctccagagttcccaagtggcatttcagagcacaggaattcactcttccacccagatattcctctcacactgagtcacgcaccccagtttctagcagcagatatcttgaagccaaccaccctaatgaaaaatgcgggtttccacaccagttttccacaccagctctccaaccattaagagtacacatgcccccatggcacacttgggttatcacaataaaaatacgtttatataaagtaaaaaacataatgtggagcaaatatatacatatacatgtacattgttagagttcaagtgaatatacagtttttaagtgtgtaaataaatttcatagcactacaaaaatacaagtcatctgagagacgtttacagtggtccccaaaactataggagagaataaaataaaatagctataggtaattaaaagctaattagataaatcaagtcacagtttcatccttcagattaaggtgctccaatataatccataccacagcaaacaaaatcctgaagaattctgctgccaatcatcttgcctcttaacctcaatataacaagaacatacataaaagagattaccgatttagtaaatgctatcatctcataccccattcacaccactggcctgtgatattcttcccctgggagagatgtcaagatttaatgagattctatcataacctgtagaaaaaatgagcaacatggaaacattccaattccagtcttaggtgagttccaatgaaattacctgaagaactgaactagtgcttttagttaaggggaaaagtgccctagcttttaaaaaatatgtctataaatctagttttaaaaacatagcaattggctgcatgtggtggctcatgcctataatctcagcattttgagaggccgaggtgagaggactgcttaaacccaggagttcaagaccagcctgaacaaaatagggagacccccatctctacaaaaataattttaaaaagctgggcatggtggcatatacctgtggttccaggtacctggagggctgacgtaggaggattgcctgagcccagcaggccaaagctacagtgagctgtgattgtgccactgcactccagcctgggcgaggagagcaagactctgtctcaaaaataaatacataaaatacagcgtccaaaagtgtgtcatcttctttctcttcacaattttataataagggggtaaaatgcctgtgagtctattcattatggaaaataaaaaagaaacaaccatttaaggctgaggcattttggttttctgctggcttttagattattaactgcattaagcccctcactacaacttcaccagtatcctagaaacaatttgggtttccttttaggcagggacaggaagtattcaaaggacagacatatggacagagttaggcccttcagggttgaagtctgtggtttcttgtgtctcaagactcaatgtcttgagaagttggtggaccctgtcctccatccaagaagtgctgccaaggaaaccaggggacctagcaaagagtcaggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctctaaacattttggctcccattaaaaaaaaaaaaaaaacaaaaaacaaaaacaaaaa

SEQ ID NO: 5090 - DNA, 1237 bp, Homo sapiens
gcactgttctgtgcttacaaagacagagctttcaaaattaaaatgtgaaggttgataagaacttggtttttcatgactggatgtgaaaaatcttagtacattcagttttcttgtccatatctttaaaagagagggcagccttttccttaagtgagttcatgataaggggggcaagtgcacttgattcattgctaagcaggtaataaatttgggtagatggcctgtcttgtactgtgtacaatctctataggtcaggttttccaaacatatttagcattccacttatggtaagaaagaaatgcatgcacacaggtagtatggcaactttatattgtgttaggtacttataaaatctgtcttaaattttaaaataattgatttcatttactcccatattctaggggacagtaatgagctttgaatatttaatcatttgattgacaactatgtattgcacagatactgtactaaaattacagcaatgaacaagaagacaagacacatggaccctgcctttatggcccttcgctggtactgggaagacaaagataataagacacagtccctgctgtgaggaagctcatgcactgctgaagaagagattcacaaaaacaaagaatcacaatgtagacaaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcagaaggggaaccaatgaagaaacatttatctgaagttcagcagccccttcaatttaatgcctaattttttttctattgcattcaaataaagttaaatctaaaacttgtttgctggccgggcacagtgagtcacgcctgtaatcccagcactttgggaggccgaggcgagtggatcacttgaggtcaggagtttgagaccagcctggccaatatggtgaaaccccatctctaataaaaatacataaattagccgggcgcagtagcatgcacctgtaatcccagctacctgggaggctgaggcaggagaattgcttaaacccgggaggcgaaggttgcag

SEQ ID NO: 5091 - DNA, 4150 bp, Homo sapiens
tgagctctgccacccaggacatccccctggcattgactggcatagtgagcttttccacccaggtgggccccctggcattgaccgacatagatgatgagactggaggaagacttccattgggcccacttttcctgggccagtgtccatcagccaggtgctcagcccctggtgtactgaagctccagcctttcctggtgccccagtcttctgcactaagctgtgtgagctcttccacccaggagggccccttggcattgactggcatagatggtgagacgggaggaagacttgtgttgggcctgctgttcctgggccagtggccatcagcctgttgcccagcccctgaggcgctgaagctcaggcccttcctcacaccctggtctcctgcactagctgtgtgagctcttctgcccaggtggggcccatggccttacacgacataggagcacgcatttcttgaagtcctgcaaaggtgatggtggtccagacaggagagggttccttcagcccaacatagcgcagctcccagctgaaactcggaaggctggtcaggcctcgaggactgcccaggccacatgagggtttggtggccgggagggccaatgatgctctgcgtctgtgttggatcagtgttcttcatggattccatcacatggtgagccttgaggaagacttgtattgggcccccacaggccccaggccagtgtccgtcagcctggtgctcacccccagtgtgctgaagctcagaccctccgtggcaccctggtctcctgcactgagctgtgtgaacttttcctcccagatgggccccctggcattgactggcatagatggtgagaccggaggaagacttgcattgggcctgttgttcctgggccagtggccatcagcctgttgcccagcccctgatgcgctgaagctcgggcccttcctcgcgccctggtctcctgcactgagctgtgtgagctcttctgcccaggtgaggcccatggccttaagcggcataggagcatgcatttcgtgaagccctgcaaaggtgatggtggtcccggcaggaaagggttccttcagcccaacatagagcagctcccagctgaaactcagcgggctggtcaggcctcgaggactgcccaggccacatgagatggtgagtctggaggaagacttgtgttggacccccacaggccccaggccagtgtccatcagcctggtgctaatcccccagtgctctggagtttggaccctccctggcaccctggtctcctgcactgagcttgagctcttccacccgggcgggcccccggcattgactggcataggtggtgagcccggaggaggacttgcgttcggcccgctggtcccagtgtgtccggaattggtgggttcttggtctcactgacttcaagaatgaagctgcggaccctcgctatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttgtaagacatgctgccaagagatgtgccattctattataaaagatcagtagcttcctttaccgacgtgtatattctatctagaacattgagctatggaagactcccacctaagggaattagttttacaccttcagataaagactgctgagaagagcaccctctggtgttgtcacagaggcaagtgctaccgcacaggcatgctgcagtgaatttaactgatcctctgtccctgcaaccgttgtttaaggatgctattctgaaaagactgtggaggaagaaaaccctttaccctgttgttcagggagaaactgacaccactcaactgcctggcactgaaaatgtggcatccagtccactttaccatcagtgtttaaggaaaccatctctgataaggatgactgaggaagagtactctttggcttgttgacaccagcacagctgacacacccagatatctgtttggtctcctgtgaactttcaaccaggatttaaggatgccactctggttaaaagctgaaacaacttcaaggaaacttcagggaaaagagaaggcctggaatctgatcctccacttcagagaacaggggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatc

SEQ ID NO: 5092 - DNA, 2359 bp, Homo sapiens
aaaggtagatgcaatatatttattaggatttatttaaccaaacattgatgattactacgtgtcaggtactattccaagtatttataaatataactaatttaatctcttcttcttccagtctttaaaattaactaaaatcatttttttaaaaaagaggccacaattttttcttttctgtttatactacttcctaagtacttagctagaccttctagatgtctggatatctggccactcttttggttcttcatatatgccatgctctcttgtgccttagaacctttaagtttgctgtttcccctgctgggaaagttattttaatctgtcccttttcttatttaattcctgctttttcttcagatctcagttcaaccatcatctttgaggcaaaaatttcaacttctttatctaaagacaagtagagggctacaatagcatattacagaaattttaagagctgtgcttaatccactttgctcaccttgaatctctagtcctcagatagtggttcttattttccatgaaatgaggaaacattgaagggtaatggggaatggcttaggttatgttttaaaaggatcactctgactgttttactgagatgaaagtaggggcacaaaagtggaataagaaagataacttatgaggctaccaataatccaattcagggctgatgatagcactgacaataaaaagtggtcatatttggagtattttgaaagcagaaccaacaaaatttgtattgggtgtgaggtgtgagagcaaggagtaaagcatgacttcaagattttgcctgagcaactggtaggatgcggttgtcatcagctgaaatgagaaaacctgtgggtgcagctagtttgagggaagagcaagatttctgtcttgaacataggtttgagatgtctatttagacatccaatagagatattaaataggcagctggaattcaagaaagcctggaaataaaagataaaaactgcaagttggcagtacattgatagtacttaaagccatgaaactggatgagatcaccaagagagtgagtataagcaaagaggcaaaccgtggactgagtcctcaggtgttttaatgtaaagagattagggagaaggaagggatcagcaaggagactgagaatgactagtcaatgaggcagaagtgtggtctttcagaagtgaaatgaaagtatatcaaggagaaaaggagtcaggacaaatagctggtctctaaatcaatgtcattaaaaattttaaaaacaaaaccactcacttaaaagctctacagggtataacagctagataagacacatagacctagatttaatactgctttagaaaaaccagtggtaaaaaacgttttgaggccaaattggtaaatttagctttagtattagagatgaaaacactgaaagggaaagctcaaggttgctgtttttttttttttttttaaaggtatgttctcactctgtcaaccagactggaatgcagtggcatgttcacagttcactacgaccttgacccactaggctcaagtgatctttccacctcagcctcccaagtagctgggactacaggcacatgccaccacacctggctaaatttttggcaaagatggggtctattgccattgcccagccgaactcctggcctcaagtgatcctcctgcctcagacttccaaagtgtaaggattacaggagatacataaataacggttggcatttgggaggcctcaaccattcctgaggtactggtggtggcagttgcaagtatcttttgctgcactgaaggaggcaatgatgacgctggtacagatttcacttcagcatgggctggaatctgtaaatgatgcccagaaggcaaaactggagacttcacagtcactggaagactctgggtattaactacaataaaagatgagtctttttgtgttgagggaggaacagcaaatgtttgcatggtgagtccatcaattttcacaccatgactctgaactttagaaactgatgaagaaaaatttccagttcccacagaagtaactctacctttttctgatgtatctactgttcttgtaagaaaatagtttgaagaactggctggctgaaaaatgggcaattgaactgatgcacttgtggaagagctggaaatctgagtctgaaaagtaacttgaactggttttcctgtattccctttcaaagcatcagacatgactgaagattgaactagtggtataagatttccagaagacttaggaattggaagtaattgcagaagattttttccatccgagccaatcgtctgaactacttggtacatgcagcctgaaacacttaaaagaacattgagtaaataaatacaacat

SEQ ID NO: 5093 - DNA, 5587 bp, Homo sapiens
cctccttcctgctcagcccaaaggcaggagtcatggaaccccaggaaaggacggaacagaacaggacagggcccccagccccatctttatctcaccggctgctgctggctgccaagcctcccctgaatgggggagggtggtctgtgtgagtcagcggaggcacgaagtggaggaagacgggagcctctgccaggcccgttgagcgtggcctcagaaatgcgccgctgggttagggtctccccgaccgaggctcgaatccaggtcgaagggtcgccggagcgatggttggagaatgtggaaggagctggaggacacccgagtattcttaaagcaatccccatggtgagtaagaaggggagctcggaagcatcagggtaacaatgggattggtttggggtctggttccttccaccttggaaccttttcaagctaatgaggagggaggagagtataacgaagtaacagaagaggttacagagcaggtttgtttgccagctaaagctaaagcggcaaaggagggagacgttcatccctacccttctgcaccccctacttattattttgaagaaaaagggcggcctgaccctccagatctttcttttccggaggatactgggcgaaaagtagttgctccagtgactgagcagcacctcgagcgacctctcttagttctattcaggcaggaattcagcaagctagacgagggggtgatttagaggcttgacagttccctgttagaatacaccccccagatcaacagggaaatattatagctacatttgagcctttcccttttaaattactcaaagaatttaaacaagatattcatactaaaaaagaatgtagaaaatatcaaagaaaactgctgagcctgaaatatgtccaaaatgtaaaaaaggaaaacattgggctaatcagtgtcactctaagtttgataaagctggaaacccaatttcgggaaatgccatgaggtgcccgtcccgggcccggttctaaatcagggcatttccagctgaggcccttccctcacccccgtacaatgtctgtcccccgccgcagccggtagtgccgcagtagattgatgctgcacgaaagccgtgagctttctgccaggggaacacccgcgaaaggtctcaacaggagtctgtggacccgtgccagcggggcaataggattacttttaggaaggtctagtttaagtttaaaaggggacaaatacatacaggagtcattgattcggatcacgatggggaaattcaaactgttatatctacttctgttccctggaaagcagagccaggagaatgtgtatcacagctcctgattgtgccgtatgtgggaatggggaaaagtggaactaaaggaacaggaggatttggaagcacaaataaacaaggcaaagtggcttattgggtcaatcaaattgctgataaacgtcctacctgtgaaataactattcagggaaagaaatgtaaaggtttggtagatacaggagcagacatttcaatcatttctctacagcactggccatccgcatggccaagtcaacccgctcaatttaacatagttggagttggtaaagcccctgaagtatatcaaagtagttatattttgcattgtgaggggcccgatggacaacctgggaatattcaaccaattataacttctgtgcctataaatttatggagaagagatttattacaacaatggggagcacaagttctaactccagaacaattatatagccctcaaagtcaacatatcatgcatgaaatggggcatgtccctggtaggtgactagaaaaaaaatttgcaaggtttgaaagaaccacttcaattggaaagacaagttcccgccaaggcttaggatatcatttttgatggtggccactgttaagcctccagaacctacacctttaaaacggttaacagaaaagccaatttggatagaaaaatggccgctaagtaaatagaaactggaggctttagagaaattagttactgaacaattagaaaatgggcacatagcgccaacattttccccttggaattctccagttttcataatttaaaaaaaaatcaggtaaatagaaaatgttaaccgacttaagagccattaattcagttacacaacctatgggagcattacagccaggattgccttctcctgctataattccaaaaagttggcctttaatagtcatagatttaaaagactgtttctttactatccccttagctaagcaagactgtgaatggtttgcatttaccattcctgcagtcaacaacctgcagcctgctaagtgttttcattgttttacagatgggtttagtaatggtaaagcttcttattctggctcaaaaagtagttttccagatgccttataaaaagcaaagtttgtagctgtaattgaggtattgactgcttttgatagcctattaatgtgatttctgattcttcatatgtggttcattccacacagttaattaaaaatgctcagttactatttcatacagataaacaactgatgacaaaaacaaaaaagggggagagatagggattatgggacagtccatacacaattgaatctagcattattaactttagattttttgaacctgcccaaaggccagatgtcatcagcagctgaacagcattccagaaaccagctgcaaagacagaagcagaacaactggtttggtggagagatctgataacaaaaagttgggaaacaggtaaaataataacttggggtagaagttatgcttgtgtttctccaggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgctgtgagtattccttcaacaagggctgacacacagaacaattatacttattgggcatatttatcaaccttggctggcaataatgcctagatgtaatcactctatgacacagttacacatgctttctgatctcagtatttaccataatctgctcctataattgaggcataccgcccttaaaaacctatttgtaaacaaaattgaacctggccagaaaaaatgaacgtacttgtttaggaagattgcattgcagaacaggcagaggtgctgcgcaacgattcctatggaatcactgttaattggtcccctaaggggatgtttagcttaaattgcacctctcagcctgcgtgccacggccacactatgtgcagctggtctgaacaaaacggtcagatggtagaaacaataagaagtatggcaaaagttcctattatctggaaccatgctggtatagtggcacctcaacctcaaacgataaggcccgctgtaggagctaaacattaaggatttgtagaaactattaatagctcttaataagatcaaaattggggaaagaataaagcatctagaaggacactctacaagctttttggatacagtaaaattaaaagaaaaaatatttaaagcatcccaggcacacctgaccttaataccagcaactggagtgcttaaaggaactgcagacagatttgcagctagtaacccattaaaatggataaaaatacttggaagctctgtaatttcaatgatgtgattgtgcttttaatctgtgttgtttgtctttgtatagtctgcagatgtggatcctaactcctgcgagaagtaactcacagtgacaaagctgcctttgcttttatcgagttgcaaatcaaagaaggggggacatgttgggaacaggccccccaagatctggccataaactggccccaaaactggctataaacaaaatctgcagcactgtgacacgttcatgatggccgtgacgcccacgctggaaggttgtgggtttaccggaatgagggcaagggacacctggcccacccagggcggaaaaccgcttaaaggcgttcttaaaccacaaacaatagcctgagtgatctgtgccttaaagacacactcctgctgcagataactaaccagacccaccactttacttcggcccatcccttcatttcccataagggatacttttagttaatctattatctatagaaacaatgctaatgactgacttactattaataaatatgtgggtaaacctctgttggggctctcagctctgaaggctgtcagacccctgatttcccacttcgcacctctgaatttctgtgtgtgtgtctttaattcctctagcgcccctggtttaagatctccctgaccgagctggtctcagcaagcagagggtgcccctgcaccaggaaaggggggcacaggaaggccctgcaagtgcagctgcagccaacaggaacagcaggacaccttccagaggacaggacatcgatgtcatctgtaacttccagtgcactgggacacacagctgtatctccccatgctcgcctcctgcccctcccggtgtgaggacttagcctggatcacctcctccaggacaagaacgacctaccggcatctatccatccaatctccccacccatccatcactgcctctgtgcatgcatccttccaaccattcatacacgcctctgtgcatgcatctgtctgtctgtccctgcctctgtgcctgcatctgtccatccatccctgcctctgtgccagtatctgtccatctatccctgcctctgtgtatgcatctgtctgtccatccatccctgcctctgtgcctgcatctgtccctccgtccatccctgcctctgtgcatgcatccttctgtacatccctgcctctgtgcattcatctgtctgtccatccctgcctctgtgcatgcatctatccatccattcatccttgcctctgcccatgcatccgtccatacatccctgcctctgtgcatgcatctgtccatccatccatccctgcccctgtgcatccatctatccattcatccctgcctctgtgtaggcacctgtccatccatccctacctgtttgcactcatctgtctctccattcctgcctctgtgcatgcatctgtccatccatccatccctgcctctgtgcatgcatctgtccatctatccatccctctctctgtgcatgcctctgtccatctatccatccctgcctctgtgcatgcatctgtcatgctatccaaccctgcctctgtgcatgcatctgtcagtctatccatcctccatccctttctttgtatcagcttatcctgtgctgagtgctcacaactccttcatcctaagacgctcattggacctattccctcccccgactccacgccgctctctgccctcccttcctggtcaagttctccagccagtggtctcaactcaatcttctcttcctccgctcctctcatgcctaagcccactgccgcctaaattcttccc

SEQ ID NO: 5094 - DNA, 6372 bp, Homo sapiens
ctcccgggcctccggatcctggctgggagccatctctgcctcctgccgcttcctgcactcctgatcaggtcagtggccagtcacagacctctgaaatgtccttcctgactgttagctccacagcattcctacagctcccgccgcagttccgccctccggagggttccaacagcagcccagtgcgcctccccagccccaggctccctccactccagtgagcctgcacctggcgctccctggcacacatattttccattgctcttcactgccaattaaatgcaaatttctcatcgtggggttccaagttctctgtatttggtcctcttatcctgacagctctaccctccccagagcactacaatctggccaagagcctcaccagcctattcccccgaaccattgttttatttattttagattcaggggtatttgtatgcaggtttgttacataagtatattgcgttatgataaggtttgtgcttctgatgatgatccagtcgcccaacatagtaccggatagttaggttttcttccattgcccccctctccctccttccttttggggtccctggtgtctgttattcccatgtttatgtccttatgtacccagtgtttagatcccacttataagtgagagcatgtggcatttggttttctgtttctgcattagtttgcttagaataacgactgccagctgcatccatgttgctgcaaaggacatgatttccttgttttttatgactgcacagtattccatggccaaaaaaatgtggtataaaaatatgtaccacatttttttaatccagtccacagtcgatgggcacctgggttgatcacatgtcttcactattgtgaacagtgctgcaatgaacatacgtgtgcaggtgtctttttggtaggactatttatattcctttgggtatatacctagtaatgggattgcttggtctaatattcattctattttagatctttaagaaatctgcaaactgctttccacaggggctgcattaatttgcattctcaccaaagtgtgtaagtattccctttctcctcaacctctccagcatctgttattttttgactttttcataatagccattctgactggtgtgaaatagtactttattgaaaccactgctttagaaagtgaaagtccttttcaggtttgtttttcattcactggcagaggttgctggcccagcaggggttgtgcaaactctgtctttgttcccctgtatttgccttcctctccctttttccttcctttccctttctcaatacacacacacacacacacacaacatgtacagaagggctcttatctgaaataatcaataaatatcaaggacgtgaagatgtcatgcaaggagcaaagggggaaagtaaacataaggaaaatgtacaaaacctaatttttcaccatgtaaccagcatgggctttaaagtctacacaagacagactaccacaagcctctgcccctgcagaaactggataaatcctggagaatgactataatctccatgacacaaattcttcctcagaaggaaggatcaaggcttctgaataaaagggctaggaaaagaaattttcctgaggctgccaaaggcaagtaggattctttttcaaggtcaacaggcattagaaacagaagacatacacagtatgccagaaaattacaagatttccctctccttgacaccaaagagttaaatatagaaatgtgcatgtggacagttattaggagaaaggagaaagggaagagaaggtggcccatttcctcccttggccaaaaagaaaacaaacaacttaaataaaacaataagatgctatcatcatgaaacactgtgcatgtgttggccagtaggctattaatacacagcacagcctggagctttgctgaacatggaaatgcttccagcctttttgcaacactgcctgtatgaacactgctaaaaatattggtgggatatatatgtgtgcttgtgtgtgcatgtgtgcttgtgcatgcatgtgtgtgcatgcatgaggatgtatgtgttgcatgtgtttgtgagcacgtctcagtagatcccaacacagactgctttgaggagaattcattttcattccatccagagttgctcacaagtctgattagctgggatagtaaaagagaaaggagcagacagaaatctatcccccttttctctttatctttgagactcttggagaagcacatgccttcactctcaccccacagaacaacacacccttcagaacccactcccacaaccacacccactccattctacacaggcacatccaactgtcctcctgtctgtcttcaccatggtgaccagagcctccaccctctacttccctaaagcaaaaattggcaaagaacccaaggaaatgaatgtctttccagtgaaccaaagttttgttatgcactgtttggataacagtgtcctaacagaatacctggaagttacagaatatactcattaaacctagctgccggttagtaagcccttgaaatgcctcagggctcccatcaaagagtttctggagacagagggctaggccagtatctaggtcctgtttgagaataagatttcatttcagagaccacttgctacactgtattgagaatgtttcaggggctgaatcagtccctctgggggaaaaatgatctctgaatgtgtgtcctgggtgtggaaaggggagtggctcagattggacatcttcaatgtagagtgtactcatgcattgtctcaggaatcctcatggcttccgtacagcaagaatcaatccacatttcaccctttcataaggactccagtcatactggagtgggatccaccctaatgacctcatctccatgtggttaaaactctttttccaaataaggccacattctgaggtttgggggtttggactgcaacagatcttttggagatctttttggaaggggcacaattcaacccacaaaagtagtccttacccaaagggacctatggatgtttactcaggtggctaatcactgaggaaaggggaagtctcagacagtccaaggactactggacacaggtctgagttgacatggacacttgggtacccacagtgtcatcacagtcccctgttagagtggggccccccacggacagagactaagtggagccctagctaatgtccagctcctaatggtcctgcggagtccactaacatgctgtgggcattgccctgtttcctgagtgcacagatggaactgatctacttgatagttggattagccttaacattgggtctctggcccatgggctatgacctgtcatagtggagggcaccaaatggaaactctgaaaataccactgtcagctgaggttgtcaatcaaaaataatattgcattctgaagtggatggcagaaatttgtatcaccattaaaatcctcaagggtacaaggcagtgctattaaccatatctctgtttaattcaccagcttagcccctgcagaaactggataaaccctggagaatgactgtagtctacaccaggattaaacaaatagtaaccctgattgcaggtgctgtactagacatagtatctttggtagaaccaattagtgaggctttcggtacaaccattgacatgggagatgcattcttttccattccaatcaagaaagaggatcagaaatggtttgtatttaggtaggatagaaaacaatattaaactgaagttttgcctcagggctaaatgaactctactgccttctgtcctaaaatagcttgaggatatgtggaccacctgaatgtcccacagaacatcatgacaccttggtgatggggcagaaccaacaatagatggctatctcactagaggtcttggtaagatacatgcactagagaggatgggaaataaaccctataaagattgagagatatacatgtcaataaagtccttacggatccaatgctcagggtcattcctgaatatctcctctaaattcaaataaaaccactgcatcttgcattccctaccacaaagaaggaagcacagtgcatggtgtgcctcatttgcttctgatggcaacacatttcatacctaggaatgctgcttcagcccctatactggatgacacaaaagggtgctaactttgagtggagcctaaactaggaaagagctctgcaacaggtccgaactggagtgcaagcacacctgccactggagccgtgttatctcacggacctcatgaggttgtaggtgtcagcagtgggacaagatgcatcatagggtggaaattgtatatctaagatcaaacctaggcaggactggaggatacgcatgagtaatccacataagctggtagcccagacccccatgtcacccaccgcggctataccagcgctcctgcctcagctcatatttatggccatattggagtgctgacacactgatctggggttactcactcacatcaggcactggatgagtacagtgtcctgggctaaagttgatctatcccagaccctcaccttcagcagcatcagtggccctcacagcagctctccctcctctgtattcctacttagtggcagctgtggcctgcagcacccagaaacagtgaggtagagggaatggcaagcatccattaccctgtgctccatcaatggcactgtcaccccctctgtaggctctgtgccatgtgtcaggtagtacccagggcttgtgagacatcactccaagtttccaaccaggtatgctcttgattccagtggatgtgatgacgttgtgctctctcagggcttaggctatgccagaggagggatgaacattccttgctgaatgagatccctctagctgttccacccagggcctctggcctgtcctttcctttggtgatggagtgtagaaggcaggcgtggagttaacacagaaagatttaactttctgtgttaggcaggcatggagttaaccctctgaaaacacaggatgccagtctaaagagtgaagagaaaatgtggttggaagatgtgttcttctacctttacatcataaatttcagaacagtgcatttcatgaccagaagatgaattactgttcacatttttctgcatgctctggataagatttgcaattgtgatcattgccaatggaagcacagtaacagctttcagagggtcagtggaagccagtatggaagatatacgctggacaaggcagcctcttgagtgatgatgtaactaccattaaacacatggtatcagggaactacagaggtatgatctgtgttgcttcaatacaaaaaagtgaagaagagccacggcactgccagtaataatgacgttccatgagagatatacaagtagccagaacttttgccactaagaagaaacttcacactgaaaggacaatagataaatatgtaaatgcatcttgtctacctatcactctaaatcaattgatcagtgtatacatcaccatgcctcatgaattttgtcataaatttttaatcaaattgtttatgcagaggattcacgaaaatgagagagataatctgccctggattaatcaatgacatttaccaagctctaataagaacaagaattgtgctagataccatggatacaataaagaacaatgcacaaatggactaaatgtaactcactgtctaaactggtagcaatgcatatagacagacgcagggtgtcctgagcagggacataggaaggggtgatggaatgaacacccagcgatggttccgtactgatgttcccagttgaagtcatcaaaaaggtgaccactccacaggaactccatttgagggccttgttcaatgggacttttcagccatcctcccaatccaagtattttcttcacctattaaacttgtctttgattagctctccattggtcagagattctgtgagatacctatgaaaagatggaagtgacacttacatatgcctatcccaacagcctagctggaaatcaccaaaatgaggcaagagaacagggtttttagtgaacctttttcctgtgtgcctgttctagttgaagaatctgggtttaatagacctagaattctttataaaagaattcttgccaggccaggcgtggtggcttacgcctgtaatcccagcacttcaggaggccaaggcaggtgtatcatgaggtcaagagtttgagactagcctgaccaacatgatgaaaccccgtctctgctaaaaatacaaaaattagctggacgtggaggcacatgcttgtaatcccagctactcaggaggctgaggcaggagaatcatttgaacctgggaggcggaggttgcagtgggccgagatcgcaccattgcactccagcctgggcgacagagtgagactttgtctg

SEQ ID NO: 5095 - DNA, 682 bp, Homo sapiens
tctcgaactcctgacctcaggcgatccgcctgcctcggcttcccaaagtgctgggattacaagtgtgagccactgtgcccggtcggggtctgctttctctttattccccgtcctctcacaaactacatccaggggcggtagctgctaaaaggactcaattctgcaacctcagcttctgacaccttcaaataaattaaatgctggtcctagggctcgctccccagctcttctgatgtcactgccaggttccacagccagttgtcggacatctcctgcttcctcagccaagaacacctctcagatgagatcaaaccgcccagctttcctcttagcatcttcctttattttccacttctggctggtggaagagagatcgtagttctctattccctacattttaactccacgaatattttagattaagtgaagtcttgctgttcttcctgatggaaatggtaattataaacatacaaagatacccatacacacattctttactcagggccctcttgtgctttggcaaatgataaaaattatctctaactcacacaacgaccctggaagatctggacaatgctatcactatttcacagctgagagatcgggagcatttaaagccacagaaggaatagattggcttcgcttcatattgtttccttgtgaaataaaaccagtgaaacac

SEQ ID NO: 5096 - DNA, 280 bp, Homo sapiens
gcacacaggaagggagaggccactccgactgctctgaggtccaggtggccctcgccccggcccacccgcgcctcccaggcccagcctcacctgctgccgagagaggacagtgatcccccaaaagccggaggtggaggaggaggaggaagaggaggaaggagctggaggagccggggactcgcccgctgaagatgctcttgtcaagacaatgaatgagaagcagccgtgcgcccgcctccggggtggccgcgccccttggggcggagctcttccaggcccg

SEQ ID NO: 5097 - DNA, 254 bp, Homo sapiens
atgcctctcacaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacgggaggaaaagcaaggcttacagaaggatgttccttcaggaggaagcagcacta

SEQ ID NO: 5098 - DNA, 2291 bp, Homo sapiens
atccctcacctcctcctgccaagatcaccccaagcagaaaccaggatcataacaaactctacctcacggggctgacccgaagggatgatgcatagcagaacacatggctcagctggccagccggcaggtcttagcaggtcatagtggcggaatgaccagcccacaagtcttagcaggtcgcaatggtggatgcaggatgtttctgcctgaccagcctccattctcacttccgtttctgcctggatatgacaaatgtcgacctggagctgttggggccatctgggcagaaaggctgtccgggaatgaagtcaaagagatggaaaaagagaaaaagaggccggcgtctggggtcatggtttgagcccccgaatccaactgtacctgaagccctgtctgtttcagaaacagaaggcaataaattcagcctttgccttaagcccgtcaagccagtctggggtgcctcttttttttaatcaaccaaacaaatactggttaataaaactccctgctcaaaagctcctggcggctccttcatgcctgcagggagaggccagcaccctgggctctgggccccacttgccttcctttttgtcctgaactctggccctcatccctcccagacaggtatcacccaagactgctgtttcccaaacacaccatgaagactcgacctacagtttctacccaaactctcctccactccccacttgagcagtgcctgctcactagagcttgcctcctcctggaagcctccccacacttcctccaccactctgagtgtcagtggcatctacctccagcttcccatcactctgcttatttccccagagtgaaattcacttttttttttctttttcctcttcaaaaaaactttgtctcactgtatcatttaagaaatgaacatcctggattgacttgggatttgacaaattcaaacttggttttaacacaccatgtgcatttcctgagccccaggcgtaccagcagacacagggctgaaagacccagggcctacccgcaggggcttagaggctgaaccaaaccgtttcccatttggctcaagacaatggatgcaaaaatgaccatttttaaaattttaaattcaaatttattttacttggggataatcatcactgacactcactgagccattgctaggtcattgtctatgggcaggtccatgcataatgttatttaatcctcactctgggaaatgttatcctcacttacagaggaggtcactgaagctcagagaagtaaagggagctgcccagggggttacagcaactgtagggagctgaccctatattctagcccttgttatcctccctggcctttctcaactgtgtgcgaatacactggggccagcttcgaagtctttttaacattcactgtgtaaactcggcaccaagctagcttcccctggttgctcacaggcaggtggctgtccacacccacttctgtgtgggggcctctggcgtcacatttcacacccctgttctgtaggcatcgggtttcagatttgctgtatttgcttccgctgccactaccggtagatcagaagctggggaggtgtttcaacacatgattgttttgaatatggtgacttccccatctatccctgccatgggtaacatcccagcagcctcttgatagcagaacagaggccattgagcctggccaatgagcttgctgctggggctacctttcacccacatgcaggcttacttgcctgcacccccggcatggcccaagaaccagttctctgagttcagccaggacttccaagaacctagcacagccaggtcagctccactgtgtatgagtcctgaacccgaccctaggcccctgctccctcagttgccatttgccaggctacctcctccattgctcctaaaatctagctcatctgccacctcctccaggaagcctttggggaactcctccagataaaaactccagtgtccctcctctgggctcccacaggcctcagagctcacccccttctcagccctgagtgccatgtgtagtcatttcctcttttctagtcccttctcccacagagcactgtgaacatccccaagacagaaacgatgtgttgctcaccacagcctgggccctacagctggcctgtcacagggctggtgacgaccgaatgaaaggaaatgcctaatgttttctgagcacttgctacatgccgggcacagagccagggatgcccacatggagagggcctgcctcacagtgaagacagtaggaaggaaagcagaggtaagagttgaaaagtccaa

SEQ ID NO: 5099 - DNA, 2559 bp, Homo sapiens
ctgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagttt

SEQ ID NO: 5100 - DNA, 9175 bp, Homo sapiens
agtgcagctgcaggaatgactccctccgccggcgccaaacactaacaaccaccccctcttccccactccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatgaaaaattttagaaaatcattttctactcactattttatgcctgccagttatcctttgttagtgataaaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaactctcatttgccatccaactcattctatatatttaaataaatgtacttacacttgtgtataggatttaaaagggggaaacttaagaaggaagaaattgtgtatagaatttaaaaaggaggcattatattgcatgagtagaatgaaaagtatctaaccagaaagcaaataagttaaggattatattatactgaaatattttaatacaatttaaatatttcattactctttcactttatttgctatttgtagatttcagtattgtaatgttggcaagtctatttaagacggcattaataaaaattttgtttttcaggcatgtgataccaagtccctttccattatagataagtaaggcctaggttggttaaaaccttagctaaacacaaaatttgctagagaatcaacatataagaagctctaactccaagcttattcaccccagatatttcaccaatgttaacacataccctattgaactaagaaaggaattatattactaaccagcagagggagccaagtcaatcatgaaaggtaggagtataaaggaacatcatatgacttcctgttttgaatttaactgtatggcccctgctcactttttgagtttaccaaaaagacagtcataaggagagaaaggcgaccaatgtatcaaataaggatacagtgacaattataacttagaattaccttgcaggaaataaattggaagaaaaattgaatgcagaactatacaagtgaaatgtctcagtattataacccaagatggaaaaaccatggaaaacagtaccttaatgccatgatgaattgctagccaaatgtaacagtgaatatttcttaataattccattttcacttaaagttgaaattaggccataaatagacacattttaaaactataaagttgtacatcaaatttatgtgcatttaatctaagaaataagggataaaatttaataaaaaattattacagtgaattaataaggacatgatttttcagcttaaaattagagaacagaattgtttccactactgtttataaacacaacaaataaagtaatatctgttttgtgagagatgtttggaggaatctagtagctaagtgattatgtcagtttatttaattttgtctaagaacttcaaaatgcctgatagaatgggtgcatattgaatgaatagatgtgatctatatattatttgaagtaaaagtataagagctgagcgttagctaactgcatcaaaataaatgtaaagacccaaacatttttagttgaataaccaaatgaattagctagtctagccccttactcgtttcaaggtttgtggaaacataccatatatacttttactcatgtgtttattcctttcaaaaatatacttcttaagcactatctccataggacgtggagcatatcttcattatgaagtagacaaacttcttaaattttattgaaagatttaatttcattgatatatgaacaatcatacaaattcagtatgccaccagtgatttcaagaaagtgatacttagaagcaaatcatttatgggactagactgcctttgtaggactaacaaattaggcacaagattagaaattatagtttaatagtcatgcagctggaggctacacgattctgaccctccctaacctgctcctaagatcagtgcttgagatattctgcagaccctgcacttgatggatcagctggcaccacccagatcaataaactggctcatctgatcttgtggccaccacccaggaactgattcagagcaagaggactgcttcaattccctatgatttcatctccaacccaaccaatcagcacactctattcacttgccttcccccacccaccaaattatccttaaaaactgatccccaaatgctccaggagactgatttgagttataataaaactccgatctccagccaaaaaataaaaaataaaaagcaaattatttgattttgagtactagaaagtagactttaaactttttgaagggtatattcttttataatgctatattatactggcattattttataaattggcatttggtgtcaagtcagttaatcacagcgataatatccaagatgtacagctcatcagtcctagagacatttttttttgtttgtttaagacagagtctctgtcacccaggctggagtgctgcagtggtgcgatctcgcctgcctcggcctcccaaagtgctgagattacaggcgtgagccactgcgcccagcctagagacattttaatgccaaaaaaccctcaatgccaccagtattactacttctaattatttgtttcctttacacacgagttgtgatgaatatgggctattagaattgcataaacagcctaagcttttaaatgtttccactcatgaaaaatagctattatgaacttttaaacattaaattaataaagtgcaatagctttaccatgaactattccttattgataaacatagtaatgggttaactcatgtcaaagtccaataaaaactagtaactttgtcaccaaagtcaacatttcagcatctatgatatgtagtataggtatttctgttttatctagttttcatttaataatctaaaagattctggccgggcacggtagctcacgcctgtaatcccagcactttgagaggccgagggaggcagatcacgaagtcaggagatagagaccatcctggctaacatggtgaaaccccgtctctactaaaaatacaaaaaattagccgggcgtggtggtgggcgcctgtagtcccagctactagggaggctgaggcaggagaatggcgtgaacccgaaaggtggagcttgcagtgagccgagattgcaccactgcactccagcctgggcgacagagtgaaactccgtctcaaaaaaataaataaataataaataaataaactcaaaaaccaaacaaaggctggtgagaaaatagctcatttcttgtcttattccagagtaaggagtggtgacagattaggaaaagcatcaaaaaagtggcttccagtgaacaaaatcaggaagtttgagtaaagaatttctcttttgctaaaaacttaaatataaaagtttagtcaggaatttgtacccacacatgtatactgcttttaacatttttctctagacatttgaaatattttattttctctttaaaaaagcagcaccaaaacctaaatttaatagtaatgtttctgatttatcagcttctttccatcttacactgttgaattctgtactgcttctaaagcacctacaattaactctacaagaactgcacaattaacactcggcattgccttcttcctaattctaacatcgacattcatcagctttctccaatacagtcagatgattccttataatcatatctagccaaatgatgtaacttttgcttgatgtatgggaaaatagcttacattatgaatttagaagagctatagtagtatttgacaatatagatggaaaagtatttttaatttaaagaacatattgcacatctttcagaatttctgtaaaaacttttgaatgtccattttggctag

SEQ ID NO: 5101 - DNA, 442 bp, Homo sapiens
aacagttgaaaaatggaattgactttcactcctccaggtccagaaggattctaatacacaaaccataagcaagagttgtttctgttattttgtccacagaacagaagctgaaaaagcatattgcttgcatttcaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctca

SEQ ID NO: 5102 - DNA, 2753 bp, Homo sapiens
tccccaatggtaaccttaccttggaaactatcaaatataaatatactttaactaagccagtgacctggtcctaagttaaggattttctaaatggtatttaattgtgtgcccataaacactgattttttttaaaaagaaaacttagtaattatttgatggataacaaaaagcatctatcactaacattgcttgttcatgtaatcttctgtgataatttggcttggcatgccagtcttataattaacataatttaaatttgatgcaatttaaatataacaggagacttaaaatattttattataaattagatgccatattagttagtggagaaaaggggcattaggtattaattgcatgggtctaactacattgatgatgagagtttaattccaactagagtatattttttgtttattaataatgaaattggtgctgacatgtaatgacttcacaagttttacgagggaaaactgaaaaaggaagtaatataaattttgtggggtttttttgagatggagtcttactcttttgccaggctagagtggtgttgcaatgtcagctcactgcaacctccacctcctggattcaagtgattctcgagccttaagctcccaagtagctgggattacgggcgcccaccaccacgcccagctaattttttttttttttttcttgagatggagtctctctgcactccagcctgggtgacagagcaagactccatttcaaaaaaaaaaaaaaaaagaaaaagagactaagagactaattattttgtatcttgaagtttaaaatccaacttttctctttctcctttgtgacattagaacagtagttctataacttcattgtaagaatcacctggataattcattaaagatgcagattcagggccacgtgttcaattctgatacagtaggtcctgtaataaggcctaggaatggccatttttaaacagtacactaggtggttttgatacagatccaaggactctaatttagaggaacactaggttagaggtttctcagacctgcaaacacctaagcacctgggcaaagctacaacgaagatctgtatgaagatatatagttctgcagaatttaaaaagagcacaatttaagtcttcggccctcagaagttaaattcatattccatctaagccaactttgattttcattaagttagaatgaactcctagtattccagtattacacagaacgaagtactactactaacacatagaagtcattactgtgatataaaaagcaaaatagatccttaattaaaaattagtcactcatattcagtgttgaataagaagttaaagtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttctatatatgcaaatgacattttcatttaatgtaccaaattgtgtatctaacttttataatataggttaaacagatcctttctaagatggcattatttaatctttacttaaaactatgaaaaatatgtgtaagttattgtttataaacagaagagactataattaaaatatagagcagattccaagtgaccatcattttactttttagatttaaaacagaatgaaacagaagatttagtcataagaagatgcttgaaaaacaatccaagtatccaatgcagtggctataaaatattatttcatcatttaatcttaatcattttgaaacaaagacagacttcaattttacactgcttgcactttattttgtacagacatttcattaattattactcaattttgaggtgcaaaccttctgaatatagctttcattttggaccaaacaatttgttatggcaataaataatgatgcattgaaaaacc

SEQ ID NO: 5103 - DNA, 1397 bp, Homo sapiens
ggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacct

SEQ ID NO: 5104 - DNA, 2979 bp, Homo sapiens
taacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtccttta

SEQ ID NO: 5105 - DNA, 1354 bp, Homo sapiens
tattccgacaattatgctgttaccaataatatgattctctaaaaattctataatctgaattaacatgaccatccacagcctacttatcagcctcatcaccctattgttttttaaccaattcaacagtaactcatccaacttctcactagttttctcttctgatctgctgatgtcacccctcctaattttaacagcctattaccttttataatcctagcaagccaatattaactgttcaatgaatcacccccacaaaaaagctctatatttctatattgatttccctgcagattttttaaaattatagcattcacagccacagaactaattatattttatattttctttgaagccacactaattcctaccctaattattattatcacccgctgagggaaccaaccagaacgcctcaatgcaagctcatatttcctattgtacacactagtagggtcccttcctctacttgttacacttgtctacactttaaatacttcagattctctaaatatgctagtaatgatatttactgaccaagaactgttagcctccttatccaataatcttatatgactagcatgtattatggcctttatagtaaaaataactctattcggacttcacctgtgactcccaaaagcccatgtagaagcccctattgccggctcaacagtacttgcagcggtactcctaaaactaggcggctgcggtataatacggcttacccttatcctcagccccctaacagaatatatagcctaccccttcctcacactatccctatgagggatagttatgacaagctccatttgtctacaaaccgatgtaaaatcagttattgcctactcctctgtaagccatataccacttgtcatcatagctctcctaatccaaaccccttgaagctttacaggtgccgtcacccttataattacccatggagtcacttcatccctgttattctgcctagcaaattccaactacgagtgagtccaaaacggaatcatatacttacctgaggccttcaaatactcctcccactgatatagcctcatgatgacttctagcaaatctcactaatcttgccttacccctaccattaatctagtaagggaactctctgtgatcatggcttcattctcctgatcaaacatcactattatgcttacaggacttaatatactaattacaaccctctactccctacatgtaccaatcacaacacaatgagggacacttacatattacattaacagttaaaccttcctttacacgagaaaatacattaatatttatacatgttacacctattcttctattatcctaaatcctaaaattattatgggctttacat

SEQ ID NO: 5106 - DNA, 1541 bp, Homo sapiens
cggaaacctttctttatggacatggaagtttgcatctcacgtacttctcatgtgtcacaagatacgattctactttccatgttttcaaccatttaaacatgtaaaagccattcttaattcatgggccacacaaaaacaggcagcaagaaatttggtttttagaccagtggcagctgacccctggatggagcataagagcttgggtgtgtgtcccactccagggcttccaggagaggggatgcaggctgatgccacctccacccccatcactctaggggagaaggcagagctggtgctgtatgaagtttggctgcagatcctggtccagccctacaccaaggctttggaggacaaaaccagccctgagttctgggcacttcaagggcagctgacgagatgggtgaagtggcgggatgaagtggggggtcgaggaagaggcctcgggaagatgggggatgactggacaagactttggtagagctgtgaccctcttcatcctctcctgaccccccagctgaacttcatcctcagacctctgcagaactttgaccaagtggtggtggaggaattcccgtgggttcagggtggccctgggtgacccagggctcagacctgggttctggggttgagggcaggaggctggaagagatgacctcccctagtcccccaaggctgcccagccccctgaagtctgtgatgatcctcccaccaggccggagccactgactgccagaatgggtgccaccttcttcagggcggcgccagcccaggctctcatgtgggaccgtttgcgccagggtctgcacaccctggggaaggcagagggcctcttggtggagatggtcatcccagacctcggtcagtacctccttccctctgcaggccccctccctctgtccatctgcctcctcccttgggctcgctgcctccacatgccctgatctgaagcctgcctcccctcctcatggagccctccaaggtgctcctagccccagctccctggtcccgcagcaccttctgagcccagattctgccttctcagaagtctgggaggcagggccccgcctggccatggccttcttgctctgctccaggcacccccagccctgaagtctccagtccgctggacgcctccatcccttgctatgccgtggctctcctcatcctgggcctcctgctcgtcacactggcccttgtcctggtgagtgtctggctgggcccgggcgccttcctgaggggcagcctaagcctttgacctcttgagcctttaagccaagctgaggggtgagcaggcccctttacacccctgattcccccacccaagcccagcatctcctcatcctccagctggggttgcacggtttggggccagggggctgggcctgatcccagtgtccccacccttcttgtcaaggtgctaaagtggagggcctcccatggggtgttcagcctgggtgtgtagaagcacacagtgtggtacagaggaccctctccagacaggtgacccctcatgctgctgctccctctgctgaaacccaaac

SEQ ID NO: 5107 - DNA, 610 bp, Homo sapiens
gtccccggaaggagggccgggccgggccggggcgggggagcgagggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcaca

SEQ ID NO: 5108 - DNA, 543 bp, Homo sapiens
cgcgggtttgccccgccggagtaatccggaagaggcctcttattagggctctggtggcggcggcggcagacacttggggtctggacgcaacggaggcgggagcgtgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacagtgtgacctaaaggacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgctttctgtacagcctgcagaactgtgagtcaattaaacctcttttcttcataaat

SEQ ID NO: 5109 - DNA, 1523 bp, Homo sapiens
gcgggggccacatggggccagtttattgcagttaaatacctctctctctattttttttttgtcaatttttccataaagaaaattaaaacacacacacacacccccaaaggggagcagggacccagaaacaagaggtggggtgggacgtggcctccctgcataggtccaggccccgggtggccccccaaaggctcccctccttcccatcagcaccctgtctcagtacctccagagagcaggaggcagcgggacgtggcagggcctctgtcccctccctcttgcctccaggtgagaccactagaagtgccggggcttagtgagggccgggagaagggcgacagacagacggatgggcagggaggataccgtttccaagtggaggagggcggtgggcactgtatccacagaaatgcattatttctccccgttttttgttaaaaatctactataaaaaaacgcagctgggggaggggcatgtgtccctctctgtgctaagggctggggaagggggcagcagaggccggcgtgggcggcggcggctgcgtggtggtggcgggcgtcactgccgggtgccctcgcccaccatctccaggttgtgctgctgcagctgggctcgaagcagggcgttctcattcttcagctcctcgatctgctgcctcaggagctcgttgtccatctgcagccgctcggcctctttgaaggtctcctgcatgcgctggttggtctggcgcaactcccggatgtaatcgcaggccttggacaggatccctcctttactcgctcccgtcttgctgttgtctgcgttacagtctggaatgattttcgaaagctggacgatccagttgttgatcttgtccctccgcctccgctccacttcgttgtgctgggctcttctcctctcatctcggggtgttctggttccatcaatttttggagagtaagggtgtgtccggggggcgatcgtcctctgtgttcctgtctgaagcacatcctggggcgtcatcatgacgtagaactggcctccagcctgcaagctctggtctgtggtctgtacggacacagccgtagtatctcccacactggacgctgggaaataggcaaatcgtgcctccccgctgacagcctcggccgccggactgccaccattgctgaagggattttggatcacagcctgtcctccatttgtctctgtgcggaactggtactggatgttgtggtcgccgaacgccgcctgctggacgctggtgatggccaccgctgtctgctcctccgctcctgggccgtccccgccttcctgcagctcgacgccctcctccgcctcgggtcccttgtcgtggctggcggcggcagcagcggtggccgaggcagcgggatccagacccgggtccagcatgtccatggggggggcgggggcggggggggcgcggggcccgggggggaggggaggggaggggagggagggaggggagggggcgggcggccgggggggccccgagcccggcgctcacgccgcgcggcaggag

SEQ ID NO: 5110 - DNA, 552 bp, Homo sapiens
attcctacgtaccgggccgtgctgcttatggcggcgctggagagggggcgctgagctgttgggtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgagtttccagattttctaaagttagacataaaggaattcagaaaggagtcatcagtgtataggtaataaaaggaagaagcaccaatgaagagagcaaagacatag

SEQ ID NO: 5111 - DNA, 3082 bp, Homo sapiens
gctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacggtattcaagccctttaggatctgatgtcctaggactccactctgggcttccagcctggggtggtactggtccctaggcatggaagctcctcccactgccccttccttcacccggccacctcctcccacaggtgtcttcctggtactcttgcacaggcccgagtcccttaccaccacggccttagcctgctctcgtgctctcagtaatgttttctccatttgctgcctttcattctttccagagattcttgctcaacccaaccaggccagcccggggactagggacatgtagggacaatagtccctgcttcaggcagttcagggcagaccacagagatgtgacattacagaccattgtgagcagaggccttgtcccattctgtgttgcatccctaagccaggaacaaagtccagcccaggcctggctccaggggacacgcagtagtatcctctggcctgtgcaagtgtatctgtagcctcacatgccaccatgtgagtctgcaatctgtctgtgaatgccctggtgtagaagccaggagtttggaggtgggagggagccctacagaatgatagccagtgctaactcctgggaatgtccagccactaagacctgcccacagccctgccatgccaatgtcctccttttcacgggagcagcttgcacagactttcagcgcacagctggcattgtcttcccaggagccatcctgtaacccaggccaggtgaagggctcctccctgggaccccacagccccgttcccatcatccttttgtggtgatcaaggcacccatcacacagtattgccataaaccgggtcaggttaacctttcattcccttaggagctgggtgggggcagccaaaagtatttgtaggaggaagagagaaaggaggggacagagctaggaagaatgggaggacggtcagaacgcccctgtgaaggaaggagagcaccaagtccccgtgttctgcctaccctcccccagacagcagatcaggagcaccccgcgcgcccccccccgccccgccccgcgtcggcgccggccccctgcaatggttggcggtatggggaggtgaaccaagaaggccaggagttcaagtgcgtgatcccccactggggcatataggttacagccgccagggcaactgaaactcctcaggctccagagggctgaagtgagtcgcctccacgttcttgaggtgcttccgagccaggaacagtgcgaggcgccggcgccgccgcgagctcaggccctggcccaccagccatgggaaggcgggtccgtgtggccccagggcctcctcgccctccagctcctcttcgcagcgtgcacggtaggagcgcagcagcgccaggcaccagtcctcgtccacgcggtagcgtgcatagaaggcggcctcctgcgccaagctgccagcgcgcagccagcgggtgacgacggcgcggccctctcgcgccatcacgacggggtagcggtgctccagcaggcgcagcagcagctcattgccccggttgccctccacgtcaccaggtgacagggggcgcaggcggcccgaagtgctgaccacgtcatcctgcgtgcgtcggagcagcagcaccggccccgggtagcagcacagctgctcggccacgttgaggttgaagtgctcgcgcacggtgcgcaccaccagccccttccaactgtggggcatgaccttcagcgccagcggcacaaggtcgtcgaaggtggcgtccagcaccagtgcacccagctccgggtaggtcatggtggcccaggtggccgtgaagccgccaacagaccagccgtagaccaccaggtgcgcgggcgggaagtgcaggcggtgcagtgcgtactcgaccaccacgtccatggcgttggcgtcgtgctgagggaagggcacgccagtgctgctgccgaagccggggtggttccagcccagcacggagtagccggcctcgagcggtgcagacagacagcccatctcgtagaagcccgcgttgccttcgcagcagatgacgaggcgcggcccgtgcacgtggctgcccgggtgctggcggcggtccatgaacatagtgtcgatctcgttgccgtcacaggccaccagcttggcgcgccggccgtggtagcgctccacgaggcgctcttggccctgctgcagcagcggcagcagcgcgcgcgtcatcagggacacggagccggggtacacgagccagcggcccagcgagtgggccagcgcgtagctagcgagctggccgggcagctcgcggagctgctgcaagaggcactgcgcctggctgcgcgccccacgtggaggccgccccagcgcatccccgcccagcgtctcgtcccgcagcaaccacacgcccgccgcggctgccgcgcaggtcagcgcccggtggctgctgctccggcccacggcgcgcacgtcatcccagcggaaggccacgggccagccgcggaatgggtaggtgtagctggcggtcaggtagatcttgaacacgcgcaccagcgccttcacgaagcagatgacgcacatgagcggtggccctaacgcccagccgctgggccgggatcgccgcgagaggcacagggcagtcttaggggataccggctcccggacaagccctgatggcctttgtgacctggccttccagggcggagggaaggctgcatcctgttgctaggtgatgggtgcacaaagggttcccagagatgatgaacccaaggttctgcccgtcccccgccttcgccaagaccccaccagctaaacgctcccaggcccagctttcccacccatgatttgagcagctactgtctccctctttcttccttatttatttattaaattgagatggggtctcacta

SEQ ID NO: 5112 - DNA, 12588 bp, Homo sapiens
aagcgcttggtaccagggagggaatgggaggacgcttgcgggatagggaggcgggggctggaaattggcagggtgagagctggggaaactagtctgggacgcagccctccttgtcccccttcttcattcacccccttgttgaggcccttggcttttgcataatacaccctttaaaaaaatgtatttaaagaggctggttcctatccatccgactggaggcatctcagtgcaagagcaaagctaagtcctgcacacgctcctcccctcctcctcctccttctccccccaggttttcccgaatgtatctactccggttacaactagacgcggcccctcccccacctgcctccccccttccttccctcgatcgtggagggagcgttctctgtgccttcccaagtccccgtgggggaccttctatgttggagtggggggagggggggagggtcatataacgaaggccagaaagaacaaattagataatcaaaagaattatagtaattgctttcactttcccccgcccgctcagcggattccctcccccgcccctcccctggtttttctgtctgtcgggaatactcggtctttccgaccccctcccctcccccaggttcctcctctcctctccccttgctcgcgcgttccctctcttcctccgttttctggtgtgctggaacgttcagcggaatatgatgaatgatcacctgtcacagcttgtttattataatgcaggcaatcaattacacatccccaatgctggccggcccgcaggaaatttatatgctcagcacaaaccaatgtgaaaatggaatctcatttgccaaatgtctttctccccgtacagcacgatgattacagtctgtgtttgtttcaacagtcgtgtacaactgacagtgccatcatttactgcctggctcaggtcacgttactctaaggctttatttatggtgttacgaagggcagcacaggaaaaggacaagggtgtctgtcagggatggcactgtgttaaaaagtgggcgtgcaagggccgcattcccgggcagccgctgcaacctcagcccctgggcccttacctccgcagcctctcccagcatccagctacccagactccaaggccccaggcgagagccagctctcggtacctggagctccacaggtcccagaatcggggtggatcagagttcaaattctggttctgctactgtctaattgcgtgctgcagggactcaatctcttcatctgggaaatgggagtaataacccttggcaggaatgttgcgatcctctgagacatggctgtctcaagactgttttgtttcccttcctggtggaattttgcacttttatgtcctgtgtagcagcaggtagtgtggctttgagaaaataaaatggccaccttgctccgctgttctttctttgtaaaaaaaaaaaaaaaaaaaaaaaaacggcatagcaatcttggcctttctagctgtgtgaccccaggccggtcaatccctcctcctctccaagcctcggattcctcccctgagaagtaaagaaaataactcctaaactgcctcccgaggcttgctggcaggatccaaggtgtccagagatgttaaaaaaaaaaaaaaaaaaaaaaaaaagcccagtaaatgggaaagtgaggctgtcactgctgagtggcatcctgttttcaggagttctggttggtccccagagttctgctacacaaaatgttgacccaaatttgtacccccacaacacttggtgtcaagtgggagctcagaaactgaggggcaggcagatgcttttatgtgtattaggttgtcttttattgtattgtatagttcctttttttttttttttttttgagatggagtcttgctctattgcccaggatggagtacagtggcacgatcttggctcactgcaacctccacctcctgggttcaagcaattctcctgcctcagcctctcaagtagctgggattacaggcacgtaccaccatgcctggctaatttttgtaattttagtagagacaggttttcaccgtgttggccaggctggtctcgaactcctgacctcaactgatccacccacctcagcctcccaaagtgctgggattacaggcttgagccaccgtgcccagcctgtactatatatttctttattatttgacacgtgtatttgtttaatggccctctgctccaccagtatggaagctccaaaaggaaagataccagattgatcttgatcacctctgcctccccagcacctagtcttccttggcacatcggtcaggctgtgccacatccacccagccttgcctggggtcatttatcctacatgtactcagatcacgtgaactggtgatgggccacccatgtgcctgcctggagactcctattcacccttcagatcaatatcccccaaataaactcccagtcactctggcatcccatgttgctttgtgatctctgcctctctctagaccatttggctcctatgcacaggcagctatgtctttttcatatttgggtccccaaaatgcacagtgcggtgcctgcctcaaaacaaatgcttttcaatccgtcaatcaatcagttgacatggatcatcttttctcagcactgatgtatggactacaacttggaattccattaaagctcctggggtcaagaaaaaaagtgattcaagtttatttatttatttttttttgagacagagtctcattctgtcgcccaggctggagtgcagtggcacgatcttggctcactgcaacctctgcctctggggttcaagtgattctcactcatgcctcagcctcccaagtagctgggcaagagccagcacacccgggctaatttttgtatttttagtagggacgggctttcgccatgttggccagactggtctcgaactcctggcttcaagtgatctgcccacttcagcctcccaaagtgctgggattacaggcatttaatcactgcacccgggtgagccactgcacccggccaagttcatattctaaaagtgaaacattaatgctgcattgtgtattttttggtcaagtgcttcagatgtgtggaaggaatttctttgtataaatgcaattattcgtcaccatgatgataattataacgagggtgactgcacagaactgtgcctccccagcaagcatgggctgggcagggccgggtattcccttcgctgacttgcttcactagttgactaacagaccttattcccgggcctgagctgatgatatcctgccaatgccagcttcccaacatggaggggacgcaagagcgagcgccatgggatcctgggggaaaagcagcctgtgtttgctgctgctttgacagttgaggctctgagagggactggcaaacaatgggaaatgaaacatttgagtggttgcaaaaaattccatgggaaatcccccctggtggtatttatgtgcgacggctgtgacaaggagagcgcagggctttcgatttcaagggttcctgagcagaccacaatggccttccaagatggcaatccccgggaacagctctctcggccacaaaaggccagtttgtctgtccagggaagatctggccccatgcatcaagttggccatgagctgcagtgtcttctttggggcatgacccacatttatagggtctgggcctctgaaccttctgctcctaagacagatctatctcagttgtccctctggttttcccaggcctcaaggacctgggggctgataggggctgaggggtttccctcgggctcagcctccatctgcagaactgtgggaacctcagcctccatcagacccctccccattttctggtcagcacgtggcctcctcctgtttcctccattcccgttggtaatggacatttatttaacttttactccccctccattctcatttagaaaagaaagtgaactgatattaaccaatctttgttttgccttctttaacactaatgcatatgcaaaatagttaccactattgataatatcttattgctgctgtgatatatgtgtgtatatgtacagatctgcttgaaggtaagctttatatagatttttagagatacttggtaaatgagaaaatggaaactgaaagaggttaaataaactgcccatgtgtattggtcatgaggtttcagttgcaaagtgacaaaatcctgacttagatgaacttaaaccggatggaaaatgtacattgtattatttgagaagcaaggtctggataagcttcaggcatggctggatccaggccctcagttaagtctttaggaatttccctctctctagctttttggctttgcttttccctgtattggtttcatgtttagattggctcacttcacctgttttacatctttccagagtcaaatccagcctttttcctggttgcctccataaaagtcccagggttaggtttagtgtgctctgatagattcagctgcccattgctgaagcagtgactctggcaacagggatggactgatctaagtgcccaggttccagtcactgctgaagcccagccagaccacctggacacagtaagagtgagtggttcccccaaagaaaactggggtgctcttaccagaagaaggaggaatcgacaaaaagacctgatgtcctaaactcccgtgtcacactgtcactaatgggcaggcagacccatacagcagctcctctgcatcttcatgctgctagagaccaccaccgggaccacctccctcctccatgctctatcctgccctgtgcctccagccccgcccctgctgcaggaattcactctagtcagtagttttcaaaatgtgcgggaaggaggaagccagtggaagagagcaggtggctgggtgacctgtggctatgggattcccctcctctatttcaaccatccagcaattcttgtgtctctttgtagattcagtttccttgtacacttttatttaaacaaaggacaccccagattttttaaacttgcaaatcagcaatttttctggaatctatgtctacttaccctaaattaaggaacaatagctcagaaagaggcaggaaactgacaacacgtcaaatgagtgccaaggggatctgagaaaccacacctcccgattcccatctcttgccctttgcacccacggccttgcagatggggtcaagatttgtgggcttctgatttattggccaaggatgcagaccttaacatgtaagtggagcagcttcccagaaaagagaaggaagaggatacctttgcacagtttttttctagtctctgggttctgtgcccccagggcaggcagcctctggggactccctgtaggtaggatcctgccagaatggagaaaaacatcccaattcctgttattccctcctggtcctgggagcttacatcaccattccaggagaacttacatgagcaagccatgtcatgcttccgtttaggaggatgtttacaaaccactattctgtcctctgagtgtctggaaagctggtgtctgtgtaccaggccctgcaatgcatttcaaacacagctttctgctgcactgatcagtgctaatcctcataggtaacctttctgagcacttccagcattcctggaactgtgtgctaagtgcttgacatgtatcatttcattgaatcttcccaacaacccaataccataggtagcagtattattttcattttatagctgcaaataaacgaaggtgcagaaaggtgaatgaatttgtctgaggtccatcagccaggttcaaacccaggcaatcagagtcaagagaatgaactagatgctacggtacattgctacgcttagacgcaccaggaaagctctggacgaggaagatgtaggttgttgccagcacctatgcacggacagacagaaagtcctctgcttccttcaggcccttgcttccacttccccggggcttccagctgagcctgcatttttctttgacttccccctcttgcctggcgttttcagcaaacacacacagaggattacggggagaaaactatcatattaccaagtggacatggctcctaaggtgccaactgaacacaggtaagtcgggtaaggaaaggcacacagtctcattacttagactaccccgcagccgcttattgaattagtgtgattcttaacatcttcaacttggatctcctccaggccagccggctggtgcattcagtacgactcagctcgccttaactcaattaacaaagccaggctgagccgggctgagctgaactcaacaagtttttcttaagcactgagctggctgcagaggggaaaaaaaagcaacaaaggagagcaagacgctgccttggccctttaagagttgccttgcgcgcttagtggataatacggtgccgtattttctaagtatcaccttggtggtttttgccatacctgcactccctctgtgctattatttacttcatatttttctttaaacaaattcacttcctttttcaaacttattttttttaattattgaggtgaagttgacataccataaaattaaccatttgaaagtgaattcttagagcatgatgctcatctgaagaaaaaagtaaaaataaagtgaattcagtggcatttagtactttatagcgttatgtgaccatcacctttatctaactccaagacattttcattacgtcaaaatgaaactccataacctttaagtagtcacgccccattcccttctccccgacaacccctggtaaccatcaaactgctttctgtttctgtggatttatctattccggatgtttcatgtaagtggaatcctacagtatccttgtggttctggcttattttacttagcataatatctttaaggtccatccatgttgtagcatgaatcagtgcttcattccttttcatgactgaataatattccattgtgtggataaacacaacttgtttacccacccacccattcattgatggacatttgagcatttccatcttttggctattgtgattagttaagtaagtttagtttagtttagtttttaagatggagtcttgctctgtcttccaggctgtagtgcagtggcatgattttggctcaccacaacctccacctcctgggttcaagcaatcctcctacctcagcctcccaagcagctgggattacaagtgtgtgcccccatgcctgactaatttttgtatttttagtagagatgggattcctccatgttggccaggctggtctcaaactcctgacctcaagtgatccacctgcctcggcctcccaaagtacagggattacaggcatgagccaccgtgcctggcccaaataagtttactttaaaaggaaattctacatcactacagtaaacgggaagccaatatttttataatacacaatacaatacctacataactattagaaggacaaatttcatctttgtaggtcataaaaatcatcctgtgaactatcagatgcaatcgtaaaaaggctgggctcagggagtggtcggacttgagttcaaatcctgactttgccatctgtgtgactctgggcaagtgtcctgtcctccctgaacctcagtttctttatttgtaaaatgataagacttaatattccttcctcttgtagtggttatgggaattaagatcatgagtggcctggcagagtggctgccacctgtgatcccagcactttgggaggtcaaagcaggaggatggcttgaggccaggaattcaagaccagcctgggcaacatagcaagaccccatctctacaaaaagtttaaaaaattaactgcgtgtggtggcacacacctgtggtcccagctactcgggaggctaaagtgagaggatcacttgaacccaggactttgaggctgcagtaagctatgatcgtgccacttcactccagcctgggcttaatagggcaagaccccatctctaaaaaataatattttaaataaataaataaaaccatgtgtaaagtgttagaaccatgccaggtacatagcaagcccttcgaaacacaaaagctggtaggtaaaactacaggtcatacacccactagcggtcaatatattagcagctaacaaagtaaatatttgttgtgtgccagaaactgggtgaagcaccttccaggtgttatgtcatcttctcagggttctaagaggcaaatattattatccccatttcatagattggagaacagaggcaaagagaggtggagccagtagtcaaacattcatgaaagtttaggccgggcatggtggttcacgtctgtaatcccagcactttgggaggccgaggtgggtcgatcacctgaggccaggagttcgagaccagtctgaccaacatagtgagaccctgtctctactaaaaatgcaaaaattagccagatgtggtggtgtgtagtcttagctactcgggaagctgaggcaggagaattgcttgaacccaggaggcagaggtcgcagtgagctgagatcatgccactgcattccagcctgggcgacagagcgagaccctgtcttgaaaaaaaaaaaaagttcataaaagttcatacagtgcaggacttgaactccaggaaagttaaacgacagtatgagaagtaactaagaatcacctccggtggaaagtggccccggggcaggggtgattcatcgcaaaatggcttcctgagcccctgaggtccagcctgggcagtggcagtgcgcggcaatcctggcccagtggctctgtccttcttggattccttccagcaatgtctctttatcaagtcgctcttcctcgggtctgccaagactagtctccctgagagactgctctcagccttcacatcttttctagttgatatccctctagcagttaatggcttcacctgcccttcctgtattccatcacccaaagacaaatccagtgtccctaaaacctcacctgtgctctgcaatctctctcactagttccacgctgcatctgagccctcgagactgccatacagcctcttactaattatccaccctggtgcaaaaattagcacgtctcaggttcacatgtatccattataccttcaccgatagggatgcagtctgcataattcacagttttagtctgcatggggaatcctgtctcacccattggcaacactagcatgggggttgtattactcttctagggctgttgtaactaatcacacaaacttcgggggttaaaacaacagaaatttattttctcatggttctggaggctggaagtctgaaatcaaggtgcaggcagggccaagctccttctgaaggctctaggggacaatccctccttgccttttccagcttctagtggctcctagaattatattattatttattttttgagacagagtctcactctgttgccaaggctggagtgcagtggcgcaatctcagctcactgcgacttctgcctcccagattcaattgattctcctgcctcagcctcttgagtagttgggactacaggcatgtgccactacacccagctaatatttgtatttttagtggagacaggatttcgccatgttggccaggctggtctcgaaatcccaacctcaagtgacctgcccgcctcggcctcccaaagtgctgggattacaggcatgagccaccgcacccggctggcccctagaattctttggttggtggctgcatacctccagtctctgctctgtcttcacatgacctgcctcatgcatttttgtgtgtccttttctgtccctcataggacacttgccactggatttaaggcctgtcctcattcaggatgatctcatcttgaacctggcctaattacatctgcaaaaaccctatttcctaataagatgacattctgagattctgagtggatatgaattttaggggacagttttcaaccccctggatggggcttcacagagaagaggtgcctggtagtctttgtaactggcttattgtatatttcaacaccctggacacacacataaaagggttcttctctcaagacaattgtcaatgacattcttgccaatctccttttcccagtcctttgtggcatcatgaacagatcctgtaactttctggccacttcccaatattgaaaaggccaagccagagagtctggctctgtcgccccggctggagtgctgtggcgtgatctcagctcactgcaacctctgcctcctgggttcaagtggttctgctgcctcagccacctgagtagctgggactacaggcaagtgccaccatgcccagctaatttttgtatttttagtaaagccgatgttttgccatgttggccaggctggtcttgaactcctggcctcaagtgatctacccacctcagcctcccaaagtgctgggattacaggtgtgagccaccatgtccggctgccagtttactttaaaacagccacctagtccccatctcctaactcaggtttgacgcacagcctgaggaaactggagaggacctggccaccttttgcttccttctccccgtgtttctggctcccaaagtacaccaaggaggaggatttcatgggcaaacaaatttggccaatgctgcattaaaccaagttacccagatgtctctacttcagggtcagttgatgtgtgaatgttcatccaagaacaggtggtttccaaacttcttcagcccaggacactatttttccacagagcgtcctacctccctagtgttccccagagcacactttgtgaaacaccacacaataaaaagtactgccaaatataaagtatatccacaactattacgtttgcatagcaatagaagatgagtttttgagtaaacacagcaactgtggaacagttttgtgatttattcagaaaactggctccaagatcgctgtggacaagacccaacttggctgggagattgtaatccctcagtagagccacgtggacagtgaagctggccgaagtttactctgagaaaggatcagagactgaaattgctctgattttcctaaacccagcttctgtagtcaggaagaggtaactgtcatatttaaaggcaagtactttcaggaaaaatttgcatgatagtgtggtcctataagttatgcaattctattatgcaaattcaatgatagggactcggcagatgataataataataatataataataagagaaaagatagaattaacaaatgcaagtggcaagcaaagcctcgccttcttctcctggtgtagatctcggatccacccagtaatctctgctcccaagggcctctcagcctcaagcatgagtctagtatttaaatatctgttgttttcgtatcctacgacttctaaaagccgaccaacttcagctggtcctcagctggacaattggcaacctcttctgatgctggagaaaaccaggctgccctggactgatggggagaaattgaccagctcccaacttagtgtctttctaaggatttccaaggataatttctgaccattgtctgttctccctagaagcttttttttttttttttttttttttgaggcagaaatcacaccactggagtccagtgactcgatctctgctcactgcagtctgtgcctcccaggttcaagcagtcctctcacctcagcctcccgagtagctgagactacaggcatgcaccatcatgcccaactaatttttgtatttttggtagagacatggtttcgccacattgcgcaggctgctctccaactcctggcctcaagtgatcagctccccagacctctcaaagtgctaggaatacaggcatgagccactgcaccggccaccccaggagtttatcgagtcacacgaccatgccattgaggctcccctgtagtctcaaaactgaattgaatctagttttgtccatataatcaaggagaatattttctgaaagccaggattaacccaacaattggatatcacgggggccatcgaggtgataagatgtgaggaaagtcaaccaagctcactccatgccccattcccaaactcccccatacatacacaagatagcctagagaaaaaaagttgatctgactgtgttatcagaaaggggtggtattactcagcagtctagccgggataggtttatccatgtagctaacaggctgccaaagaccagaggggatttgaaaagcagtgtgggggcggggggttgggggcagatatggagcctgtactccacctctccagctttctcctcctgcataacaattcccactgcccacggaatgatgcccaaactccaggccctttgtatgcgtctccagccctcatgagctgagaccatccctgaccctaaggcagggtctggttctcagtcatctaccattctgcccagccctgagcacagattttggcagataagccagagctcaatggatgaaggtcaaatgagtgaaaaaggaacccacataaaactcaggtaccctgtgctccagtctcagcactgcgttatgtcaaaaataaaataattttttggggggccaggtggggtggctcatgcctgcaatcccagcactttgggaggcaaaggtgggcagatcacttgaggtcaggagttcaagcaccagcctggccaacaaggtgaaacctcgtctct

SEQ ID NO: 5113 - DNA, 1353 bp, Homo sapiens
agacctgtggagctcagagcctgggcccctccactgctcctctcctaggccaaggaccctggggtctgggctgacatgcgagccgctgggggactctgggcttggctgtggcccctggaaatgaagtcccttcccttagccccagataacccaggggtgctggccccctgcatagacacagagtcccagttaggagctggggatagaagacagctaaaggggactaagagagagaggtcagagtgagagaaataggaccatggggagaaacacattaacaggaacagagaaacaagggaaaaagagacaggatgagagagacacaactgtaatagagacacagaggagtggcacacagagaccacctcccagctggagacagtcaggaaggactgagggagaggggacagccagggctccacacccaggcaagaatgggggagggcctgtggaacagagaagtcatcaacacacacagttcaaagtctaccctaggctaggagggggagcaggaagaaggggcagggacgcaggggcccggcctgcgagctccctgttggcctctgctgccccctgctggctcccgctgcggtgctcaggcaggaagagaggaggctgctgtgtttaggcccaggacgctcttcattccctttgcacaccacccaccaaccactgcctgccccactccctgtcccccacttcacagagtgcccccagggccagcaggtggtgcgggtgtcttgcccgtgaccttgttggcacagtccagcagggcggtgtgaatgtccttggcacaggaaatctgggctttgatgaccgccaggtactgtgggtaggggaggctgtcaggctgcactgcgtcgggcttggtggctgtgggcaccaacgttggagagtgcttggcactgtcacaactctgtgacaggcactcatgcgccaggcgctgtggacaggcaggcaaggggacagcatcagctccacccgaggtcattctaccccaccccaagggccagctgggggttgtcggcttggcctctggatttcccaggtcttagagtcagaggttggccctgccagtcatttgctggggaacctgggggcatggcggctactcttctctgagcctcagtttcctcctttggaaaacgggtttaataaccacctcttcctacctcataaggtgagaacagtgagagcaggtgtatgagacacaggcacgggtcctggcacactgtttaaagtgccaagaactgttagctactatcattgttactgccctggctccaggcctggtgttggcagtggcatctcacccctggttttctgcctgcttctctggctgctctaggtact

SEQ ID NO: 5114 - DNA, 6006 bp, Homo sapiens
aacccactcacgtccccttccatgctatggaagctctgttcttttgctctttgcaataaatcttgctgctgctcactctttgggtccacactgcctttatgagccataacactcaccgcgaaggtctgcaacttctctccagaggccagcaagaccacgaacccactgggaggaatgaacaactccggacgggaggaacgaaccactctggacgcaccgccttaagagctataacactcactgcgaaggtctgcagcttcattcctgaagccagcgagaccacgaacccaccagaaggaagaaactctgaacacacccaaacatcagaaggaacaaactccgaacacatcagaaggaacaaactgcggacatgccgcctttaagaactgtaacactcaccacgagattctgcggcttcattcttgaagtcagtgagaccaagaacccaccaattccggatacattttggtgacccagatgggactattacctatcgccaagcggtgagaccactgcctatcgctgagcggtgagactatcacctatcgccaagcagagctaggaaggctggcagggtgtgtgaagagcgtctggtacctgcagtgaacatttttcctgcaccagagatcaccaccgcccgacagtcagcgtctctcgaaatcttgttgaagcactctaccatctctctgtgaagcaacgagtgaagggttacaaatggggcgggaataccctgccctcatgtccatcttcccacaacgttccactttcacccagtcccgcagccccgcctccccccgcaggcaggcctccaggatctgcaggtcagacctccagaagaccttgttcatggcattcctcttgttgggccggttgagctggacatgcagaacatgtttctgcgcagacgtcacacgaagggactcatagctgtggtctggggcttcaccgagggctactccggaagcctcctcttgtgcagaggagccagtgaggcgaaggctaatactgagtcccgggtagttggagcctgtcagtcctggggagaaaggaacagcctttgatgaccccagactgcaagacacaggcctatcgaattagggagtccttcaaaagggagcacacgcacccctgaatttaggggactcgggcccttcgtgaccccggatagccctccccgtcctacatctgctataacagcacgacagcgcgacgcacccccataaggcaagaggtgactcacgccgggtcagtaggtcgcggagtctgcgagaagccactatccccgccgccatcgccgccgccttcgtctactgcgttcggacggagtaacgtgcccgttagcggagggggcgggcacagaaggccgccatgttgagcgagggcaccgatgccgcaacctgacaggcaatgacgccgttctttccgccatctttactaagggcagtcgatttccggttgccttacatagagccaggctcagaaatggaccctttgccccagtgggaacctggccaaagaaaatagctcctgcaatggcgtgaacctgggaggcggagtttgcagtgagccgagatcgcgccattgctctccagcctggcgaccgagcgacactccgtcttaaaaaaaacaaaacaaacaaacaaaaaaaaaaacagaaaagcaaacagctcccgctaaagttcatcacacagctgtttcataatggtggaataataggcgacagctgaaatgtccaaggacataattgcagcagagcttgtaatcatgcatgtatatatcatgttaactaaaaataaaagaaaacttgcagtactgtgagtttactcaggtaaaggaatgagtacagacgggccaacattaagcgctgactgtataatatgaactcccaccaggaggtcgtactatttcctactatatgcagaggaaactggcccaggcacgggaagacactaggttcaaggtcggtgggcttcagaagggctaaagcaggattacctggcaccagagttcatgttcttagcctggcgcagtggctcacgcctgtaatacaagcactttgggaggccgaggcaggcggatcacctgaggtcaggagttcaacagcagcctggtcaacatggcgaaaccccgtctctactaaaaatacaaaaattagccgggtgcggtgtccggcacctgtaatcctagcgggaagagaatggcttgagcccaggaggcggaggttgcaatgagcagagatggcaccactgtaccccagcctgggcgacagagcaagatctcaaaaaaaaaaaaaagaagaaaaaaaagttcatgttcttaaaaaaaacaaacaaaacaaaaaaaccgaaattcccttgggaaaagccagctaccaaaaggcataaaaagtactgtaaaactgctggccgggcgcggtggctcacgcctgtaatcccagcactttgggaggccgtggcgggcagatcacgaggtcaggagatcgacctcctgacctagctaacacagtgaaaccccgtccctactaaaaaaatacaaaaacttagcgggcatggtggcgggcgtctgtagccccagctactggggaggctgaggctggagaatggcgtgaaccccggaggcggagctcgcagggagccgagatggcgccactgcactccagcctggggacagagcgaaactccatctcaaaaaaataaaaaaaaaaagtactgtaaaactgcttaagtatgctttttggggagacattgagcaaggcggtgaacagatgtctctgggccagtgagattgaaggaagtatctttccttaatgaacctgtctcctgtgtgttttcacagactagaaaagcaggctcttttgaaagacagaaccattaactacccatcaacagtagactgtttataccatagaaaactctgaaacctctatgcaaaaataaaaatgtgtgagaaaaaaatgtgaagatgtaatagaacatttagtatgatcctttgttcctttggtgtaagaaagtatagctgggctgggtgcggtggctcaggtctgtaatcccagcactttaggaggcccaggcaggcagatcacctcaggtcaggagtttgagaccagcatggccaacatggtgaaacccaatctctattaaaaatataaaaattagccaggcgtgttggctcatgcctctaatcccagcactttgggaggccaaggcgggtggatcacaaggtgagaagatcgagaccatcctggctaacacggtgaaaccccatctctactaaaaataccaaaaattagccgggcgtggtggcgggcgcctgtagtcccagctattcgggaggctgaggcaggagaatggcgtgaacccaggaggcggagcttgcactgatgtgagatcacgccactgcactccagcctgggccacagagcaagactctgtctaaaaaaaaaaaaaaattagcggggcgtggtggcaggtgcctgtaatcccagctacttgggaggctgaggcaggagaattgcttcaacccaggaggcagagtttgcagtgagctgacctcatgccactgcactccagcacttcagcctgggtgacagagtgagacaatgtctcaaaaaaaagagtgtagctggacctgcacagaatatggtgtatgtatgtaatatctctggaaggagactcaaactggtaacaggaaatgaaattggatgctaggagacaaactggtaaaattcactttttatcaccttgactggcttaaaaacaataaaccctagttgattttatttatggctgcaagatgactgtagtttttccttgtctaaagattgtttgaaacttcccatagtgaagcaaaacttgttcatctgccaaatgatgcttttgtgatgtcattaaatgttaaaaatgtaaggccgggcgcagtggctcatgcctgtatcatagctactttgggaggccgaggccagtggatctcaggagttcgagaccagcctagccaatatggtgaaaccccatctctactaaaaatacaaaaatcagccaggcatggtggcacatgcctgtaatcccagctacttgggaggctgaggcaggagaattgcttgaaccaggaggcagaggttgcagtgagccaagattatgccattgcactccagcctgggtgacagagcaagactccatctcaaaaaagaaaattttattcacagtaaattccccagagtgggctattctcaagcacacatgcataaacttcaaggtttgtgacctgctcctctgcaggtcacctcttccctccagtaggagtcaaaatccttaaaccaggatccttccgggtggtacccgccaccgcaaggcatcttcacagatttgcatctgcaagtgggaagctatctaccgtatgatgcaattatatagatcctttaagttttgagacatggtctcgccctttcgcccaggatggagtatagtggtgccatcacagctcacagctcaagtgatcctcctgcttcagcccccatgagtagctgggactataggcacagtgtgtgccaccatgcccacatcatttttctatatatttttttctcgagacggagtttcactctcgtcactcaggctggagtgcaatggcacaatctcggctcactgcaacctctgcctcctgggttccagcgattctcctgcctcagcctcctgagtagctgtgactacaggaacgtgccaccatgcccggctaatttttatttttttagtagagacagggtttcaccatgttggccaggctggtctcgaactcctgaccgtaagtgttccgctcacctcggcctcccaaagtgctgggattacaggcgtgagccaccatgcccggcccactttcttattttttgtagacagggttttgccatgttgcccaggtctcaaaactcccggccttaagtgatctgcctgccttggcttcccaaagtgctgggattacaggcatgggccactacatccagctatatatatcctttaacccagcaattccactggcaggaatttatctcctgatcagtatcagggaagctggccaagatacttgtgtagatacgtgttacagcgctgtttgcaatagcaaaaatagacctggaaactaccctttgggaccaggttaaatcatgacacatccacacaatgatactgcaagggtaaagacaagtcactctgaaatgatacagaacacaaaggttttgggtttttttgacaccctgttgcccaggctggggtgcaatgaccccatcacagttcactgcagcatcaccctccagggttggggtgatccacctcagcctgctaggtagctgggactactggcatgcgccactatgcccggctgatttttgtatttttagtagagacagggtttcaccatgatggcaaggctggaaacctttttttttttgagatagggtctcattgtcacccaggttggagtgcagtgatgtgatcactgcactgttaacctcctaggctcaactgacccacctgcctcagcctcccgagtagctgggactacaggtgttccaccaaacccacctttttgtagtgacgtttcaccatgctgcccaggctggtcttcaactcctgagctcaaagtatgtgccccaccttggcctccccagattgctggaattataggtgtgatgacccactgggcctgatagagcttgctcgggcagggcccagtaagaatgccactaagcctgatggattttcctcaaagactcaattgctagcaccattctcagtctgcagcccaccctgctcctcttgggtctctgtatgcctccagagggcctgtgactgtgctcaggcctgcctgtgtcttcaggacagagagggagaaaagcagacatcctggaatcccagcaagtgctgtgtttattttccaaacaattttattgaaatgtgccaagagtacatgggcagcacaaatgtatgaacaggaaaaaaaaaaatcacatgtacaata

SEQ ID NO: 5115 - DNA, 1602 bp, Homo sapiens
ttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccagaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgtgggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactcc

SEQ ID NO: 5116 - DNA, 1845 bp, Homo sapiens
ctgtaggcaaatctcatagaaccaggacctagacaaggggttactaggggccaggggaggggaaaccgagtgacagccaatgggcactgggtttcttctttttacttttttagagacagggtctcactctgttgcccaagctggagtgcagtggtgtgatcaggcttaatgcagccctgtactcctggcctcaagccatcctcccacctcagcctccagagtagctgggagcacaagtgtgcaccatcacacccagctaacgtttatttttttgtagagagagtctcactcactatgttgcccaggctggtcttaaaactcctggcctcaactgatcctcctcctttggcctcccaaagtgctgggaccataggcatgagctgccattgccagctaattgttttatttttacatttgctgaggcagggtctcgcttgtggccgtgcagatcttgaactcctggccttgagcagtacctccctcctgggtctcttacagtgctgggatgataggggtgagccgctgtgcccggcccggggtttctttttgaagtggtgagaaggcagatgctcaactgtgaatccactagaaacccctgagttgtactttttacgtgggggagtggtctgacgcacgaattctctctgagaaaggccattaaacaagaatgcagcaaacagtggctgtccggtcctccctgcaccaggccctgctctgctgccagcctgcctggaacaggaccaactccgctgcccacttctgcgcccagcactcactcgcagctgccaagatcactggcctcgtgatcagctagtgggtgggctcgcctcatgtccccatgggctccgagccctgggagggcctccagcaccacgggttctcgtggcagcagtgcctctgtcttagggagagggcatatccctggcccttgtcccggcccccgccctgggcccaggcaccttctctgtctctcggctgcatttgatgatgaagatgttggcatagatgtcctccacacacatccagctggacagggacagcgtggtgtccgtccacacccagtccatcactgcccgcagctccaccaggaacggcaccagccggaacctgcccacagccagggttcccgtcaggtgggctccctcatgcccgggccgtgacccccaccccggcggacctgcactcacccctggaagaggaagaggttgagatgattgtacttcttggtgaggaagttgccgaggatgcgggtggggtagccgcagcggatctggtaggcggacagggcgaagtagatgcacttcacgaagtaccagagctgggccaccacattctggttgaacatcctggggcgggatggccaggtcaaggaccccatcagaaacagccccgcagggcccccagcctgcactgccccgcccctggagaccgagcgcccccacgcgtgggcccacctctcagtgacggcgggcaggatgaagaacatccataggtggatggccagcaccagcgccacctggaaggccagcttgcccagcacggtcttgcgcaggtagagggcgcggtcaaccaccatggtactgaactggatcagcagcatgaccaggaaagcctcgggtacctggtcgtctgatagggaggacgtgatgtctgtggccgccgagtgcttctgtggccaggagagcacaggtcagggggagccaagcccaggggatgtgggtggctgctgagctctgcgtacactgggtttgggtcccgggcctggctcaccccaaaggcccagaagccaaaaatgatgatgatgaagtcgacaacatcagccaggaacatgagggcatagacgtc

SEQ ID NO: 5117 - DNA, 596 bp, Homo sapiens
gctggcgattcgtgttcgtgagggccttttctggagctctctgtacatcctcaaccagagccacagcttcctcgccgttttctggatgctgctccctcacccaggtctggatctcctctggcaagatagtcagaaactgctccaaaaccagcagctccaggatttcctcttttgagtgggtcttcggcctcagccactgacaacagagttcccagagtttgctaaaagcttcatgtgggccagttacctcctggtagcaaaactgcctgaagcgctgacgggaggcctcggagtcagggctgttaccctggagggctgatttctggccctgtgtgggatccttgtttgaggatgggtgtgcctcggtactcttcactgcagccatcatttgcttcaacgaactggcttactctggttgccacttctaccctggagatcagagtccatctttcccacatcactgggaagccatgttctcctgcaaggaatgtctttctgtaatccgtgggacatgagagtgtcagacatgtgtagagactcacagcggaaaaaaagggctcaactttgaaggatgtctgaagaggatggaaaaagac

SEQ ID NO: 5118 - DNA, 2196 bp, Homo sapiens
gctacaagaatccatccacctacaccccttctccacctgggtgtctctcagacccagaaaatggtgccattggcccactgacaactaaatgtggggacaggtctcttacaagccactgggtagtaaaagcatcctgaggtggcataccatatcgcataattgcattaagaaaggcttttcgctgacgagcattaaaaccaagtacctaggggaagaagaaacccaggtgagaggcagcaggtcgcattccaccaaagatgcaatatctgacactcacccctccttagaatcgtatggcacttacttcaatattcccaccaacacgggccaacagaggaggcaatggcttatctttatcattccgcaggcccttacgactgggcctacggggagctgcaagaagaaaaagatgaatgagtgacacaggtaggatattaaacaaagcaacatttagaaaagcaacaaaaaaagcacagccctcaccttctgaacgttcatcaaagtcttcatcaccttcctctgaagccactgagtaatcggactggttgtcggactggtcgtcctgccaatctggagggagagagggcagatgagcggggcccactgctctagtggaacggcccatgggtggggggcggggccggccacacacacctcggtcctcctgggagccatcattgtagttgacctgtttacggattctttttcctttgcccagatttcgggctagatcttcttgctgctgctcataatggtgccgcagcaatttctcccagtagtcaggatccacactttcttcctgtttaatgatttcccgttctacctcctcttcctcctgggacagagggagggccaggactcaggagtgctgaagtcagcaccaccagctacccctggtcctcacagttcccactctgctagctccttttcatgactggactcttaaatacttggtgtgcctgtttggacctaagaacttagaagaaatttgattgagagtacacagctcctcataattacatatagattagcagtcagcataactcaagaaaaacatgggatagagctattatcacaggtaaggatgaagagacagaatgctttcttctaaccccttgcactgatgcatatacaattgaaagatagcaaaaagaaaagaggtcagagccttagcaaggcagaatggagaaacttctgaagtactgtaaaagattttcataagagagaaggaaggagaggatgactataagcctttctattcttcataaacttcataaaagcttaccaactgtctgcagaacgaaaagaattctatatagcctcttatgtcccaaaaacgttgatactcctctaaaagtgaatttttttcagacacttgaggaccactcactgattccacatcccttatattggaattaaacagctgctaatagcataacattagaaacaacctaaaagcccatcattatggaactaattaaataaattacaatcggccctctgtatccacgggttccgcacctgtggattcaaacaaccatagatggaaaatattcagagaaaaaacaaaattatgtctgtactcaacatttacagacttttttcttgtcattattccctaaccaatgtagcatttacattgcattggtattacttttatgtttacaaggaaaaaaaagtctttgggtacatatatgtgagtgtacatatatgtgtatgaatatatgtataatttgtatacacataaaatatttttggaaagatataaaaggaactgaaaacattagttgtccccaagaagggaactaaattgttagaggacaggagagaaaagagatacgtgtgtgtacatataaatatatatatatttttttgagagagggtctagctgtgttgcccaggctggagtagagtggcgtcattacggctcactgcagcctcgactgccaagtttaagcaatcctcccacgcagctgggaccacaagcgtgagcaaccacactcggctaatgtttttattatttagagacggaattttaccatgttgcccaagttggtctccaactcctgggctcaaacgaccctcctgcctcagcctcccaaagtactgggattctaggcatgagccaccgtgtctggcccttttgtgtattttgaactatgtaaattctatctattaaaaataaaacttaaaaat

SEQ ID NO: 5119 - DNA, 1346 bp, Homo sapiens
gaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcagaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgg

SEQ ID NO: 5120 - DNA, 3699 bp, Homo sapiens
ggtcatcatccacagtacctctggacaaggaggaaaagaaccatttccactaacccctggatggaggtgcagggagcgtcaatagtatccctgaaaacttcaaatgcaccaggggggtcagcacccagggaagagccacaggaggccactctgatggattctgatgactatctttgctcaagtgttaggaggaggcttctttctctctgcctctggcaaccctgggcccaagaagtcccaggcactccggaggtccttcctgctcatcacagccccacccaagaggcctggctcactctgcaatgatgatgtgagaatgagcaggtctgcctagtgccagagcctgtggttggattttcggctgaggccaagagaaataaacaagcctcctccttccctctgcacgctacaggaagagcagctcgctggctgcaaggggaccctccaccctgcctatggggcacagcagcccacagcattccttccagaaacggagcactggcaggcctgggtccctgtaagatggaacacaaaggggtgggcagctgacctcaacagccagcccttgggattccaaaccttctcttatcccccaactttgtgatgttaatttctccctggataaagctctctaacaacctggcaagccagcaccagctgaaccagccccagcttgaaccagcagctttccccagcccagctacagtctcatccctccagaagggaaaagaagtcctacggattcctttacaaggaacctccagaatctgctatggtgtccgcaggggacattggcaccaactctgggtttattaaatgtagtgggttcaacagtgtcccccaaaacgatatgtcttaagtcctaactcctggaacctgcgaacatgatcacatttggaaaacggatctttgcagatgtaattaaggtttcagccaagttatccccagcatggctgcttgcgtgggaagcccacagctgagggactgtctgcacgtggcatgcaggagtcacaagcgccatctacaccccaccccgggccaggcagatgacctctctggtctcagtttcctgatgaggaacaggaagggctggaccgaaagatcccttccagcccggacatggaatgaccccacgagggccacggtgaggtctgtcccagctccgcacactagctcgggccagcagtttccaaaggcacagccgcaggggccttggagcagggacaaggaggaccagcccacttcaccctcctgggcagaggtcaaggaccctgcctttggcccacattccttgtggccaaaaatgcagaagcaagcagtgctggcagaggcacctagacctttgggcaaagcaggggctccacctgacaccccaggcctggagcacgagaaaaccagcccaggcctcaggtcccctgactgccagcgaccagggaatgtgacactttccggcctctgcttcctcatctctcaatcctagggggagattaggttgggtgatgtgtttttctttttgacagtaaacttttatttatttttatttttattcttgttttaagagggggtctcccatggccgggcgcagtggctcacgcctgtaatcctggaaccttgggaggccgagatggatggatcacttgaggacaggagtttgagaccagcctggtcaacatggtgaaaccctgtctctactaaaaaatatgtgagctggcaactccaagtccccagcagcctccgaatggaggctttcctcttgtaggattctcaaatcctacaaatatgagtgtctgtaatccagctactcaggaggctgaggcatgagaatcacctgaacctgggaggcagaggttgcagtgaaccaagaacgtgccaccgccacttcagcctgggacacagtgaaactctgtcaaaaaaaaaaaaaaaaaaaggtgggggtctccctatgttgcccaggctggtctcaaactcctgggcttaaggaatcctcctgcctcagcctcccagagtgttgggattacgggcacgagcccatgaactttaaaaaataacatctattgctttgttcctgactgtaaaaggaatttaggcacaaagccgaaaatttgcaaaatgcacaaaaacaaagggaaaaaatctataaacccacaacccaggtaacttccatcaatattctgacaaatgtctttccactctttactggggagtgtgtgtgtgtgtgtgtgtgtgtgtgtgtgtgtgtgtgtgtgtgtttaaacaggttcatacagtgatgatgttgggtgctttcctccatgtggcgccatgtggctgaggtccctacacattttgggcccgttctctcgattcctctgtagttctgatgttctgattccagatatgtcattcttggctcggactgttcaggagaatcatttctggatcttgctaaaaaatggactgctggtccccaactcttggtggttctggctcaggagggctgggtaagcctgggcaccccggagtgtttctggggcgctgcaggtgtgaacctctgccctcctgaagactcacaagcctcatctcccccatcccctccttcctccccgagaatcctacaagaggaaagcctccattcggaggctgctagggactcggagttgccagctcacagccccaccctgcccccacctccccgggagttatccaaggacaatgtccagcctcagctgccaagtctcagctccagggtcagtcacacactgaaggacatgcagaagtcgccgtgtgctgggcactgctgaggacaaaggcctgaatgacaagcgggaacaaagtcacaaggtcccaaaacctgcccgaggtcccacagtcagggcctcggaaatccatgaaaaaagccagtttaataccctgccacggaacacaggcaggagagggagcagcccccagccagcccccagccagcctcccgccagcctctttgcgaatcaccccactccgggtcacagtcagggcagccgccgccttcctccctgctcgacagcccttgagggcaggagccagcttgcccatcattgtcccctctccactagggcctggcaccctgcctggcatgtagtagaagcctaagaagggctcactgtgttcattctgcaatagtcaatgtgtatgagtgcttaccatacctgaagacagtgatttactcttgtccccattgcacagatgggaaactgaggcactgagaggctgatgactcccccacattgccgtgtgggcaagggcaaggccagatgtgagccggcacgctgggccatcgcgccctctgcctacactccgccctgggcctgggaaggctaccctcggagatccccacgatgctgacacctcgctcagcccctccgtgcaccctctcccacgcctcccagccacccaaagtaccagccaggtagcactgttattctggttttgcaaactcagtcattgagtggaagagcagccaggctgaagtggggcagaggcagcccccgtcagaccccagggtcgggaccctcagccatccccactctccaaggactagtagacagagatttccatcgtgctcagccaggggccagggaacaggtctccacagtgggggagtgatggatggatgcaggtgcggactgggaggacccgggccggccttccagcgctggagcctcagcagcccaatctaccttg

SEQ ID NO: 5121 - DNA, 2228 bp, Homo sapiens
gggccacagatcccagcaccagcgactggaagcatgcccactcccgctttcccgcaagcttcacagcacatagccgccctgtagtcacaaccgagggcagctccagcacaggccattcctgagacctctctgcaggggaggctccagctgggaacacggctgctctggctctgggagtgtcgcaagcataaccacttttcagggtacagagtgatgcccaaaagcatctcacagcctcaatcaattcagggaaaagaacatgaaccaaaatgacaatcccgttctaatctgctctgtccctctttcagagtatttgtgatatttgctgatgagaaatgggtgcttccttagcagatgtcttcctaagaatggggaatgtgaaccctggtttacctatgcgacttcctgctcttagattcgctctctgctgaagaggtcccatgctgtcacctggtggaaaaaaatgagaaactgccttgtgtgcccaggccatgacaaaagcgttcctgttaaaggaagttaccctttactacagatgctgggggacaacgctgaccccatgctgcctcacctgctgtgccatctactccagacagagcaccttactaagatcctcagctaccaaccaacctcaggtggaataaatggtcccagtggcagtcaccacagccaccccacactcgctaaagcaagatggaggaccgaacaggtagacgagtcaggaggacgaagcaggggccggggaggacgcaaagaagggaggaattcatcaacgggcaggatcgagcaaagagaaacacacaggtaagcctcgccaacaaaaagcaccgcccttgggatttttacacatttttagccaaacagccggaagaaccaatgagaaatacagaagtgtataagataataaagttaaatggtctcatcgcgatatattaaaataagaaaaagcctagccgggcgcgggggctcatgcctgtaatcccagcactttgggaggccgaggcaggagaatcgcttgaagctgggaggcagaggtagcagtgagctgagatcgcatcactgcactccagcctggcagacagtgcgagacttcgtctccaaaaaaaaaaaaaaagaaagaaaaagactacctgttcaccaagttacaaatataataaaactaccttcttatataacacgataaaagaaaaataaggacaagaatatccccaaagaggctgggcgtggtggttcacatctgtaatcccagcactttgggaggccgaggcaggcagatcacttgaggtcaggagttcgagaccagcctggccaaggtggtgaaacctcatctgtactaaaaacacaaaaattagctgagcgtggtagcaggcacctgtaatcccagctacttgggaggctgaggaaggagaatcgcttgaacccagaaggcagaggctacagagagcagagatcgtgccactgcattctagcttgggtgacagagcaaagctctgtcttaaaaaagaagaatatccccaaattagccaggcgtgctggcaggcgcctgtaatcccagctacttgggaggctgaggcagaagaattgcttgaacccaggaggtggaggttgcagtaagccgagatcatgccattgcactctagcctgggcaaaaagagcaaaactccgtctcaaaaaaaaaaaaaaaaaaaaaaaagaatatccccaattattcctagaggtggatttgtacttcctaccttgggtttttctaatgatggcagggtgctttactgggctccaagaaaggctatgtagcccggctagaagcaaaagctctgtgactcctgcttaaagccactgaaaagaacctgcttaaagccactgaaaagaacctatcacaagaggacactccagagggaaaagaagggaacctggtatctttgaggggaaaaaaatgagaaaacgggagaagggctattcccaggactagaaagaaaacaaaagctggtgcaggtcgcagaagctgagtgggccttgggaggctggcctctgaccactgaccaaggctccaagcctgggtatgacttgcacacaggctgcctaggagcaagagttacgtgaacctggacagcaggaatgccatactatctgttccaggcccaaactggcgagatcctccagaatactgtgctctaaataacaacctagggctgaccctggcgtgaagcctcaaagtcatgtttaattta

SEQ ID NO: 5122 - DNA, 35669 bp, Homo sapiens
gttctgcatttctgtcctgtaaggaacagtgattgcccctgctccggaagatgtaatgtgtaaggtaccatcctgggggtggccctctccagacaccaagcctgctggcaccttgatcttggacttcccagcctccagaactgtgagaaataaatttctgttctttattaattacccagcaatttttatagctgcacaaaatggtttaagacagaggtcatagcaagcttcagtttttactttttccccttgcatctgaacaattgcaagcagaaagaacaactgagtgctttatttctgcaaccaccatgctgctactgagtgaaggggaaggaggggtaagagcttgccttctttccttgtgttaattgcaacatcttccaaaacccagcaaggaaggcatgaagtgagcctaccaaggccagtctccagatgaggggactatagctacagattgctatgtttcctgttggtggtggtagcaagatttcataggggcctttcttgccattgctcaaaatgaaatgcattgacaccaaaggaagtggtgaaactgtgggcattgtatgctttagaaatttgatatttggaaacctgcagacctgaagaggcagtagcttctcctgaagatctgatatccaagggctacccagacaaggagctgacttgtcaggaagtgtggtggaccttgacgcaaaaactcaaaccacaaatgtttcacttctaaatttttgcaggctttgttatatagacatttttgttaagccctgtctaaaacaataggatgactgggttctttcccctcctcatggtgactacgtgcatcttctacgaacattcccatgtcatgtggtcagcttccaagaaagactttaccaatgagtctgtttacagattctcaaccagaggacttacaggaatgcacagtagctatttgtttgggatgcagaggtacatgagccccagacctcatccccaatcaggcagttgggtaggaatggtgtggttactgatggtgggaggacagggatggtggggactttcctgtggagggcccaccactgaagaaatctctctacctcctggtttgatccaggctttccagggataaaataagagggggaaacaaagaagtaatcattccccagcccccagtatgccccatctctgactcagctcccagcagagcagtaataggtccctgcttatcagatggcatcggaagggggtgggtgcctgggtgggtgcctggctgtgtgcagtgaggaggtctcagcagcagcctctgaagccaactgcttggctggaatctaggtgcgctactcactagctggggaacttacagcaagttacttcacctcttacgcctcagttttctcatctgccaaaagggagtactaatagcagcatcattgacaaaagctgaaaggtggaagcaagccaagtgttcatccactgagaaatgcataaataaaatgtggcctagacatacatggaatactattcaacctcaaaggaagagaatctggacgtgtactgcaacatggatgaactctgaagacatcatgctgagtccaaggacaaacactgtatgattccacttagatgaggtacttagagctgtcaaatttgtagagatagaaagtagaatggtgcaggtcaggcgttcaacaccagcctggccaacatggaaaaaccctgtctctattaaaaaatacaaaaattagccaggcgtggtggtgtgcacctgtaatcccagctactcgggaggctgaggcataagaatcacttgaacccaggaggtggaggttgcagtgagccaagatcgcaccattgcactccagcctaggcaaaaagagcaagactccgtctcaaaaaaaaaaaaaaaaaaaaggaaagtaggacggtggctgccaggggctggaggaagaggggaatgggaagttcttgcttaatgagcatagtttcagtttcgcaagatgaagagttccagagatggatgggaagatggatgcacaacagtatgaatgtacttaatgccactgaactacacacttaaaaatggttacgatggtaaatgttgtgtatgtatattttaccacaatttttaaaaataaataaggagaaatattacccacctcagggttgttctaggattaaatgagttaattcactggttctctaccagggagcttttgtcccctccactctgccccccaggggacattttgttcccggaccaaactgagggtcaggctgctatttctcgccacctaataatgagatgcagatgaactggggaggaagagaggttttattttctgcaatcggttacagggagaaggcctggaaattatcaccagaccaattcaaaattacaaagttttccagagcttgtataccttctaagctgtatgtctacatgtaagtgtgcattcatttaaagacataagtgattaacttcttttaatctataactaaggtctcagtactgaagaccttcctctggggcctcagtaaatttgcttaatctaaatgggtccaagtggtgaggtgattatccttgtctcctgttaaatcacggaggtttggggagttcctttagacccccaataaacttatttgtggaggcctggggagtttcttcagacccccagtaaaactcatctaatcctaaaagggtcctgttaagaattctttcattatttggtcatgctttaaggcccaggaaaggcctaggcaagatgcttggtgggcttctgctatattccagcctttgtataagggcactagcttttttttagcttttaatgtttaacttaaccacttagtcagtactgaaacagttgttatggaggcctgtgttagtgagacctggcctgccacaatttgacaaaagttggttaccacaacttgtagaaggctggttggtgctactggcatctggagggtagaggccagggatatgatgtattgtatccacatcaacacaccaaagacctgtcccacccaggatgccgaagttgagaagttccagtgtaaagtacctggtgcagaggccagaggcagtggctcacggctgcaatcccagcactttgggaggccaaggcgggcggatcatctgaggtcaggagttcaagaccagcctggccaacatggcagaaccccctctactaaaaaatacaaaaattagcccggcatggtggtgcaggcctgtagtcccagctactccgaaggctgaggcaggagaatcgcttgaacccgggaggcagaggctgcagtgagctgagactgcattactacacaccggcctgggcgacagtgaggctctgtctccaaaaaaagaaaaaaaaaactccctcgtaatttctatccgttgtcctcactaagattgggtgtgtgcacacatccctcacctgagcgtgtgtcggcagcagcactgaggcccctgcaccgagaggctggctgcccgcgatgtcctcgtaacccaggacgcaaacgatcgttgtggcatattagaacgccagacgctaggcgtccttcgctgcagcgcagtcaccttgtcgccatcagcggtcccctctgtgcggatggaagcagggcagtttgccctttgttctctagaggctgccctcacctcgctgtcccctgagaggaaaaggctggtggccaaaggcacatccagagccacccttacagccccgcgtgcagcctcttgtgagagtcagtgcacttggcacacagattctgcaacactcccgatatttccaccggcgattgtgatggtaaggtttagggtggcaggggtcatatttaaccaggagaaagaacttacatgtggcaaatgcgcagaagtatagtcatgcatagatgtgtgcacgagaaacggccagttgccagtagtgtgcaaactcgtggcttaaacaggtcccaagagcctttcatccattgatttgtccttccgtacctctcttttgggatgcgtgcatgtctagggggtcacttttccattcccctgaccccagcaccccaccctcagtctctctccagcgtcggctgagctcctactgccatcttgtggccgttcacgtaaggtgcaccagagaggcggagcccctgctgtccttgtcctaggacttgatttgcagagatttgggaggcttcctgactctggggtgctcatttccttcacaaacagaaaaagaaaagtcactcctgggcacattgctgtcatgtgtgaggctggaagcactccctacgatgggattctctcaactgtccctatttgcatctctagtcctcacgtagtgcaattcactgtgtgagtgtgtgtgtgtgagagagtgggtgtgagtttgcgtgagtgtgagagtgtgcgtgtgtgtgtgagagtatgtgtgtgtgtgagagtgagtgtgcgtgcgtgtgtgtgtgtgtgtgtgtgtctgtgattattggtaaggggaaggtacaagaagcagggtaggcactgatgctagtactatacttcaaagtcctcaaggaagaagtctcgttttgagccaaggatttgggtgtttctagagagagggaaaacgtgagctccagagctcatgaaaagctccatcacaacaaaggattgtcttgtctttttagccacatcctcccattcacattgcagcatattgagatcttggcactgtctccactctttctttggcatatggctttcaatttgagctccctgaggtgaagaaccattcaagtccacaacctgcatctcacacagggctgagcctagggaaggtattaaatgtttcttgaatgagagaaccttatcttcattcagatgctctgtggtcagcatatcctgtcgattcttcttccagaaatcattttcctatccctagccccctctctttattcccagtgtcaatggaatgcatgccatgtgccattcggccactcaaattttcctttatgatgagatgctcattccccttgactgcacaaagttaagtccctccccagggatttccctccatccaaaggaaactgattcacccaaggttaaagctcctcctgggggtagcccacatcctataactaatcaatgttggcggggtggccccagcccctgtacctcaaatccagacaactctgaaggaccatcagagacccagaacttcctatgggattggctgaggcctctgtggtgactgcattgcagttcagcttctccctctggccaaagtgcttccttcactcctcacaggttgagggctatggttgcactggagaaagacagcaaaaggccaagggcagttactctttgcgaggacaaagtgttgaagtccaacaggcctccttggtagcatataaagagatcctgatcttcttcaaccagagggcagaagcagctgaggctcagaagtgaatggagctccagagaagactggactctccatttagatgagtccactatgccaaggccccagctgggagggagacttgagatgggaatcatggcagctctagagctatctgtgagattggctgaagcctctgtcataactgcatcacagttcaacttgaggttcttgaaaccccaggtcctccaaacactggcctgcagatgtgacccatacccctctgcttgaagacaactcaaagactcctcatgcctttcataacttatccccacctccctgcgtggctaaaagctacagtcaagccacaacacaaccaggccaggaatgtactgggtcccttgagggagaaggagactatacatcaaagacgctatagggcctagccagcatgtactggcagaagcagagaggatatttatggggtgggatctggagggcactgaatctagagaaatagaatataaagttggataatagagagtttattaatatgaggacattcttctatgatacaagatgaatatcctgctgatatggacaggagacagggaaatactgggtagaagagggcagttccctggcaaaggtcccaccttcaagcctggatacccatggccctaaatgggaacaggcattcctgttttcatgttcaaaagttgccttttagcctgccacacccgtttatcctgtacccatataaaccccaaacccccagctccaggagtagatgagcagatgaacagaagagcagcagagaaggagagaagagaaggaacattgggaggagttcagctggggaccgctggagaggaaatcagcctcaggacagccaaactccaggagaagatcaccttcctacttcatcccctttccagctccccatccatcccactgacagccacctccaccacccaataaaacccccacattcaccatcctccaagtctgtgtgtcacctgattcaggacactggacaagagctcaagatacagaaagctgtcacactggccctctgcccttgtgaaaaggcagagagtctactaagctgtttaacacttaagccattggtggatggcaaagctaaaagagcgcactgtaacacatgcccacttgggcttcaggggtcacaggcgcccacccctagatgctgctgtggggccacagcccagaaacactcgccccagctcctgcacctgcctgtctgtgtgctccccctcccataaggggtttgagcagcggctgtggccaaacagacaagccacacccctgttgcacgtcctgcgagggggggtcagagaactctcccgtgtcactgtcaaagctcctatatgcaaatatgctgctaggttgattcctagaagctgggaaaaagcactagcccatactaagtgaagtagcactgtcagaattgccatggcaagtgatagagaaagggaccgaaggcccagagaagtgggcttgataaaacaggcattttatataaggtgagaaaacccaccagccaattaccttccatgggatggaggcctagaaagaatactttgactagtaaagtgatcaaaaatgtgttgatgagaggggcaccagcattattgaagaagctcagtggtggctgtcctttgtagaccagggctgagaatagcagatgctcttatagaactcgctttccctatagccacgggatgatggggtttcaaattaacagaggccaggaagcgcgtggcatcagaaaccaggtgtatgtaattactgtaataaggaacaaggggtggcagtcacagcagcctggcccagacagaatatgacaattgttaatagaacatggcactctgaaggtcaagatagatatgtgggcagccaccaagggtctcactcaatctgcacaatcaaggaggctgagggaggcactctcataaaaagtcacaatctgttgtctagtttctggacctgggccagttttcagacctagaacttggtagctgaaagaagagctgggccctcagcagaaacttgcaacgccacagcaatgtatatggtatgattacctttatttagccttccccacaggacctgtgggccaagggcaatacccagaaactttgaggactggttggacacagacacaaggcctgagctaattgatattggacacccaagccaccaccagggagaatggagggtgaggaggccctatggggagcagctaagaaggtcctggtgcaggtctcgcagtgggctcactgggtcatagaactgtcccatggttatttcccattaagcatataagcagaatggacatatttggcagttaggtgaaccaactagttagtcaaccacattgaggaaggccaagtggaaatctatgaaatttctccccacttccagtcaagatggtaaatcaccaacaatactattaatatatcctgtggggactagaagagacttaaaggagagggttggtggcctccatattccaactgaatcactagtcatccaactgcccaacaggtgcacattgcccgctgcctagacagagccaatttatcaagacggcaattgcaacggagaaagagtaattcacacagagctgtgtgggagactggagttttattattactcaaatcagtctctccgagcatttggggatcagagttttttaagatgatttggcaggtagggtctcaggaagtggggagtgctgattggtcaggttggagatggaatcatagggggtggaagtaagtttttcctgctgtcttctgtttctgggtgggatggcagaaatggctgagccagattactggtctgggtgatgtcagctgatccagggagcacagggtctgccaaatacctcaagcactgatcttaggctagtatcaattttgtttcagagtcaaatcataaactaaattccttcccaggattagcttagtctatgcccaggaatgaacaaggacagcttaaaggttagaagcaagatggaatcagttgggtctgatctctttcactgtcataatttcctcagttataatttttgcaaaggtgggtttcagtcaggccctgcaaaaagcatacaaatgtggtatatttcctagagcaaattaacagtgtatcaggtacctggcatacagccaatctggcaagtgtattcttatccacccctgtagaaaatgaggaccagaagtagtttgcattcgtgaggtgaataaccctatgcattaacatgaccttgccccaaggttatgttaattctctgccctctgtcaaaagatagtctgaagaaagctgaaccttctggacatgctgcagaacattacattcatccatgacattgatgacattatgtcgatcagactggatgagcaagaattgggaagtctggtggagataaacgctatcaagactcaggagcctgctgggacattgtcttcaaaataaaggactcaaaaggaatcacatgtcctatacaatcaacctgggttctgaggtcagcatagtccattcatgggaacattattctggcccatttgccaagacacatggaaagctaccagcattgagtgggacccaggggagaaaatagctccacagccagtccagggtgtgatataagcagtcttgtcacttggtccatacaatctggtattcaaattatctgtgattgagaaaaaatgctatatagagtttatggtaaacctaactggagaatcacaatgtagacccatagggttctgaagtaaggcaacagagaactatatgctacggtttatatatttgcaacagagaactacatactatttggaaacagctcctggtttgcccctggggtttggtaaagagtatttgatcacacaacttgtcagacactcagccacatgtctgagggggcctagtaggaatccatcctgagattgaagtggtacagagggcctacgcagactgtatgagcaggtggtgcagaccctcccgtgtcattcactactgtcacagaagaacttttcctcagctcacgcagatggccgatggggtgaggggtgaatcccttacaaccaactgatggaggaggaaaaaagccaagtttggctcaagatgggttggttcaatacgtatctgcaaaccattaacggactactgcagccatacagccccgtgctggtggtcctttaagacagtaatgagggaaatcattgcaaggcaaacatcaggctatgaggtcatccacgttatgtggaaagagagcagaggccagaaaaaaacatggagtcacgggaatagcaaatggcttggctagttggtcaggggcctaggagaaagaaaagactggggacaggggtagaggcacatggacggatctctaggagtgggcatggaatgtaaagatttttgagtgcaagttaacgctcaccagagagcatctgctgtggaggaggcactcaaaaaccaagtagtccaaatcattggtagtagtccaaccaagtagtagtctagttgacatcagccatcttcttcaatggccactcctgtgctggcaaaattgggtgcatgagaggaatagctatggtggcagcatggaaaacgtgtaaaaagattccattcaccaagagtgatctagctacttactgatgctgccaaatatttaacttgagtgcaacagaaagcaatgctgagccccaatacaatacccatcctttaaggagggcagccatccctctgatggctggttgttcatgctgagccccttccactctagatgggagcagttgtttatcttgactagaattgacacatgttctaggtatgggttttgccttttctgcttgcatagcttcagccaacagtatcatcaaggatttataatgtgtctgattcaccaaatacatgaccatgggacccactgatcctatcacatactgtagaagctggtgacttgatagtacaattggatggtcctttaaaagtacagctgagatgccagtttgtaaataatattctttgaggatggggtagcatcccttaggatgtggggtacaccctaaatcaatgactgttattttggttatgtggccccaatgggtggaattcatgaaactgagaaccaataagtagaagcagaagtggccccacttaccatctttacccgtgactcacttggagaatttgctcttcttactcttgcaactttagactctgtgggtctaaagatcctggtttccacaagggaaaaacttccatcaggagagacagcaagagtcccattcaactttaagctattgctgttgtaaccggaccccggttcagcggctcactgctagaaagccagacatgagaggtgagagttggtggaaggaaaagttggctttaatcaagtgctagcaggcttgtggagctggtttttacaactgggttattttcccttccaccaccctcacttctcatgtttggctttcaagtggtgagcagccatacctgggtctggttacaaacatggcaccccattagatgcgaactgacccccagcccctgctctgctagccataactacagctttaattagacaagagactgattttagtaactttctcctgataagagatcatgactatgcactagttctggcctgtttagagaaattgtgcacttgtatgcctttgtgtcctgaaaataatttttttttttttgagacggaatcttgctctgtcacccaggctggagtgcagtgcacaatctcggctcactgcaacctccgcctcctgggttcacgccattctcctgcctcagcctcccaagtagctgggactacaggcacccgccaccaggcccagctaatttttttgtattttttagtagagacggggtttcaccgtgttagccaggatggtctcgatctcctgacctcgtgatccgcccgcctcagcctcccaaagtgctgggattacaggcgtgagccactgcacccagctgaaaagaacttttgacgtatagggcctaattgtaatagatttaaatgttaagtctccaccccaaatggaacatgggtcatgttcatgttacatgcatatttgtttgatacacgtcatgaattcgccttgatttatattagtagctcctcctataacctgtcacatatatatgtttagctaacctgtcatccccacagaagctctgggtacaattgacagcggggaatgtgcactataattaagactgaatgctgtgtgtacattccagataactctggaaatacatcctcaacgctgcaagacatgcacaagcaaattaatgctacgtctgatcccacaatgtccttaaatcaatggccctcttcatgatctagaacaggcccctcctggtgaagaagaaaaaaggttgctcataattttgttaccggaaaggggtcttgatccagaccccaagagagggttcttggaccttgcacaagaaagaattcagggcgagtccataaagtgaaagcaagtttatgaagaaagtaaaggaataaaagaatggctacttcataggcagagcagcagcatgggctgctcaactgagtatacttacagttatttcttgattatatgctaaacaaagggtggattattcataagttttccgggaaaggggcggagactttctggaactgaggatccctcccctttttacactatatagggtaacttccagacgttgccatggcatttgtaaactgtcatggctggtgggagcgtcttttagcatgctaatgcattataattaacgtataatgagcagcgaggactactagaggtcactttcactgccgtcttggtgggtgccgtgggttttagctggcttctttaccacatcctgttttatcggcaaggtctttatgacctgtgtcttgtgctgacctcctatctcatcctgtgactaagaatgcctaacttcctgggaatggagcccagtaggtctcagccttattttacacagcccctattcaagatcgagttgctctggttcaaatacctctgacaactttagccgtgattatagagataagtttattcttctgctgtgggctgtattgctgttacacacccactatgatgctccagcagatctcttctgtaagcccagggactcatgaatactttgaactccaggaagacaggttccattccatggctccctaactatgctgtttttcagcaggaactagcaagaatgaatacaccatccctattccatagagatggaatacaatttgacagtgggggagtttgtaaccaggaacctcagctttagaaagtgcccattttcttcttccttccctcccctctcacctcttcattccttccctctgtaggcactcccctctgacaatgcatgcttatctaattatgcttttgcttaagaaatcctggaggctaatcttgaaacaaaccaggcatggagcttccattgtggaattctcctgcttaaggggagtcaccaacaggtggagggcaggtgggttacgacaatgccaactagatattgagaaaagtgatctaagaaggcccttcgaacaagacacacagattctacgccctgcgctcctcctgcctgtctcccataccaggtttccctttcaaagccctatggtaaaatttaaaatttaagttggtacttcagaaaactagttcatcatcttcttggtttcatgcgcgtccatgtgaagagaccactaaacaggctttgtgtgagcaataaagcttttaatcacctgggtgcaggcaggctgagtccaaaaagagagtcagcgaaaggagataagggtggggccgttttataggatttgggtagataaaggaaaattacagtcaaagggggttgtcctctggcgggcagagtgggggtcacaaggtgctcagtaggggagcttttgggccaggatgagccaggagaaggaatttcacaagacaatgtcatcagttaaggcaggaacaggccattttcacttcttttgtggtggaatgtcatcagttaaggcaggaactggccatctggatgtgtacatgcaggtcacaggggatatgatggcttagcttgggctcagaggcctgagattcctgtcttctcatattaataagaaaaataaaacaaaatagtggtaaagtgttgggacagtgaacattttgggggatggtatggagagagaatgggcgatgtttctcagggctgcttcgagcgggattaggggcggcgtgggaacttagagtgggagagattaagctgaaggaagattttgtggtaaggggtgatattgtgggactgttagaagaaacatttgtcatttagaattattggtgatggcctggatacagttttgtatgaattgaaaaactaaacggaataagagaaggagaaaaacaggtattaaaggtctaagaattgggaggacctaggacatctgattagagagcgcctaaggagattcagcatagtcgtgccagcaaagattatttatttacttcaagacttaagagtggcagtttggggatagcactaggagataccagctgtgatggcttagagaaaccatgtaaaccggcagtgtaaacaagagcagggcatgtatgagtagttgagaacggtgaataggagtatgactagaaagaaggtagtagggatgacaagtttctttggggcacagtttaagttggtctggcgtcaaatgagtctggggcctaataaaaaggagcgtctatacagaagctcaaatgggctgtactttgtagcattctgaggacaggtctgacttttgagaagggaaagtggtaaaagtattgtccagtcctttttaagttggtggctgagcttggtgaggtgtgtttttaaaagacttttagtccgttctacttttcctgaagacagaggactgtaagggatataaaggtttcactgaatactaagagcctgaaaagctgcttggctgatttgactagtaaaggctgggctgttatcagactgtatagaggtgggaaggctaaactgaggaattatgtctgacagaagggaagaaatgactgcggtggccttctcagaccttgtaggaaaggcctgtacctatccagtgaaagtgcctacctagactaagaggtattttagttatctgactcagggcatgttgagtaaagctaatttgccagtcctgggtgggggcaaatccttgagcttgacgtgtagggaagggagggggcctgaataatccctgaggagtagtagaatagcagatggaacactgagaagttatttccttgaggatagatttccatgatggaaagaaaatgagaggttctaagaggcgggctagtggcttgtactatagcatagcctgcctttgctggtgtgtggtgatgagggctggtggaactgccatcaataaatcaagcatgatcagagtgaggaacaggaaagaaggaaatatggggaaatggggtgaatgtcaggtggatcagagagatacagtcatggtgtggtatcaggaataatgtgggaggccggattgaagtctgggccagaaacaatggtaattgtgggacttaacaaagagtgagtacagctgaaggagccggggagcagaaagtatatgcgtcaggtatgaggaagaaaatagattttggaagttatgagaaatgtagagagtgagttgagcatagtttgtgatttttagggcctctaaaagtattaaagcagcggcagccgctgcacgcagacatgagggctaggctaaaacagtaaggtcaagttgtttggacagaaaggctacagggtgtggtcctggcttttgtgtaagaattctgaccgcactaaccatgcctaggaaggaaaggagttgttattttgtaagggattgaggtttgggagattaattggacgctatcagcagggagagcacgtgtgtttttatgagaattatgctgagataggtaacagatgaggatgaaatttgggcttgactgaagtaatgggggctgtctgtgaagccttgcggcagtacagccgaggtaatttgctgagcctaatgggtgtcagggtcagtctaagtgaaagcaaagagaggctgggatgaagggtgcaaaggaatagtaaagaaagcatgtttgagatctagaacagaataatgggtagtagagggaggtattgagtatgggtttggcaccacgggtggataggcagaacaatttggttgataaggtgcagattctgaactaacttgtaaggcttgtctggttttaggacaggtaaaatgggggaatggtaagaagagttcataggctttaaaaggccatgctgtagcaggcgagtgataacaggctttaatcctttcaaagcgtgctgtgggatgggatattggcattgagcggggtaagggtgattaggttttaatgagatggtaagggatgcatgatcggtcactaaggagggagtagaggtatcttatacttgtgggttaaggtggggagatacaaggggaggatgtgaaggaggctttgaactgggggaaaaggtggcaatgaggtgtggctgtagcccaggaatagtcagggaagcagataatttagttaaagtgtctcggcctagtaagggaactgggcaggtggggataactaaaaaggagtgcttaaaggagtattgtctaagttggcgccagagttggggagttttaagaggtttagaagcctggccgtcaatagcacaacagttatggaggcaagggaaacaggcctttgaaaagaaggtaatgtggagtgggtagcctccgtattgattaagaaggggacggacttactttccactgtgagagttacctagagcatctgtgatagtcttgtaggcttctgaggtgatcgggcagtgtcagtcttcagctgctaagctgagaagatctgggaaggagtcagtcagagagccttgggctagagttctaggggctctggaagtggctgccaggtgagttgaacagtccagttttcagtgggatcctgcacagatgggacatggcttaggaggaatcctgggctgtgggcattctttggcctagtggccagatttctggcacttgtagcaagctcctggggaaggaggttctgggggaacccctggcagctgtggttcaggcgtttggagttcttgtgtgctggagatgtgacgggtttgtctcacagtggaggcaaggaattgcaactcagaaatacattgctacttggctgcctctactccattattgtacactttgaaggtgaggttaattaagtcctgttgtggggtttgagggccggaatttaatttttggagttttatttaatgccgggagcagattaggtaataaaatgtatattgagaataagacggccttttgaccttttagggtctagggctgtaaagcatctcagggttgctgccgaacgagccataaactgggctgggtttttcatatttgatgaaagagcttaaacactcactgatttgggagaggtctgataaagaaaaaggagcattaacttccactatgcctttagcttcagccacctttttaagaggaaattgctgggcaggtaggggagggctactcacggaatgaaactgtaaacgggaccaggtgtgaggaggggaggtgataaaaagattatagggtggaggagtggaggctgaggaagaattgggacctagctcggcctggcgaggagcagcctggggaggaggggagaggtcagatgggtctgtagaaaaggaagattagaaagactcagcgatgcttggggttgggactgaggggacaggcgggagggaaagaaggaagatttgggacgagttgcactgggcacagaggctagggagggactgatgtgtaaaagaatgcctggacgtcaggcacttcagaccatttgcctatttttcaacaaaaattatttaggtcttgtaggatggagaaatcgaaagtgccgttttctggccatttagaactactgtcgagtttgtattggggtcaagcagcattgtagaagaaaataaggcatttgggttttaggtcaggcgagagttgaagaggttttatgttcttaagaacacaggctaagggagaaggaggaggaatggagggtggaaggttgcctatcgtgaaggaggcaagtttaaagaaaagggagagtagagacatggagggaagcagttcgggggttcttaccttccagaaaagcgggaaaggggtcggggcgcagagatacaaggtcaggacacggaaataagggatcagggcacagagatattagaggtgggggtgcagaaataagggatcggggcgcacagctatgaggttggggtacttgcccctcccccagaaaagcgggacttgctgctaagggggaaggagaaggggttgtgggggttttttcctcccagaaaggcggagaaggggtagcgacacagaaggggttggggtacttgcccctcccctagaaaagtgggacttgccactaagagtgaaggagaaggggttgggggtttcttgccccccagaaaggcggagaaggggtagagacacagagagtaggggttggggtacttgcccctcccctagaaaagtgggacttgctgctaagggtgaaggaccaaggcaggcatccttgcatggtctgacacctttgaaacctgggtgaataatgagagaggcatccctgcaatgattaaacaccaagggaaggctgccttctctagtccgtgactggcgccagagttttgggtccatggataaaacgtgtctcctttgtctctaccagaaaatgaaaggaattgaaattaagagaagggagatattgaagtgtggtgccaagattgaaaggagaaagaggttgagggatagtgagggaggttggagaagagagtaaaaagaggccgcttaccggatttgaaattggtgagatgtttcttgggctggtcggtctgaggacttgaggtcataggtggacctctctcacggagcaaagagcagtaggacaggggattgatctcccaagcgaggtcccccgatctgagtcacggcaccaaatttcatgcgtgtccatgtgaagagaccaccaaacaggctttgtgtgagcaataaagcttttaatcacctgggtgcaggtgggctgagtccgaaaagagagtcagcaaaaggagataagggtggggccgttttataggatttgggtagataaaggaaaattacagtcaaagggggttgttctctggcgggcagagtgggggtcacaaggtgctcagtaggggagcttttgagccaggatgagccaggagaaggaatttcacaagacaatgtcatcagttaaggcaggaacaggccattttcacttcttttgtggtggaatgtcatcagttaaggcaggaaccggccatctggatgtgtacgtgcgggtcacaggggatatgatggcttagcttaggctcagaggcctgacacttggtttgctggctctccatttaaacctgcttttcctcccaccaaccctctgtctggcttttgcatggtgagcagctgaacctgggtctgtttacgctgtcacctagtcacttgtgcagagacaagcaggcaaggaaagaagctaccaccatggcaggggtaacccaccaggatcaccaggaggaggcggggctgtcacacagtgggggcaggagggcacacatctggcacccaagtgatccactagggtgtctcatggcaatcccctgcccaatttaaatggaagacggtcagccatgtagagcagacactgcctgagaatcagggcatggggactagaggtccagaactctcaaggatgaggcagcttgggtcacaccaggaggtaagccaccttgactagcagaggtgatggccaaggggaactctcaaaagggtagtaggggagggagagatgcagagatgagcagtgcaagaactaaaggggatgttgtggtgttctgcccagattccacttcaggagggaggtcatcgttcccctagattccagaagttatcccttcccagggatcaccctcagctctctttttaaaatccaggacatcttagaagggccatctagctccaggcctccccatggattttgactaaagcctttgtagtaactgcattgcagtgcaatttctttctgtgccctatttgcttcttttactccttcacacacattgttcctaaaagcactctaccccaataaacttcctctgcaaaaatgtcaggctcagagtttgcttccacagaacctgacctactgcagtcaacatcttagtccaggccaacattgcctggcagctgaattactgtaatagccttcaatgacttccttagggactccctttcaatgcaaatgccctttaggtctgcagtctgctcctaaaactaaaaagtctgttcaatttagcactgataatgtcaattattagcttatcttccaggtgcagaacaaagacagatgagatcaatgttgcataatctattctttttttaactccctttttcttcttcaaacactttttttttttttagacagcgtcttgctctgtcacccaggctggagtgcagtggtacaatcatagctcactgcagccttgaccttccaggcccaagcgatcctcccacctcagcttcctgagaagctggtactacaggcacaagctaccacaactaatttaaaacaattttttttctttttctttttttttttttttttagagacagggtcttcctatcttgctcaagcctggtcttgaactcctgggctccagtgatcctcctaactcagccacctgagtagctgggactacaggcatatgccagcatgctcacctaatttttaaaattttttgtagagatgaggtcttgcaatgtttcccaggctggtgtcaaactcctaagcccaagcaatcttcccaccttggcctcccaaagtactgggattacatgtgtgagccactgcatctggcctaaactttcttttaaaaattagactttacttttaatgtcttttaagtatttgtttgctcctagtttaaaagttataagaaaaaattatttgatgtaattctcctcctgccccaaattgatggtgtatttgggaaaaataattaaattattcttagttagaaatgtaataaagtaggaggtctcgtaaagtggtatcctttgaactgtaagatgaagggaatttccaaggcttaaaactagtaaatttgacaactaaggttaagatctattctctccagacaaagcaggaaggacaagggctgcagtaacctaattaaagtggctagacggaggtaggagttggatgtgaaagctggaacctaactcagatgtatgaacataacaaaagcaagaatttgataatggaagaaatggggttgttctgcttggagtcttgcaaaaggaagtcaggctgggtgcagcggctcatgcctgtaatcctggcactttgagaggccgacgcaggtggaaaaggaagtcaaccaaaatttttgtgtttgctggagtaaggaaaaaaatgaaaattattctattactagtgattcaggatttttctcagccccttcatcagacttgtaacaggtgttccctgtttactcagcctgccgcactcaaccccttgtgagagggagcatgtgagtgagtgagtgtggctcatggtttccatgaggcttgctgtgtggccatgggcaggtgagccaggagaaaaggtgatatgccgaccactctgggtgccagcaggagcaggctctgtgtgggggtgcctgtgaccccaaagcctagaaggaatgtgaccgtgctctcttagctacacagtctgcagatggctgtgtgttaacagctcagttggttccctgccttgtctcgtggggcggctgccctctgccagcaagggcaaagggccagtgtgacagcctttttgggtgcttgcacttggtggctcccaagctcttgtccaagaagaatgcagttgcacagatacttgaaggatggtgaaggcagataattttatttagtgatggaaatggttctcagtcgagaggggagctggagaggggacggaaagggcagttagtctttcctgaagtccggccacctcttccctgaagtcaagccatctctcttctccaaagtccagcatctctcctctctacaagttgagtctggggtctttatcggcacaggatggggctggggcaggccgtaggtagttttggaaaaggcaacatttgattggtaaaaagacattactcagaaagaaccaatcaggagatggtaggcaaacaggaatattagttctcactttgggctgtgagtttcaggctaatttgacttgaaggtgaggtttcctcaggacatgcccgtctgcctagaatttctctgtctctcacctctatcactagaacagtaaaataataataaagcatgtgtttcccaacacaggaagaaaaaatacacttccttgtgctctgtgttcattaacttctgatgccaatgtggcctctcagttatcttctgacagaaagctgggagtgccctaaatctctagaactgtaaattaataaactggcattttgatcaacatattgatctactacttttattatcattagttggttctgaggctaatttgggttctcaaaaaaattattaagtttataaaacctttaggttctgaaaaaatcaagtttaagtactaactcctaacaaaccctaaaaacaaccatatttggatagtcaatctgtccctctctatccacattaattccagctcttatgtcagctttctcctttatctaaaacacaccttgtacttttgaggagttaatgttaataaaaatttccctatgaaaaaatgcgtcccaaatttgattttattttccatgttatctagaagagaagagactgaggatcttggatttttaaaggcctcatgtccagtttccatgaggcttgctgtgtggccaatggcaggtgagccaggagaaaaggtgagccttggtgttatgccaagccatctaattactggagacgccaatgcttcccctatgtttcactagccatcatttttttcttttttcttttttgagatggagttttgcttttgtcacccaggctggtgtgcaatggcacaatctcagctcactgcaacctctgcctcccaggttcaagtgattttcctgcctcagccttcgaagtagctgggattacaggcctgtgccaccatgcctggctaatttttgtatttttagtagagattgggtttcaccatgttggtcaggctggtgtcgaactcccgacatctagtgatctgcccgccttggcctcccaaagtgctgggattacagacgtgagccactgtgtccggctgccatcatttttttcattggccctctcatccatgacccacattacctgtaggttgcctttgtgacccgaatttcaagggggtgacttaatataggtagagaaatagtgatgttaatgaggaacttgttggaacttacagaactgaatagttttctggtttccagaaagaaaaatatttgatcccaatgaagctatttttggcttcctattttctggccccaaatcttccaagaaaaagtctaaggtcacacaaaatgaatcatatgcctgtggcctgggtggttttcagtagttaaaccatttaacttttccaaacactcattccaccaagctcaggaaaaatacaaagttcactcacttcttacctgaagcctatttcagtccttgggttacctgtggagattttatttcatttagaatgaatggaaaggttaagctagggctggaaaagcaccctgcattggctaaatcctgtctctgctattgttgcagctataactccacagggggtcatgtctgaaatggaggagagttaataagaccttaggccaggccgggcacggtggctcacgcctgtaatcccagcactttgggaggccaaggcaggcagatcacaaggtcaggagatcgagaccatcctggctaacatggtgaaacccctctctactaaaaatacaaaaaaatttgccaagcgtagtggcacatgcctgtaatcccagctactcaggaggctgaggcaggagaattgcttgagcctggggggcagaggttgcagtgagccgagattgtgcactgcacttcagcctgggcaacaaagcaagactccatctcaaaaaaaaaaaaaaaagaccttaggccaggaaaatcactgcctagaaaagtgaacaggaaaaaactcactgtgctgtaacaaaaaacactgatcttgaaatcatgagtaatgtgactctgtcatctaaccagagcctgcaagagtacaaaatgttggtcagatcctgcgtatgtgtcactggtctagacatctctgctttacctgaggtgtctggcctacctctatgatacattttggactgggtgggacacagatttcagatagctgccatgcccacacccactttggaggccactgatcttgttttccctcagctcccattattcaagtggattggtttgtaccacaaaaccctgtgcactcctctcactactctaaccctccaatagtggctgggtacaatcagtaggctagctagcaactaaggcatggctgaatctgaaatgaaagaatatagccagtaaagtcaaggcaaaggcaagtcaaagtttaagtaattagatgttgtaatagatgggtgaggatgccaactgacattaagaaaagacttgacaagaggttagcttgtttcagatcaacccttcaatcaaaaataatgaggaaagctgtacaaagcataaaaatatacttgaaggtgttggagtgctaccgcagtaactacgactttaggggccaagaccccagagagaaggaagcccagagagggaagactggtatttggtgttgtaacaggactgccaggtttgtatgcccgctgggcgacaacagatcaatactacactgacaacgggaactgcagcaacattggaatttaataatccaaggctgctggatgagaaaatggaggggaattctcaagccatgaatctgttccctcgaggggttctgggcgtgtctttaaggggatggtggaggacaacaggctggaaaattggggttgttgattggtcctggtaaagagatgaaatcataggatatggaaactattcttccatgagtcagcttcttacggggcccttcagccagccggtgtcagtagtttcgttgatatgcaaaacctaaaggagaaactcttagattttagctatagaacaaagtcttgtgacaaggcctacattttcctggggtagtaagcagcggccagctacagggaagtaggccaaagggcaagctggcttaatgattactgctcattgtactgcaaacctagttgaattttattttctcccttaatcaattttataaagttttcttggggatggtttcagtgccacatctgccaatttgaaagcagtggctgagaaactgagcagtgattttggactttcacaaggctggggtgtttgtaattacaattcagggcccgccaaagatgaaacccagtctttaagtttgtatatctaaagggctacaccctagtagtaaaagagaaacagatcagttctcagaaggctgaagatcatcttccaaacagctcattcccttatttcctaccttgtttgccaaaagtaaaagtagatcatcttgaggaagattataacatctacagcctcaattatgtacagattttcatatactgtgtctggcattcaatcagaatgtattctgaatgaataccagtgtctggtattcaatcagaaatacacagacaaaagacaaaacagagaaacaagagggggaaaaaaaaaacaacagaaacagaatcacaggagacccagatgttggaattatcatatatgagctttaactgtagttaatatgtttaataaattaaatagtgagcaagaacatcagcaggtaactggaaatatattagaggatcaaatgcaaattctggaactgaaaaatatacaaattaaaattaataactcaatagatcagtttagcagaatattagatacagatgatgaaagaaaaataacaactggaagatatgtagaataaaatatttaaactaaatatggagagaccaaagataggaaattcagaaaagaacatgagataaaggacatggtaaaatatgtgtataattgtggtgtgagaggaggagagaaaaataatatggcagaaggaatatttgaagagataatggccaagattcagtgataataaaaaacactttggcaagataaatacaaagaaaactacacacaggcactatatggaaagctttaaaaatcaaagacaaaaataattggaggattaaaaatacattgcccttaaaagagcaacaagactaaaaaaatcatgaaaggtagaagacagtggaatgattcctttgaactgcagaaagaaaataactgccaagccaaatctctgtatctcacaaaaataaagtctctgtatttatttctgtatctcactgaaatagtctctttcctccaaattcaagatagcctttgttcacaggagttgactcggggtaatcaaaagttatatgcagattttcaactgtgccgggcgttggcacccctaatccctgcgtcgttcaagggtcaactgtattacaaacacacagaggcactactgggtatctggttaagttcagtgctatcctggaatgttgactttatatgataaagacaggtcaagaatatttgctttaagatgaggccacagatgtggagtatttttatatgggccggttgcttctgtatccgtaaatagtgctctcataagaaaaaaggaacctcggactgaaagatgactttccccttttggcatggttcactgggcactgaaactgaatggcatctttaaaagtttcacagacaaggtagattcatctccagttatttgctgttaatgcttgagaaattgcaaagcaaccttgggatcctcttgcattaaattacattttcccaaggatgaagcttaattatatttagttgccttggataagcacctatggaggaaaaattttttttttttttttggagacagcatctcactttgtcacccaggctggagtgcagtggtgcaatctcagctcaccgcaaccttcgcctcctggcggagtaatcttcccacctcagcctcccaagtagctgggactacaggcacacaccactgtgctcgactaattttcaagtttttctgtagaaaaggggtctctattgctcaggctaagaataaatattttatataagtaagtgcttatatacccaggaagccaccattctgtcatgcccttacttcacaaagtgttgctttccacccttccccaggggaaaacacacctaacatggcaagattcattggctacagttcagcgaaacatttttggatcctttaggaggaaaaatcttacataaactgcactttaagaataaggttgtgcaggatctggattaaaaaaaagaataaggaagaagttttatgggacctaaatttcacgtcaacagccctttgaatctctggctctacgaggaatgcaactaatccagggaatgcctttctttgaagatgttttatgccactgtgaccccagaggaaagatagatagcaaattatttggactctgatgcaaaaggcatataatctgtatcctgctggttctggttcttactaataaatagttaaaatgatgcattaaaggattataagtgatttaatcaagaatatgtctattctcattgtaaattagcttgcattttctgtattatatgtgaaatcactgagttagtacacactgcaaatataccaaacaagtttgtacctgcctttgatgaccataatccaaatgttctttccattttctgtattgtagtttagtctgtgattgaacatttttatcctacatgttctatctaatattgttaatatgtaacatcgagataaattcagaagacaaactacaacccttgcactaagaaaagtgtgaaacagaccatgttttaacatgaagtatgatgtacgcttttgatctattgcaagttgaagcacatgtttacaggccaaagcttgtttaaaatgatttcagaaccaagtgtgaacatgccatacagaacttaatatagtgtactctaatttttctcagtttgacaaaaaatggacagaaggcaaaatgaaaaaaaatttatttcctcagtgttttatccactgtcaatactgtatttttgatgcaatatatttgccaaaagaactcagcttttattttccattttaaacaactacaatatttacaagctgttcagaataacactcagacacacacacactcacagacacacgtaagtacatatgtccttatctctggtttatactgaatgctggtaaaggccatgaatactttccagagcccatgatcagaaaaggaaaacccattttcctttcttacgttcactttcctagaatcattttcaatattcctccttccatttcctcatgcagagctcattgccagacttgtataggtttaatcagtttttacattttacttttacttaaactataagcttttaaaaagcataagcagacatgattcccccccccccccccatttctattattttggttgtagaatcaagcttcatagataaaaaatcttgttcaatcacaagtacactaaacccaagagtcatctggagcagccatcttatgctctatcactactctgttgtgaattccggggcaccacctcattgtgcaggtaaaactcaggaattcatccccatcacagtgttagatgacctttgttccttctagcttggctccactgaatcataaattgtcaggtacagagctgaggcataagaaaaaaggtataaccctatataataggtataagtcttagaacagagttgtcatataaccttgtggtgacaatcagctctagttccaccaaagaatgtaaggttgattccacaaaatggcagataatgaagttcaactcacaaatagaagttatcttaattcagaaaaagtatgttgtatgtaggcaataaagataaattgttatacataattcttgacagatgactctggtgaggtgattcaaagtagaaaatatacttctgtttcaagcaaacttactccactcatatcctaccagatttatttgtataataattaattcctttccaatcacagttcttcctagacagacatttaacaagtaaaaataagacggcctgggtgcatatcaatcaaccaaattaaaaacaaacaaaaaagatagataaatggagaaaacgattggctttttaatacttatttttaaaaagccatattcaatgtaatattagaattatgctgtcccaatgcatggtagtatctaatttttttcttcctcaacaccaatgaaacaatatccatgtaagactgaaacagaatgtccaacctccattagcaagttccatgtaccacattagccttgactgacgttattatctccactaatctctgaattaaaggaaaagcctctagaataaaaagggacactttataccttatctaaaccatgtatcctatcaaaagagaaaattaactgggtctctgtccaaagtaactttatatgattacattacacagaaaaagaatacgaatgaataatgacgacttaaaaaacaaacatacacacacacacacaccccagaaaaggctttgtccatattcatgacaaattaattaaaataaatataaatgaaattaacaatctggacagcagtttatggttaagtagctagtaaatataaattcaaagaattctgacaaaatcattattacctttttctcaagtcacatatttatttaggaggaaagatgcttgaaagctagctataagaaaaggacaactttagacactgggtgaatcttcagcttaaaaggcccagtgctggatgaatgactcacaacagcaatccaccaaatgcagagctgctaagcagaggcagaaggatgctgctcagaagcacagaggaatttatcaaggctataagctaaacttgctgaaaaatgtgaggctgatttttatattttggtatgtgatggaaaaataaactaattcagaaagaaaaacacatcttcttaatgggttttctacacaaaaacttacattttcattgcctgacatttagtatacagagtaattttccatatctcacttaggatacaaatattgtctgactacttctgttttaagaattataagtagttcagatatacttgaaatattttccaaaatacttcgaatctaatagaaatagattatcatcctccagtaacaaagtcaaagaaggcagaacactggttaagtttgttcactaatttcctaaaaggtaatctcttaaaaaatatacatacagcctcaccacttactcttccaagttccttaaatatcaacatcttatgttaatctagattcttggaaaaattaaagttctttagcaaaaagtcaacattaaagttttatccagtgttgaaaatggtgtaaaaagagagttcacaccaaggtataagttggaagattaaccaaaaacttaggagttataaaatgttttttgccactgaatgaaagaaataaaggaaaaaaaggcaataatttataactcattccacgattacctttctctcaaaagagggggtggcggaagaattaaacaagaaaaagcaaagttttcaatcatacaactccaccaaaaggaaatgaataaaaaagctagtattttagttacatcttttaactttcaaattatggaaattaaagcattggcaaatttataaactaaagacattaatgtatgctgaagtcttgtacataactgaaaaaaagcagagaatctaaacgagtcactcactattctctggggggtgaggggtgaggcaggaacaagaatttatgatcaatttagttaacacaagtatgtttatttccatataataatttagatcaaattattcttaagaaatggatctttcttcaattatcaccaattccctgatgcaattactagaaaagtattatgatttttaaaagattgtcagttttagactcttaagaaaaacaacagggcttcttctcagggttcctaatttataaattcactaaagaattatatatgttaacaaaattcaacttgttttgagaaaaatatatgtcaattgctacccaaaatcaaaacccaacatatatgttccatataaagtctagtcttgcatttgaaatctgacttttcagagtatgtgatgtgtttaaaatttttttggaggaggggctagaaattaaaaaattctagcccttcagattaaatcatgtaaaggtcagattttttttctgtgtgggaaaatgaattatcttccatctaagattgaaaaggctctacttttatctaggcaatgaccatgaaaagatcatattcacttcagaaagggaagaagcagcagggaacatagttcctttcagaagattttaaaaatatacgtatacagagaaatagattataaattcagtttcagaaaaaaaccctccaaaaccaaaaacaacactaaactttaatggcatactgtagatctgccaaaatgaggcaaatgcagaacataatgacggtatcacaaaaatacatttttaaatggtcaatttagaaagggtacttttgtataaaggttcagtaaatcatttgacaagtatttttaaacagtaaattttgtaaagtgtgaagtctatggaaatgtcaacacaaggcacattaggttctgaatgaccacaaaagtttaaaattagaaaaagggaaaataaataggttttaaagtggaaatgcagtaagttctgtatgttcactatttactttcttagttttcattccttctactgtaatgttatgctataatgtgagatctacatcagaattggtaggaaaaacagcttctctcttctgtcacctcaacaaaagatactttaaatctgtactgtctaatacagtagccactaggtacatgtagctattgagtacttgaaatatggctagtgacatatgatgaaatagtaatactttgactatactgggtgaaacaaaatgtatcattaaaattaattttacctgtttctttcaatgatttattcacaaggggtagaaagatggctgctcctaaatgctcagaggagatgtacaattttctttggagtttcacaccaaaagggaaaattttatcaaggatttaaaaaatgctaagagttgcaaattaaatctaaattgaagttcctatatcgcccaattgtaaatatgagtaatatatttccctgaatatgcatttaaaaaaaataaagttatgagacaacatatgaattaagtcaatttcacagttataaatatttcaatttacagctacacactataaattacaggaaataaaattcaagtaacagaaaaagaagaggggaaaaataaaaagcaaaattattaaagagggatataataataactgcaccacttggatacttttatttgaaaaaaaattttacttgactaactgaactgcatgtgaataacttcaagagctagaaactcataaataaaaggcaatcgatcctttctttaaattcctggacattcatcttcttcttaaagaaaattgttttcttcccagaagcacgcccagcagagcttgctctggtggagagaagcagagcacatgggctcctctgagatgtagacacaggagctggcagtggtgttcacaagaccgatccgctgactattggctctgggaaatgtcaatgatgaagctacgtatatcttgagattctatattcactttaaagaaaatacccaatgtcctggcatgaagtacacactactaacagaaaaatgagcagcacagttcctgctacctgtgtttataaggaaagggaaggggctaatcccaaaggcaatttaaataatggtattttatttttatatataaataaatgttctgagaaatctcagactttagtgcattgctgtaaaaaattagtgcagttttttttattaaagtttttagcgctcaaggaataagataaatctatgtctgttcatagtctctttcactgtacattaaacttttatactgctataagtcaaaaggaacatttctacactggtctgttcttaaaaatcaaggtaaatgaatttcatgttctatgacaaaacatggcaattatttttggcaaagaaattagaaaaatatgagatcatagtttagaaatgaagagtttgttgatttaaagcataggcaatgcataggaaaaactttttttaaggatgtattttaacagaactttatccttcatgcaaaatgttttctcggcagctaacttaaaaaaatatttcagctttatttggggatggagacagtgacaggagtcagggtgaagggcaaaggagaggtgcttaaccaagctcattctattttcagtcgctcccacataggatcaaagtgatacctgcaggcatcttctgcttgttcctctctttttccaatgccttggaattgagagggaaaaagaaatgtctttataataaacactggctcacacttcagccccaagttctagtaccccagtttcaattacagtcacatatttatcatcaatctggaccagaagcactgccttgtcgatgtgggatctggtacctggatctctgctgcaaggcacccatcggtgaatcacctaatgattcagaataaaacaagaagttagcactggagacctggaatatactcacaaactcttacccctacctaggattagtagtagcaattttgtctgaaaattatacgtttaagtataaatcagctaaaaccatgcatccaagtgaggcggacttcaaaaaaggcagagccccagaccgccagcttgtaaaagaacttacatggccttccatgccctcctgcggactccagtctttccagctatttctcccagcttttaaccggattccttcatcaggccactgtagctctttccttttagacaggttgatcccttccagaatttgactgggatccacaatctacatggtaaataaaaacatttccaattcatttttttcttgatgatgaaaaattatgtaatctcaaacaaaatgcttttcacagagaggaattactttttaaattcctataatggaataaaaaaaaaatcttaagagctacatcttgaattcttttcagccctctggtagacctcactgcaatgtccatgagacagtggctgaacaaggaacatatatcaccatcacaaaaactgtttgctttcagtttttaagtttgaagaaatttttccccaacattcaaaaatattctagtcctgagactaagataaggtgtgtattcacaacagtccttcattcaacaaataagaaataaaaacaaataagtaacaaaaacagcacaagaccacctctgggcttacttacttggactctgtaaatcacttctgcctttctggagtgtgaattgttggcaggacttaaggtgttgcctggctgtgcatcagtggcactgctctgacctccctctgtcgcaagaaagcccacgagagtgtgatgtttgcaggctgggatgctttggctggagctgctggaggaaggcaggccgtgctgcacacaggccaggccgctctgacctgagggttccatttggttcaccatcgacagtcgggattggatggatgatggcaagtttcgaagcgatatctgactagtagaagagcgccgacaaggcacaaacccagtggtggacatccggagggatgaatgccggctgctatagcagtaggaagactggctggctactgaggcccgggcaggagactgtctgaccaggcccgactgcacagagtgagagctgtggctagtgcctaggaggagaaacagcagcactcactcaaagtagaatgactcagacacaatacttctgttttgcagtttctaagactttttcccctaagcaattaattggtgaactgacagaacttaacgtttatgcctaaaacttttaaagttaagaaaaagaaatacgtatctgagatctattttcttttgtggttcttgtaatatattttttatttgctaaagttttttaaagttcaaattctgtggcatatgaaagacaattaataattaaatattttacagcaaatatcaggacttaaggttgggataaatcctaaaatatgtttcacagaagcattttaaaataacaagaatacttccataatatatcagaaatgaaatatctcacggaaatgagacagtcagaaggatttactaagaaacactgcatgatctcacttgtggaatctgaaaaccccgaactcacagaagcagagagtagaatggtggttgccaggggctggggaagaggaggtgttggtcaaagggtacagagttccactgagtcaagaggaacaagctctggaggtctactgtacagcctggggactagagttaataataatgtgttgtatgcttaaaaattgttgagtagctctaaaacattcttatcacaaagaagtatatgaggtgatggataggttaactagcttaatttaatcatttcacaatatattcacatatcaaaacatgatgttgtataccataaatatatataatttttgccagttaaaaagaaatatttattaaggccctactatgtggcaagctctataactactatttctcaaagtatagtattactgccctttcaacttctaccaaggaaaagctacactgtctatagagagacagtgaataccacgctgtaattttcatatacatttggggatcactactaaatcggaatgatcagtggcactgaaaagcaggttcttctgcatcctttttcaagtggcttgatatgattcttcagacttgtctttttcttgactcataagagtaatgtaaaattaattacattgaaacatagctacatgtactttttacctaaaaataaaaagagctaatcaaggtaagaacaaaaagtacatttaaagaacactgaaagttttaggttttcacctaaataaaaaatatttaat

SEQ ID NO: 5123 - DNA, 4944 bp, Homo sapiens
atatcaagacaccaaaattatttatagctgggcattaaaaatatctgacatttttctccccgcaaagatacttttcttaagctcacactttaattatttgtagactgctgttaagctaaatagccccaaaggaaacttttaattcatttagagactgtcaagtttccaattgcattttaactagaaagccactttcaatagcgtgattgtcacgacaggctatgacggggaaaggtcgcacaatcttgtgggatgaggccagtgaaatagaagctttctctacatcaaaaacagggaagctgaaggctaaatgacccactgtctcacaaaaggcactgagtactatggtctcataaagtgtttttaaaacattttgataacttattttaaaaagaaaaagaggaaactgtggattatgtgagtttttgcagcaatctagtgattccttccagcaggcccctgcttcccaggtctatgagcaactactgctgggccaggccctggctctcaagggccgagtctcagtttaaggccagattaagggggaaaattcgtccgagtagacctggacgaggaaaatttggtatctgtagcttttaagggcacacatatccatattaaaatgcaattcttatctgaaaatttaaaatcataacttatagaaaggagttaaagtcatttacatgcttacagttagagaagtaacttgagatctgtagcttatatgccgcagaagttagccatcaacatccatgcttagttttaaagaataatacttggtaggttgtttatttttaactggcgatagaaagatgggaattactatttattcagtcataggacagtgccccacatcttgctgactgagcacagcgcaagcctgggaaattgctaccatctttgggagtcaggcctcactgacacagaccgttctgaatctctgaccgtgacgcctgtctctgggctactcaacagagctgaatagctgggaaggctgatggctcaacccaactgccaagttccttccagagtggagattctgacttcatggcccttcccaggcaggctcacccaaaggaaaatggagtgaagaaaatcaccagcaaatcttccctgccgagggaccttggaacacccatatcagtttacattagcaactttatgaaaaactctctttaaaggaaagtttggatacatgtctgtatacataatatacatctatgtacacatacacacactatatacactgtacatatggagaggatataaacacatgtacattcattcagtcttacagcctagaaacctgtacacgcacaatgctgctgaagggacccagggctggacatacgaagtgcacgctggtgggaggcacacaatgagaaggtccagaccctgtgtacaaaagacccaaaccaaccctgtcttgatgaggggttggctttaaaaatttacatcaaagttaagacattttcaaagagcctcataactgagagaatggaagctggataaaggaagcacgtggggcatctgctctgctggctcaggcattcccagggcccagtgggcaccgccttccctgggagaaaagtggctgtcagatgatgagacttcctatgacctggactaagaaaagagttaaaatgttacctatgaccccattgcacataaagtcatttacactggaaagtgggcaacaagcttctggactccaatgagatcaggtcccagaacatggatgtacacatgtggcatgaactgctgattgcggccaggggctggaagccctgcagagggcgggctgtgagcaagagtgctctgcaggaaatgtcctcaaaggactatgaaagtaaaagcactagaaacagctagagtccttagaattttttgctccttgccgtaactatcccccaaacaagtaagacagctaataagtatgtgtgtagcgtggatattgccttgagattaaggagcctaacgcatccactgttaacaccatggctggtgtcctaactgcctcagaagagtccacattcaatactgacaatgacaagctaaaaatcagtccctcttgagggcaattacacatcttagaagtgactacacctgaaattaaatataaagcccagaacagcaaaagaacctcaaaccacagccttatggcaagggttagacaataaatgtaactcctcaggacacagaaatgtcaaattaggagagtatggtaggtaacacacttccttaaaaacaccttccaggagtaacttgaaaagtattacttgctcaactaatttggtctttcaaaaaatctcttcctgtcctgttttatgctaatgtgtaatgatctccaccattttcaacatctatctgtcttaacccaacattatctgagatacttctggaaaagagctcacttaactgatgacagcatgtgtctgtcccacctctctgagccagctgcctctcctcattgagggaggagcagccaggccagtagaagagggagcatgaacgtggctccatggagttcagtagccagaggacaggtctcacttcatgaaacccaaagtttcacaaactgctaataagggctataagccctgtgaaagttggagcccaaatatttggtttgcatctctttaagtaattcttgactttgggctgactttacttaaccaacctgacaggagatgaaatggacctgcagtcagaggcttgaaatgagttaaagcagcaagaatacaggttacgtggacatgatccttaaagaaaaggccacttcaaagtaaggccaagaggatctcagaaaccaaccaagaggtgttcaaagcccaaaacagtccctggaatcagccatcaccagcaaggggacttaaagagcaggaccaggttagaatcagcacctttccaagcaaaatcacgttttctgcaaggttgtttcaccacagcccaacacttccttatccagcctgagtctaagcagcctactggctgccactgaatgacctgggaatgagaggaggggctggtggagaccttttcaccaacaccaagaactgggatctgaaagctgttatgcttgtattcccagggaactgcaacatggccctcatggtcactctcaaggatcaaaacgacggaaggcaggcaacaatctgtgttagaggcaccactgagctgcaggatgcctgctactaaaagccttcacaagcagaaatgaaacaaacctgccctaattccattgtctcagctggttttttgtcttaattttgaaactgaaaacacatcagggttagaaaagtaaaaattactttaagctggcaaaattaaatcctttccatcattttataatggccactcccactactctccaaaatttgctgccaaggcaagaattataaaatgatataattaaatccaaacaagaatttagaagttggaaacactgttcccacttaccctactaacactgacttgcgtaaagtgctgctaacccttcaggatcaagcatcctgttctgccttgagcctgcagcagcttccattctgtccaatgtggcaccacaggggcgtctgtagctggccagactgcacccctgtggagcacatgtggcgccagcctgagccagatcagagcacctgtgagtcaggggagtgtccagggatctttttggatatcatctgattaacaaatcaagagaggcaaatttaacccaacagggtgtattttcttaatctggactatttaaaaagcaaaagacaaagcaattgaccgggtcttccacatgccactgttctcaaacaggaaaagcttgctatatattcacatccgtgggaatttacgggtgtttgaagttagacataacttccttttaagcgcatactgttcttgctgtaaactctggttgctacaatttatgaggagaaagactatcaccctggaaattgagggttgtttttaaggagcaagcagcctgcatttaaaatgctccggggtggtcggctggcacacacctgggggaaccaaagtgcacagtgtgctggtaacattaacagacttgccaacagagatgctgagtctatacacatttttaaaatctctggtatttaaggtcaacaggaagaaattgtcctgaaaccttccatccagctttaccaggccctaaccactctcgccaggcggcagcaggctcctgcccagccccaatccagcctcacagttatgatggagctgcagaaacacgagcccttttcaagggggcatttggagtggaaagccctgggaaggtaacgctcacactccaaggccacactcctccatctggacaaacacacaagcacccccaattgtattggaagtactgtcaagagctcaaaatgcccaccttgcactttttggtcacaaggctccatctgccacgagcggcggatgtgacttggggatgttttcacttgctggaggaactgtacatctcatttggcagttaatgtctgactagttgcaatccaattcagataaccagtcatcaaaggagaaccccaggttctagaggagtctgcagatgcccatcagagaccaggaccaagtagtcagggaacctgacaagtgtctgctctatggctagaagcttctgaactgggtcaccaccgactgtgctaccacactcccacttactgcatgatgcaaatgagccacgtttccattcacagaattcagctcaactccacaacatgtgcacacaattaggaatgatgccttcttttcttaaacataaatgattgtctcctgtaccctagtgagttttcacagaaatcattagcatttcggcaaaagacatacacagttttccatttgccctgcccacaggcaagatgttgctaacgttacacattgataagtgcttagaaagtgctaatattattaccctggtaattagtatctata

SEQ ID NO: 5124 - DNA, 480 bp, Homo sapiens
acagttcccacactgcagtgcctctggtgaggagacagcgccactgaggcctcctctgaactcccaaaatgtgacctatgccatcaccgaggccgcaggaacaagaggtgggtgtccatgacattggtacctgtcatccctgtgtgcagcaggtgtgccccaccctggaggcagcagaagaaggtatgtgagtcattgtgggctaggaaggtggctatgtccaggccctcagctgcagcctggctggcaagctcaggtgtgacccaggccccagcagcctctgtgggcccatcctgcccatcggtgccaccgctcaaaaacagcacatctatcggccccagcggccaccttctcaactctgctccaacacgcagggccagttcctggttccggccacccctgcccgagccctgcagctgtactgtgggctcgccaccagccagcaggcagactgggccccttccccatgccatggtctcc

SEQ ID NO: 5125 - DNA, 3660 bp, Homo sapiens
tttaaaaatgtactccgttctccaactcctgaaatgcctctgcagttgctggagaaaagggcccgaaggtcgccgttttcaaacagaagctgccgtgtgtgcgcgcccggcatggtctcctcatcccgccggggccagtgaggctctgggggctttgcccccgccgcggcagctggtagagaagagacgtgtttcacctccccgacgtctggaccagtctggaagggatggaggcgctgtggccaagtgcagtctctctcggggtctctccccgcccgggtggacagggcgctccctcctccgcccctggggctcagcagcagtcctgggcagccgtgcggccctcgcctgcgtcctgcggccgtcccgcggtgtcatgccggcaacaatacaaagtcgtcgttgacgtcgaccatgggcacgtagaaggagggcacctcgttcacgcacagggacttgtgcccggcggggtccagttcctgcaccttcagctgccactccatcctctgcacggcgttcagggccgcggcctcgtgctgctgccgcatgaggaggaaagtcttccatgtgtctttatgaagctttcagttttttctcacggctctggttaggaagggcctagtggcctggggagggtgtggtgtgagtgacttcctgcaccatcatcttagggctggccagaaatgcacactcagctacgcctcagacctgagttcctcagcacaagcccccaggggccacgctccccaaatacccacagctcccaccgggtagggctggtggttctcatctgtgcccacatcagcacctttctgagagctgcagtatgacacacgggtgcttggttcagggacctgggtggtgctgagcctgatactgcaggtagccggggccgcctgctcccaggcctggctggtgactgtacagggtgacgctgactgtaaagttctgtaacttttggcaagtttccgccttccgttgcctcctggtggatcctccagggtgtcccggtgagcagccctcgcgaccgggataagggtgtgctgcccttcccggcacctcccccgcccctgcccaccgccctggccagcacttccagagcagtggagggtgaatgctgggaccttagagggggctcacagggcagtcccaggagttctgaccatcaagcctagggtcctgttgagctggcgacaggagccgctccctgcacaccgggacagaagggaagactgaggaggccacacgcagggacaggacctcacctccccgaaagcatcggccagattaagagaatctgaaattgtcaccgcccatcacagaactgggcagcggcctccccccaggcagcgcaaagggggttgtcaccacccatcacagaactgggcagcagcctcccccaggcagaactgaggggacgcgcaacaccgaccttcatgcggtcatacttgtcatccacgtcctggagccaggagatgaactggcgggcgttgaaacggtcgcgcactgacttgttctcgtcaccctgtggaaaccaaacacgggagtttcatcaggagccccagagaccgctacgggaaggcatgccagcctgggcgatgctgcagtgaccgttctcaagggacaaccacagggggagcctcattccaccgcgcacacactgaatcatgttcaaggcatggcaggcgcaccctgcccatctccctaaacagcctccctaaaatgcgcgtggaggcagctgggcctttgtctcctgggcaccgggtgcccgcaggccccacctgtgagccggtccccagccctgcccccaggggacagtcagagctcagcccactgccaactcctgggagagacttttttttttttttttaagagacagagtttcgcttgttgcccaggctggagtgcaatggcgcgatcctggctcaccgcagcctccacctccagggttcaagcgattctcctgcttcagccttcctgagtagctgggattacaggcagccaccacgcccagctaattttgtatttttagtagagacggggtttctcctgggcgagactttctagatatgtcaccgtcctgtgtcctgaagggtggacacggataagatgtccaggctcctcccctttttcacgggttcatggtgaagctgacaatgccgtctgtttctcagaacatgtggagcaccgacagaaacccacacacctgcagggaactcactttccacaaaggtgccaagaacagaataacgatcacagggaaaggacagtctcttccgtaaacggtgctgggaaaactggctacgcatcgcagaagagtgaaacgagaccctagctctcgccacatacaaacatcaaaccaaaatggatcaaagtctggaatccaagaccttaaacgatgaaaccactacaagaaaacactggggaaaatctccaggacattggcctgggcaaacatttctcaagcaataccccgaagcacaggcaaccaaagcaaaaatggacaaatgggatcacatcaagttcaaaagcttctgtccagcaaaggacacagtcaacagggtgaaaagacacgcacagaatgggaggaaacgcctgcaaaccgctcctgtcacacagattctcaagcagaacatagaaggcatgcaattaactcgatatgaaaaaatctaataatcccatcaaaaaaacgggcaaaagatctgaatagacgtttctcaaaggagacacacaaatggccaacaggcatctgaagaggagctcaacatcattgatcgtcagagaaatgcaattcaaaactaccgtgagacatcacttcaccccggttaaaatagcctttatccaaaagacagacaatcacaattgctcgcgaggatgtggggaaaagggaaccctcgtaccccgttggtgggaatgtaaattaaaacagccgccgtggagaacagtttggcgtttcctcaaaaaactaaaaattgagctaccataggatccagcaatcccactgccgggtatagacccaaaagaaagaaactgggggccaggcacggtggctcacgcctgtaatcccagcactttgggaggctgaggcgggcagatcacctgaggtcaagagtttcagactagccttgccaacatggtgaaaccccatctctactaaaaatacaaaaattagccaggtgtggtggtgcgcgcctgtgatcccagctacccgggaggcagtggctgcagtgagctgagatcgtgccactgctctccagcctgggtgacagaggaagactcagaatcacaaaaaggaaaaggaatcagtatattgaaacggtgtccacactcccatatttaacgcaaccccatttactatagctaaggcttgtgtccatcaacagatgaatggataaagaatatgtgctacatacacaacggagtactattcagccacaaaaaagaatgagatcctgtcatttgcaaacacgtggatggaactggggtcatgatgttaagtgaaataagcatacaaagacaaacatcacatgttctctctcacttgtgggatctaaaaatcagaacaattgagctcatggacacagagtagaacgacggttaccagaggctgggaagggttgtggggggctggcagggaggtagaagtggttaatgggtacc

SEQ ID NO: 5126 - DNA, 481 bp, Homo sapiens
gcaagcacaaagtttggccagccacacattggagaaacaaaagcaatgtttaaagtgttccatgtaacggattttttcccaagatatggacaaagctggtttttactctccagagtgttgcacggagtagggcgggcttgggggttaagcgcatgcgagagctctgtgcgctttacaggacctctggaagcaactactcctgattaacctcggtgaagttaaggaaaacttcgtggctgaagatgtgaatgaagaacaagattactatcctctgccagcagctcccagatcctctccctctctttagctttcactgtgtttgatatcaagaatatgaaatgtgaattccacggtccaagaggggaagagtcacctttcacaaacttcgttgttctcttctttggaagggaaattagtgttctaggcgattgagtcccttcattaatgaaacttgaaaccctgttatgcattggcaaatcac

SEQ ID NO: 5127 - DNA, 12042 bp, Homo sapiens
cttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctggtaagtacaatgatcccagggctaggacaccaacgagattttccaaagggcagacgagcttcagcggttcctccacccccattccccacgtgtgggagccctcctccctagcggccccgtcctgcaatcgtccccctgcgcgaagacttccgtttatctccagcatggatggagggaaagtcaagctcaaacacaaggtccccatcagcaatggaacccaatgatccgctgggggttcaaattgggggtgtcaggcacgggtgtctctggagcccagagaaaaatccaagattctttgaaatggcaaaagcccccaaaagtgactttcttgtattgccacgatgaactggaactgccctgacaaactctaaaaagatagagaccttaataaattgtgtagagaagaattaaaagagtgaatacagatgcatggaaaatctctagaacagtgcctggcactcatattaagtattggctctcacacatggataacagacacaaggagaccaagtgacttgccccaggtggcacaactagttagtggcagagatggaggaaaaaccagtctctgattctttgttcacagctcaggtaccttcagtcctttctgaaattaagtgagagtataaataaagtcatttagtggataaatgaattttaccactgttaaatatcagagtagacctggcacagtggctcacgcctgtagtcccagcactttgggaggccagggcaggaggatcacttgagcccaggagttcaagaccagcctgggccacacagccaggagtttaagaacaacctgggcaaaacagtgagacctcgtctctactaaaaaaaaaaaaaaaagaaaattagcctggcatggtggcatttgcctgtagtcctagctacttaggaggccaagggagaaggattgcttggcccagaagtctgcggtgagctatgatggagccaagaaattagattcctgctcctctacttgctactaaaagggccaatcctcttgttaaatcccaaaacataaggcaggaaaccaaatgagcctctgctcccactcattggagcccttgttcccttcaaggagccctagaagatggaagagtatttgctgcatcagtcacttctccctctcctgacactttgtgatgtgtgatttcatcacacttttgctgtgatgaaatctcagcttctcccaaatgctcaccaatatcctagcctccaacctggctggaattctgctattctctttctaactcaaattggcattcagcatttctaggtgtggtcaggtaagacaccactgctgagtggggacaagaccaggaaggctaaagtcagaaaaaaatcagaggcaaagccaggcacgactgagggcgcctgtagttgcagctactcacaggctgaggcaggaggatcgcttgagtttgaggcaggaggatcgcttgagtttgaggctgcagtgcgctattgatagcacctgtcaatagtcactgcactcgagcctggacaacacagtgagatactcatctctttaaaaaatttttaattataactgctgggcgcagtggctcacgcctgtaatcccagcactttgggaggctgaggagggcggatcacctgaggtcaggagttcgagactggcctggccaacatggtgaaaccccatctctactaaaaatacaagaattagccaggtgtggtggtgcatgcctgtgatcccagctactcagaaggctgaggcacgagattcgcttgaacctgggaggcggaggtttcagtgagcccagatcgagccactgcactccagcctgggcaacagagcgagactccatctcaaaaaataaaaaaataaattaagtataaccaaaaaaaagcaactaaagacaacaaccaaaaacaaacaaacaaacaaaaaaaccagttacatgtttgcttttaattctattagaataaacaggagggctccaaaaaaatcctcaaaggagtttccatatttactcacatattccacccttgatatttttattctcaaagcacaagaatgagggacctaattataagaggcccatgctctcctgccatccttacatattttcatttatctttgagactctcacccctgggtaactcaaaaagtggctcatctgtagttaaaaagcaaagttaattagcatctggcacttccttctttccttcctcaattctccaagcttagactaaaagtctgtcttaattgaggcttcctgagtttgtgacctggggcaggagttgaggggttggggatataagcagagagagaaaaaaaaaaagcttgggtttgcattgctcattcttttttcttttttctttcttttttttttttttttgagacagggtctcacactgtgacccaggctggagtgcagtggcgctatcacaggtgcttgaccttgtggactcaggtgatcctcccacctcagcctcccgagtagctgaggtgtgtgccaccatgcccaactaatttttaatttttgtagcgatgaggtcttgaggtcttgctatgttgtccaggctggtctcaaactcctaggctcaagggatctgcctgcctcagcctcacaaagtgttgggattacagatgtgagccatcacacccaactgcattgctctttcttttttcttttttttttttttttgagacggagtctctctctgtcgcccaggctggagtacagtggcaccatctcagctcactgcaacctcggcctcttgggttcaagcgattctcctgtctcagcctcccaagtagctgggattacaggggcctgccaccatgcccagctaatttttgtattttcagtacagatggggtttcatcatgttggccaggctggtctcgaactcctgaccccaggtgatccaccctccttggcctcccaaagtgctgggattacaggcgtgagccactgcgcccagcctgcattgctcattctttcaagtatcagccaaaaagcacgtgtggctcgtggttgcagggactcctcccattgagagatggcctctgtgtcccctcctcttaaatctagtgggcttgtgactgccaagagagtatggcagcagagatgctaagtgacttgagaggtgaggccatgagaagccatgccgcttcctccttggttagaatgctggctcttggaattctgagcattaagttagaggtctgactaccctgacgctgccatgcagtgacacaacccaagcaagccagaaggagaaaccatgtgaaggcactcaagttgacagtcccacctgagcccaaccttcgtcatcccacccaggtaccagacatgagtgatgaaacttccagatgattccagaccccacctgttcaagttgttaccaaccccttgagagtcttcccagctgactccagatatcatgggagcagagccaggccgtcctgctgagctctgtcggaattcctggcccctgggaccgtgagcatcacagtgttgctttataccgctgagcttgggacaggctgttatgtagcaagagatccctagaactctgaagatctcataaaatcctcaaaacaaccccactaaatagttacaatagtcatcttcatgaggaaactgacgccgaagccgtgcaggaagtgacagagcaggaatcagaacccacctggaaccaccacctaaaactgcttctaacaccaagttgtcccactgctataaggcacaaggctcgttttttttgttgttgttgttgttgtttttattttttttttttgagacagagtctcactctgtcgcccaggctggagtgcagtggcgcgatctcggctcactccaagctctgcctcccgggttcacgccattctcctgcctcagcctcccgagtagctgggactacaggttcccgccaccacacccggctaattttttgtatttttagtagagatgggttttcaccgtgtgagccaggatggtctcaatctcctgacctggtgatccgcccgcctctgcctcccaaagtgctgggattacaggcatgagccaccatgcccagcctgttttggttttttggttttttttttttttttgagacaatgtctccctttgtcacccaggctggcatgcagtggtgccatcttagcgagacccagccccccaaaaaaaaaaaaaaaaaaggtccagggcccaatcccagtggggaaagcgtttgacacgtcccaccatggcactgggtcacccctatgatgggttacaccatctaacagaagtcagcagagacatctcctttcctggttggcccatgagtgtccctgagggacagggtcagttcccactaaaatggacatccattgttacacatttaaaaccccagtggtggctcatgactgtaatcacagcactttgagaggccaaggagggtggatcacctgaggtcaggagtttgagaccagcctggccaacatggtgaaaccctgtctctactaaaaacacaaaaattagccacctgtggtggtgtgcacctgtaatcccagctactcgggaagctgaggcaggaaaatcgcttgaacccaggaggcggagatggcagtgagctgaaatcgtgccactgcactccagcctggacaacagagtgagacagcgagactccgtctcgaaataaataaataaatacccaggccagacgtggtggctgacgcctataatcccggcgctttgggaggccgaggtgggcagatcacctgaggtcagaagttcgagaccagcctggccaacatggttaaacttcgtctctcctaaaaataccaaaaattagccaagtgtagtggcatgcctgtaatcccagctactcaggaggctgagacaggagaaccctggaggcggaggttgtagtgagctgagatggcgccactgcactccagcctgggcaacaagagtgaaactctgtctcaaataatactaataataaaataaaaaataaaaacgcagccttggctaggtgtggtggctcatgtctgtaatcctagcactttggtaggccaaggcaggcagatcgcttgagctcaggagttggagaccagcctggccaacgtggcaaaaccctatttctacaaaaaatacaaaaattagccaggcgtggtggtagtcccagctactcaggaggctgaggcaacaagatcacttgaactcaggaggttgaagctgcagttgggaaaagctgagatttcatcacagagaactcatagctggtccaaagctaagtcctgggcagactgaaatcccttccagaacaagctggctcattctccaaagctaagtcccggggagactgcagtcccttccagaacaagctggatcactctccatatgaaactacattcagttacttccgtcctgagattctcaccgttgtgtagcccccacccacattcacagtcaatgtgacctaaagaatatggcacagtgatgggatagcacctttaacattagattataaaagaatccgggccaggtttggtagctcacacctgtaatcccagcacttttggagcccgaggcggggaggcgagcagattgcctgaggtcaggagttcaagccagcctggctaacatggtgaaaccatctctactaaaaatacagaaactagtggcgcacgcctgtagtcccagctactcgggaggctgaggcaggagaatcgctttaacccgggaaggggaggttgcagtgagccgagattgcgccactgcactccagcctgggtgacagagtgagactccgtctcaaacaaacaaacaaaaaaagcagcagcagcagccaggcatggtgatgcatacctgtagtcccagctgcttgagagggtgaggctggagggttgcttgagcccaggagctggaggctgcagtgagctctgattgtgccactgcacctcagcctgggcagcagagaccctatctctaaaattaattaattaattaatgaaaaaattaggttatgaaacatcactggggcttcagtcttgggcttatacaccccctcccctcccctcccctcttctctctctctctctgtctctctccagtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtctgccaagtgttggcgtgatttgttaaacagcaaccagtaactaatacgccacccatggctgccgcgttcctgctgtggggccagcactattccatgcttagaggctccatcaatacctgtgatggactaaatggtcagtacaaacaacagctcctctgtaatggtatgaggcagacaggtttctaaaggcaatatgctaaggtgcaaactcaaccccaaaagaccacatagtgtatcatcccatttatatgaaatgtccagaacaggcaaatccatagagacagaaagcagattagtggttgccagaggctgagagatggaagaaaagtagagagtaactgctaatggtgtgaaatctctttttggagtgatgaaaatgttttaattttttttttttaatagagacagggtctcactatattgcccaggctggtcttgaacttctaggctcaagtgagttcagcctcagcctcccaaagtgcttggattacagacatgagccaccatgcacagcttaaaatttatgatgctgatggttgcataactgtgaatatactaaaaaccactgaggcggggtttggtgactgacacctgtaatcctagcactttgggaggccgaggtgggaggatcacttgacaccaagagtttgaaaccagcctaggcaacatagcaagactccatctctacaaaaaatttaaaaataaaaataaaaaccattaggccaggcatgatggctcatgcctgtaatcctagcactttgggatgccaatgcgggtggatcacctgaggttaagagttcgagaccaggctggccaacatggtgaaaccccatctctactaaaaatacataaagtagcccggtgtggtggtgggcgcctgtaatcccagctactcgggaggctgaaacagaaggatcacttgaacccgggaggcagaggttgcaatgagccgagatcacgccactgcacttcagcctgtgtgacaggagtgaaactccatctcaaaaataaaaacgaaaacaataacaacaacagcaacaaaaaaccattgcattgtgcacattaaatgaattgtatggtatgtgaattctagctcaataaagcttcttatgctaaaacatgacgaggaagaagaggaggaggagaagaggcaaagtcactggtgcccaaggaatggcaccaggagtggtctccaggaaggctggccacctgtagggctgggagagctctgtgatgctgacatcaggggccttcttcatgcctgagaaacaggacatgggctaagggcggctaaccaaggcctgggagaatattgagaggtaaacaggcgatgtgggtgtggggcgctcagcctacttggccaaagggtgagttcttgctaatttcacagggagagcctgactggtctcaagcacctgaggcccagcatgagaagtcaacatccctgacttctcatcctctatagaaatttcccccagaccaggcgcggtggctcacgcctgtaatcccagcactttggcaggccaaggtgggcggatcacctgaagtcaggagttcaagaccagcctggccaacaccgtgaaaccccgtctctactaaaaatacaaaaattagccaggcatggtggcacgtgcctgtaatcccagctactcaggaggctgaggcaggagaatcacttgaacctgggaggcggaggttgcagtgagccaagatcgtgccattgcactccagcctgggcgacagagcaagactccatctcaaaaaaaaaaaaaaaaaaaaaagtttctcctgactacccggaaagaaggttcacacacccagctctcgcaggcatgcttccccatgtgcctaagccaaggcccttcccacaaaaggggccttacacatgccccaaaggatggtcctcttccagaaatgagccgatgatacagtggagagtcacccaaagacgcaggaaagtcgatccttgctgaaagccccagaaaggggctgtaaatttaggacaaaggatttaaatggcaggggcaaacttgtgcaatgtcttctttaagaggtggtcaagaaagaaaatagaaacaggttcaagacagactttgaataggttgctggcaagtgtgtcttacagaggtgtcacagggtcagaatgatttgcccctttgaggttggtttcagagtcagaatctcatacgacagagaagctagaggttggacctaaacagtccttccctgcacaccaacagagtctgtggatgaaagagcctttttctggagagagtccatgcttttctgcaggttttcaaagggatttaaaatctgagacaggttaggaaccactgggtgacgtggttctggggtaggtggaagatggagtttttttctttttcttttttggagacagggtctggctctgtcacccagactggagtccaatgccataataggctcatggcagcctcaacctcccggactcaagcgatcctcccgcctcagcctctcgagcagctgggactagaggtgtgtgccaccatgcctggatagtttttgtgttgctgttttttgtagacacagggtttccctatatggcccaggttggtctcaattgatcctcttgccttggcctcccaaagtactaggactacaggtgagagccacagtgcccggccggatttttgtttttttgtttttgttttttttttttttgagatggagtttcgctcttgttgcacaggctagactgcaatggcgcgatcttggctcactgcaacctccgcctcccgggctcaagtgattctcctgcctcagcctcccaagcagctgggattacaggcaggcgccaccacacccagctaatttagtatttttagtacagacggggtttcaccatgggctggtctcgaactcctgacctcaggtgatctgcctgccttggatctctcaaagtgctgggattacaggcatgagccaccacgcccggcccagattcttttttttcttactctgccaaatctatattttataaacttttaataactaacttgtgttgattccatgtaattaaaaacgtacagtatgcatgaataaacacatttataaaacatatggcatatatatttaaaacatccgcatgcacgatctggaagatcacggcctataattcccagatgcagcctctgctgtaattttttttttttttttttttttagacagggtctcactttttcactcaggctggaatgcagtggcaccatcttggctcagtgcagccttgaccaccctggttcaagcgatcctcctgcctcatctcctcaagtagctaggtctgcagacatacgccaccacacctggctaatttttgtattttagtagagacggggtttcaccatgttggccaggctggtcttgaactcctgacctcaagtgatctgcctgcctccgcctcccaaagtgctgggattacaggcgtgagccaccgcacctggtctgctgctgcaatcttaagatggccatataatatctcttaaaactacaaattccactttccttcttctgtcctgacctcaacttaatcacaaacaaacaacctccctcccaaaacacacacacacactcatggcagtccccccgtcaagtgtcagctatgtggtagttcgccccattctcctggggtgagatctgcagctggctctctgcccaggcactcggcactcaggccctccttccctacccggctgtcagcttaggggtcctcctccacctatcctcgtgagatctgcagacaaccctgtaagctctgaaccaaagaggaagaaatcctggggatgacatagagggctctggacacctcatcccaccagtcattgtcctggtcacactctctccttggcagggggcccgtgacaatgcttccattctcagagcaggtctctgggccactcctgcccctggagcctctgggatcggttcagactctgtcccatagcacagcctcttcatctttcaacaggctcatcttcaaggctacagcggccagcccccatgactaggcacctgatgtccattttctcattaaacattgtgacaagccccgaaggcagccattcagttttatgaatgaggaaagtgggactcaaggaggtgacggggaaggaagtgggtttaggtttattctggagcctgctctttaccaccgtaccactgcctctcccaggccagtgcactggagccagatggtatcaactgccagctcaaggacacctaggtcaacttcccaaaagaggcctaggggttgggcaaggaggccattgagattgtagaggccaggccttgcttgcccctggcattggggagaatgggcaccaccccaggccaactggggaagggccaggcaccagagctgcgtccttctgcccactcttgctgtagaggatcagagtccaagacgccaactccatcagacacaaggaccttcaagagcaaggaactaggctgggcacggtggcttacgcactatggggggctgaggcgggaggatcacttgagcccaggagtttgagaccagcctgggcaacttagcaagaccccatatctacaaaaaatctaaaaattagcttggtgtggctgggtgcggtggctcacacctctaatcccagcactttgggatgccaaggcaggtggatcacgaggtcaggagttcaggaccagcctggccaacatggtgaaaccccatgtatagtaaaaatacaaaaattagctgggcatggtggtgggcacctgcaatcccagctattcgggaggctgaggcaggagaatcgcttgaacccgggaggtagaggttgcagtgggccgagactgtgccattgcactccagcctgggggacaagagcaagacttcgtctcaaaaaaaaaaaaaaaaattagcttggtgtggcggtgcacacagtagtcctaactgctcaggaggctgaggcaggaggattgcttgagcccaagaggttgaggttgcagtaaactatgatcgcagcactgcactccagactgggtgacacagcgagaccctgtttctaaaaaaaggaaaaaacaaaacaaaaacaaacaaggaactctgcctggaagtccaactaagtcctgggaaggtggggacggggggtgggggtgaggggacaagtgaaaaagagccaggaagcccctcctgcatagccgcctgactcccagaggcctcctgagtcctcctccctgggatctggactcccctcccccaacccagcacttcttcctgggaacaagcccgtgtttggaggcagcatggtgcagggttaggagcagcctctgccactttctggctgggtaagacttaggtaagttacttcccctttctgtgcctcagtttccccatctgtaaagtgggaatcacagtagtacttaccaaacagggttgtctttttt

SEQ ID NO: 5128 - DNA, 3700 bp, Homo sapiens
agaccacaggacctgggtgaccctgcctcccacagccctcacctccaggagtgactgtgggctctgggcccaggactggctgcttgttgcggttccttctcaaagggagccactgtccacaggtccaagtgcctgctgggcggctgttcccagaggcagcccctgcaggtgtgcagcaaaggggccgacacagagctcttgggtcaaggctggcacgtgctccttgcttacctggaggtcatcagagttgccccacgcccctggccttcgggcaggtggaggcattgggttcctctaaggtctttggttggggaagtttgggcccagaacacagcactctgtcctcaaagactatgacgtcacatgcaggttgcgtcacacgcaggtcgcggtgcactccatccttggaagtgttcctggccgtagccaggctgagggtgcctgcagacccaggcctgtccacaagatgtccccccacggacatgcctggccgctgctccagggagggtcagagggatgattggggcagagggatggatttgcccaaatgtggcagccaggccccatgcatttggcatggccagctccttcaggaaggcgggagagatggaacaaggtggtgactctccagggcagagcggcaaggccctaaggtgtggactccaggggaagcgggctcaccccaacgggccgagctccgcaggtgtggtgggcttttccctaaccccgggccctgttgtttgacatggaaacagctttctccctcagtcctgcatgttgagtgtccagaaccggatggtgacaccaggcagactgggtgctgtcataggccctccttccacagagttcatgcacccctgtgtgcaccaggcctggcgtggagtggagcccacttgagtggagggaggcagagcgtggcgacgcgcagggaagtgcctgtgactgagaaggcaccccctgcaggcccagagcctccatggtgacagttctgagcgcagcatgctgcccacgtgcagcacatccctgccctgtgggattgttagaaggtgcgctgtggccggcatccctgggacaggatgggacgtggcatgggctgggtgcctgcagtcctcctgccgtacccaccatgggcccaagcgccaccaccccttgccttgcccagggctgtctcctcccttccctcctccttggcccccatgtccctgttcaggtctttcctgaaccccactctgttcctggagggggaggcgtccctcctggggctctgctgccaagttcgtggtgctgaccttgtttctgagggccatggcccctccctgataggtagaccccagcgtgaggacgtccatttcaccctgcgttccctgggcctggctgctgatcgagggaagggtggctgccccggcaaaaggggctgctagctcctggcttgagagttctaggatgagttggtttcaggaaatggagagaattctgaaagtcctgaaggcagccctgatgttggtcttgtgagtgtggtggtttgacctgggctctgggaacagacttggcttggaatcccagctgcactgttcagtacctctgtgaccttgagcaggtgacatggcctctctgagcctcaatctcctctgagaagcgggttcacactaagcactaagcatggcctccctgaggtcagaggtcagatgcgtgcccagggcttggtgaggtatgtggcaggagtcagtgtgagatgagcagagcctctttttttttgagacagggtctctctctgtctcccaggcaggagtgcagtggcgcaatcacagctcactgcagcctctacctcctgggctcgagttatcctgtctcagcctcccagtagctggaactataggcacacaccacaccctgctaagtttttattttagcagacatggggtctcactatattgtctaggctggtcttaaactctggctcacgtgatccgtcttggcctcccaagtgctgggatttcaggtggcagccgccacacccagtcaaatggagcctcctgttacaacaaggctgctcagggaacagtaacttctcggtcctaatacttattctttcccagggaggctcagcctggtgtggcactttgtgttgaaccagtgagtgaatcattagaatccttgttttcctcatagaacttccaaccaggtttattttcacttttaactttgccattgcctaatgcccaaaagcaagtgggaactctgggcctccccagctgggtttgagcaggtgctggggtgttccgcctgcagcctcctccccgccgccccctcctcccaaacccggtggcttacggcaccagcgtggcctctcccagctctggaggccagaagcccaacctcaaggtgtggacagacccacgctccctctgcaggctccagggaggatccttcctgccttttcccacttctggtggctccacgcactcccgggcttgtggctccagtttctgcctccgcctccgtgccgcactgttcctgcgtgtctgtgtctccatgtggtgatttcctcacagggacaccagtcattggattaggacttaacctgtgacatcttaacttgatgacatctgctaagaccctcagggggcgacacagttcaactaagaccctctttccatccgaggtcccattcacaggtactggggttaggacttcaccctgtcttctgggggcgatacccttcaacctacaacagcccttggtgagtgtccacaacgctaatgaggtgagagtggcatcccctcaagcgaacaactttccccaaattgcagccagatgtggcccagcaaagagccagggtgcagccatcagcaagcagagccccccagttctggagggtgtgtgccgagatgcttctggggaaaggcctgggcctggggctgggctgcagctgtgggacaagctgctgtctgggccaggagccactcagcgtcgccaagctgctgtccaagttaaaccaattcagcatctggcaccttgtttacaagcgtgatttgggggtttcttgctctccagctggcaagcagctggcagtggtcagctgaggccagagcctgggggcacatctcccatggcagcccagagggcaatggacaccccccactccgcccagccctgtgaccccatatggatgctttcgctgggtgaggctgcagcccccgcagggagtgctggacttgggcgcttttgctttacctgggacttgatgagatggggcacccgagaccagccacgcattccacagctgtgccccagggtccaggggatggggctgggggtggtcggacaaaaccactgcccacacttggagctgggggcagccgaacaacaccactgcccacgccttcctggcgagagacggttccagtctccccggtgctggcgtgggcacgccgtgggacagaagcgcagtcattcggcagaggctcccggctgttctcacattgtcagacccaccgtcaaggtcatttcaacggcccctttgcccggccgggcctcctgagttccctctgagcctcagagcagctcgtacacacagctttgggtttctaatggggatggggtcttcaggcctcagccccttctgggcatttcttccgttacaaaggaaaggaaatgtaccgaacactagaaacagtgtttaataaatagcagatttctc

SEQ ID NO: 5129 - DNA, 3632 bp, Homo sapiens
atggatgtgaggagccaggttggacctgtgtgcattcattagatgggtgggaggctgaggaattcacaggacgctaacctggccctctggacatctgtgtgtgctgcttaggtgcatgcaggagcgggggcaggggctgctggtgtggcagcaggaggagccctctgagtttgacttggcctacgccaatttcctctccctggatatcagcatgctgcggctctttgagaccttggagacggcaccacagctcacgctggtgctggccatcatgctgcagagtggctgggctgagtactaccagtgtgagtgaaggccaatggttggtccccctgtcgtggcttgggaggtctctctcaaatgtcagaactgtttttattcttttataaaggctgcttagaaaacaggataacaggctttagtcaggcagatctggcttgaaacctaaagtcattctgcagctgtttgcgtttggacaaatgccttgacctctctgagtatgtttgttctcatctgaaaaatggacataaatcctcctgcctcataaggttgatgaaaggattaagtgaggtgatgcaaagaaagcccatttcctggtacataagttcctggtacagagtctcactctgtcgtcacccatagtggagtacagtggcctgatcattgctcactgcagcctcgacctcccaggctcagttgatcctcctgtctcagcctcctgagtagctgggactacaggcatgtgtcaaccatgctggctaacttttcttttcttttcctttgtttggtagagacgaggtcccacgttgttacctaggctggtcttgaactcctgagctcaagtaacctcctacctcagcctcctaaggtgctgggattacaggtgtcggccactgtgcctggcccacaagtcttaattgtaacttttataattttgaagataataaagtgtgtaaggtgcctgatacagagtaggtaacttttttgttaagaaacaatttaatacgttgggatgtgcacaggttgcgtgaggccagagttggagaccatcctgggtaacagagtgagacctcatctcttcaaatttttaaaaaagaaacaagaaacaatatattgaatgccttcatccagtcgggttttcattgtgcctctcttttctgcctgttactgtgctggggacacagcagtgaacaagatgaacccagcccctgcgctgccaggatgatagactaaaacaagtagctactgtatagcatgttgagtgactggaaaagggagaggcaggtggcagaggctcacagggccccctaagcatgggtgaagtttatagtgaggagctttgggagggtttttgcccataaagggaaggtgacttgcctgttttcacagactcagacagtggccaagctaaagagggcccccacccacatccaactcagggtccaagccttcccctttgccttcctccaccgctgccataaatgccagagcctctcaaggaaccagtcctcattctaccgtcacttgctgtgtgacccggagagccttcctgtggaagatggaggttggactcaatctccaagggccctttcatcttgttagtctgagtctatgtattgattgaaaaaacaataatagcagctgtcactgttagccaggtgccagctattagccaggcccggtgggaagcacttacagtcatcattgctcatgttcacagcagccctataggtttgtgctaggttgatctccatttttaaagaggtgcagaaaggtgagtgacttgctctgggtcactgggcactcactgggcacatgtttttgtctgttgagggtgggggaggtctagaaccagggccaagtgcagacagtctgcactgcatgtatggcagggggtaagggggcgaaacagattttccctactttttatttagcaaacctctctttcgctgctgttatgtgccaggtactgggctgctgggggatcccaagtgagcagagtctgttttctaccctcgaggagctcagagaaaaggaaatagataattactgtgtgatgagactccagacagaggggttggcatctgcacatccttcctgggcatctcgtgggcactgctcgattaccaccaggccttgcacacctgcctcccctccaagcccctcctgggcctgggctcctctgtgatctacgtcctgtggaacctgctgctactgtggccccgagtcctagctgtggccctgttctcagccctcttccccagtatgtagccctgcatttcctgggcctgtggctggtactgctgctctgggtttggcttcaaggcacagacttcatgctggaccccagttccgagtatcctctatttctcctggttcaacgtggctgagggccacacccgaggccgggccaccatccacttggctttcctcctgagtgacagcattctcctggtggccacctgggtgacttacagctcctggctgcccagcaggattccactgcagctgtggctgcctgtaggaggcggatgcttctttctgggcctggctctgtggcttgtgtgctactgctggctgcaccctagctgatgctgggagcccaaccctgaccaggtggacaggacccagagtctactttcctcagaggggtatcagctgcctcagacccagttagcacagaacttttttcccaagggtaaggctgaggctgcttcgccagtgaagggagaggtgaacggcgtcctttgaagcaggatcagacccagccagcagagatggagagtgactgctggcagaaggcaggcgaggataagctaacgatgctgctgtggcctccatgcactcagcaagagtgggatgcctctgctgggccgtgcaccagggatggtgctgagtggggcagaggcctgccttcaaggagttcacagtgaacaagatgagaagggctgggccctgcagggtcaagagccccaattacgtacaagacactttgggaggaaagacgactaccttttcttttccccctgccattggtatagctggtgccccaaaactttcacctccctccctggccacctctaaaatgattggtataggggcttccccaccccttagctcccctatcctgggctagaaggccacagggactgtcctctagaattcttcctcccctcccccacaccattcattcaattcgtgaaacaaatcttcaccgagagcagtttatgtgctaggaacatcattctatccttgcaacctggaacaagaccagctaccaccttagcttcatcccctacttgcaccaaccagtcccgggttagatctcaaatgccggaagtcagggatgcccaactctgggcagccccagtcagaacctctgggatctcagtgaagctggcctggcctctgctcttgctctcaaggggctgcttttcaaccaagagccttgtgagcctggtctgagccttgcacagccactgagtattttttattccttagccagtgtacctcctacctcagagtctatgtgagaggaagagaatgtgtgtccctgtgggtctctgcaagtgacagatgtgttgtttttaacagtattattaggttatgattaaagcctcatgaaatcctct

SEQ ID NO: 5130 - DNA, 3650 bp, Homo sapiens
ggagacgcttgcgctttcccgggccgcacttcccacccgggtcttcagaagcccgtggccgctgggtgagcccctgcgtgaacgcacacgcacgcacacggcttcaggttgccccgcggcgccgcgcgcgatatcggctcggatcccgggaggccgtccgcccctttttcagcggatagctgaggccagatcacacctggctgtaggcccaaagcgaacctatcactggcacagaagcttggacctggaaggggactcatggaggagtccgctgtcttttagagatgggaaaactgggcccaaataaccaagtcactggtttcttaggctttcaggcaggaggtctgagagtctgtcttaaagagaccctctgtctggggcccagagcacccctccttcctcaatacacggccacatccaagataatcaaggttagtctcatgggtgacagaaaaataaccatggcagtgaatatactgctgggtcctggttttgctgttaccattcttcaaacagcaggactgggaaaatcccgcctgtcccctgcctgctctgcacgtcattttaacttcatgactgaaaacagcagccctttctagggttatcaacatgaatgtcggtaaatgttctactctaagaacagatgttttactttttttaagtttttagtatgaaaaactgtaaacacgaaattagaggaagagtccagcacctgccatttggccactgtccagacctactgtgtgcttcttggggaaaaactttacagctttgaatggctgagaggtttggaaagaaacagctcagtccccatggcccggatggagagaggatccctgcaggcaggtccccatgctgccaccagattggagccactccttgcttcctttagtcacagtacctgaatgtgcccgcctcctggagagcgtcctggttgcaggcttcccttgccaaccactccagagggtgaaactggctctcttcttgcttctttaaaaagacactgaggcgcatcttggatacccgcaagaaagaggctgtacaaaggcagaaacagacgttcagcatggccgtggctgagctgttggctccggagtgcttctgtcccacctcccccaggaagggaagtccgttggccaggccaattctagagcaaaatctgagagatgctcttagattcccactgtgtcactgcttctgctgagccatggaaacctgagagggtgtcccccaacacacagtgaaatgatgcccactcctcaggaagagcccacgtgggggcaggggcaagaggggtggggaggctcataccgtggcacgcgtcatcctcattcaagaggcccaggaggagcaccaccctccgcatattgcgcgtgcagctctcgttctggtctctgagcatgcccacggcgctctgcacacagcttctcagcagcctggtggtgtccaggatcgacacctgttggtggagacggttgggtcatccgtttctgccactgacacagtgggcaaaagccaaaccgcccgtatgcgatgagggtctcaatgcagcaaacagcacagggcggcggtcctcacggacaaagaagagacgccgacctccgccctgcaccccccaaactgccggtgcagatgcccttgacccccagtaaccagcaacaagaccgtcactgtgtgaggaaagtggggcgccatcctcacccctgcacagcggcggcgactcctctagctcccaatgcaaaagcgtttaaagatgcagctcagaagcatcaccagcagcacaaggggaggtcccaagaaccagaacttacatcactgcctccgagttcagaggtttcctttcccaccttctcagaactttctgtttccatggcctcctctgccacctctgccacctcccctgatgtgctggcctccgtctccatcgcctcctcatggccgtcttccgcccggtgttccaagcccactgcagtcgaagcaaacgtgattgcgttaccactcagaaggtggcacagggactggcagcggtgccatctgggagtctgtgtgctcagcctccgagtgcaggcttccccggcccctgctgtggtgctaggtccccagatgagagatcacggtcatgaagatcagcccccaaggcagccccttccttccagcctgggctctggcgtgttctaggtgctcacttccatggctggcctgctcacagagctctacctcagcctgtggtaagcgcacctgctcggccctggtgctctatgatgagccaccagtcagttctgcagatgtgtccccgagctcctgccgagggacgaaacacggtggccctgctcctagtgccatgtgcacgccacgctccacacctgccatctgcccttccaccacctgctcccccaggggctccgcctcgtgactcacgctcaggcaagtctccgggcgcgaacagctggctgatggtgacatgctgcagcctggtcacatcagaaaccatgagggtggatctccggaggtcatcgatgtggacagactgccacagccctgtgaagagtgaagccacccacaactgtctttgtgtctttcccggctgctgctcagccctaagcagggacattgcacaccctggcttgtcattatcttgctgcgcaatgaatgactggcaccctgaagccgaaaccctggaatgggcctgcgcagaaaccacccaacccgatactatacacgacccgattctatgcccatcgacagcttcaccataagcagcaacggtaagacctgcaatggccagcgtgggaaggacgcatggataaggcctgtggttctttcacccatgcattgttgtatttgctgtatcacagttagtgaggggtgggggacactggcaaggtctgccttccattctccacgaaattattcaagtaaacttactttcctgtttctggaataccaacttttctatgtcataaatagctggtgaccattccttggaaaaaaagagatctgaagatagtccgacccccgccactctccctccccgccaaacaggcgtatcggtgcgttcctgacagtgtctgtcgggagtcgggagtctccacgccgtgtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgcggtggctcacacctgtaatcccagcactttgggaggctggggcgagcggatcatgaggtcaacggattgagaccatctaggccaacgtggtgaaaccccgtcactactaaacatacaaaaattagctgggcatggtggcgcacgcctgtaatgccagctacttgggaggctgaggcaggagaatcgcttgaacccaggagattgaggttgtagtgagctgagatcgcgccactgcactccagcctggtgacagagcaagactccatctcaaaaaataaatagatacaaataaataaataaatacataaataaata

SEQ ID NO: 5131 - DNA, 3651 bp, Homo sapiens
tggagacgcttgcgctttcccgggccgcacttcccacccgggtcttcagaagcccgtggccgctgggtgagcccctgcgtgaacgcacacgcacgcacacggcttcaggttgccccgcggcgccgcgcgcgatatcggctcggatcccgggaggccgtccgcccctttttcagcggatagctgaggccagatcacacctggctgtaggcccaaagcgaacctatcactggcacagaagcttggacctggaaggggactcatggaggagtccgctgtcttttagagatgggaaaactgggcccaaataaccaagtcactggtttcttaggctttcaggcaggaggtctgagagtctgtcttaaagagaccctctgtctggggcccagagcacccctccttcctcaatacacggccacatccaagataatcaaggttagtctcatgggtgacagaaaaataaccatggcagtgaatatactgctgggtcctggttttgctgttaccattcttcaaacagcaggactgggaaaatcccgcctgtcccctgcctgctctgcacgtcattttaacttcatgactgaaaacagcagccctttctagggttatcaacatgaatgtcggtaaatgttctactctaagaacagatgttttactttttttaagtttttagtatgaaaaactgtaaacacgaaattagaggaagagtccagcacctgccatttggccactgtccagacctactgtgtgcttcttggggaaaaactttacagctttgaatggctgagaggtttggaaagaaacagctcagtccccatggcccggatggagagaggatccctgcaggcaggtccccatgctgccaccagattggagccactccttgcttcctttagtcacagtacctgaatgtgcccgcctcctggagagcgtcctggttgcaggcttcccttgccaaccactccagagggtgaaactggctctcttcttgcttctttaaaaagacactgaggcgcatcttggatacccgcaagaaagaggctgtacaaaggcagaaacagacgttcagcatggccgtggctgagctgttggctccggagtgcttctgtcccacctcccccaggaagggaagtccgttggccaggccaattctagagcaaaatctgagagatgctcttagattcccactgtgtcactgcttctgctgagccatggaaacctgagagggtgtcccccaacacacagtgaaatgatgcccactcctcaggaagagcccacgtgggggcaggggcaagaggggtggggaggctcataccgtggcacgcgtcatcctcattcaagaggcccaggaggagcaccaccctccgcatattgcgcgtgcagctctcgttctggtctctgagcatgcccacggcgctctgcacacagcttctcagcagcctggtggtgtccaggatcgacacctgttggtggagacggttgggtcatccgtttctgccactgacacagtgggcaaaagccaaaccgcccgtatgcgatgagggtctcaatgcagcaaacagcacagggcggcggtcctcacggacaaagaagagacgccgacctccgccctgcaccccccaaactgccggtgcagatgcccttgacccccagtaaccagcaacaagaccgtcactgtgtgaggaaagtggggcgccatcctcacccctgcacagcggcggcgactcctctagctcccaatgcaaaagcgtttaaagatgcagctcagaagcatcaccagcagcacaaggggaggtcccaagaaccagaacttacatcactgcctccgagttcagaggtttcctttcccaccttctcagaactttctgtttccatggcctcctctgccacctctgccacctcccctgatgtgctggcctccgtctccatcgcctcctcatggccgtcttccgcccggtgttccaagcccactgcagtcgaagcaaacgtgattgcgttaccactcagaaggtggcacagggactggcagcggtgccatctgggagtctgtgtgctcagcctccgagtgcaggcttccccggcccctgctgtggtgctaggtccccagatgagagatcacggtcatgaagatcagcccccaaggcagccccttccttccagcctgggctctggcgtgttctaggtgctcacttccatggctggcctgctcacagagctctacctcagcctgtggtaagcgcacctgctcggccctggtgctctatgatgagccaccagtcagttctgcagatgtgtccccgagctcctgccgagggacgaaacacggtggccctgctcctagtgccatgtgcacgccacgctccacacctgccatctgcccttccaccacctgctcccccaggggctccgcctcgtgactcacgctcaggcaagtctccgggcgcgaacagctggctgatggtgacatgctgcagcctggtcacatcagaaaccatgagggtggatctccggaggtcatcgatgtggacagactgccacagccctgtgaagagtgaagccacccacaactgtctttgtgtctttcccggctgctgctcagccctaagcagggacattgcacaccctggcttgtcattatcttgctgcgcaatgaatgactggcaccctgaagccgaaaccctggaatgggcctgcgcagaaaccacccaacccgatactatacacgacccgattctatgcccatcgacagcttcaccataagcagcaacggtaagacctgcaatggccagcgtgggaaggacgcatggataaggcctgtggttctttcacccatgcattgttgtatttgctgtatcacagttagtgaggggtgggggacactggcaaggtctgccttccattctccacgaaattattcaagtaaacttactttcctgtttctggaataccaacttttctatgtcataaatagctggtgaccattccttggaaaaaaagagatctgaagatagtccgacccccgccactctccctccccgccaaacaggcgtatcggtgcgttcctgacagtgtctgtcgggagtcgggagtctccacgccgtgtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgcggtggctcacacctgtaatcccagcactttgggaggctggggcgagcggatcatgaggtcaacggattgagaccatctaggccaacgtggtgaaaccccgtcactactaaacatacaaaaattagctgggcatggtggcgcacgcctgtaatgccagctacttgggaggctgaggcaggagaatcgcttgaacccaggagattgaggttgtagtgagctgagatcgcgccactgcactccagcctggtgacagagcaagactccatctcaaaaaataaatagatacaaataaataaataaatacataaataaata

SEQ ID NO: 5132 - DNA, 8686 bp, Homo sapiens
ccgccttctccccgcttccgccctgcgcgctaacccaagacgggagctcgagagcttgatcctgcgcgagtttacagactgccctcttccctttttgcatcgaagaccacgactcccaagaggtaatgcgtcggcccgggactacatctcccggcatgcatcgccggcgggtccgcgagttctcaccatcgcagctggactattagcgggggccctagcgctcttgtggtttgtttcggcagtatctgaatgtcagcttttggcacttctggtcgctctgagcctcctactcgcattcctggagcaaggtgctttccaggcctcatggaggtggaggagctgaggaagctcgagaagatggatagaagtgggaaatggagctagcgtacgggagagggaaatggctggaatattcgtcaatctgtggtgctttactggagatttgcaggagttcagaggaagggggcattgaatttcataacctaaaccgtatcgtggtttaccagaaagttttgacccgtgattccggttttaaaggctgagtagggccgggcgcggtggttcacgccagtaatcccagcagtttaggaggccaaggcaggcggatcacctgaggtcaggggttggagataaacctggccaacgtggtgaaacctcgtctttagtaaaaaatacaaaaattagccaggttttgtggcacatgcctgtaatcctagctactcgaaaggctgaggcatgagaatcgcttgaactcaggaggaggttgcagccaaccgagatctcgccgctgtactccagcctgggcgacagagcgagactgtgtcaaaacaacaccacaagctagctgagtagggattcttgggcgaagtggaagacattataagcaaatagggtagtatgggcatggaaacgaactacatgattaaagattagtattatctggcgagggaggaaaagtgccagagcaagtgccgaaactggaaggttacatttagttcaggatatgaagatcatataaggcctgcacggtggctcacacctgtaatcccagcactttgggaagccaaggtgggggaggatcgcttgagctcaggagttggagaccagcctgggcaacatagtgggaccccatatctcaaaaaaaaaaaaaaaaaaaataagctgggcgtggtggcttgtgcctgtggtctcagctatcccggaggctgaggtgggaggactgcttgagctcaggacgtcaaggctgcagtgagctatgatgggccactgcactccagcctgggctacagagtgagaccttgtctcaaaagacaagcgacaacaacaaaacatgtaaggagaggccaggcgcggtggctcaagcctgtaatcccagaactttgggaggccaaggtgggcggatcacgaggtcaggagttcaagaccagcctggccaagatggcaaaaccccatctctactaaaactacaaaaattagccgggcgtggtggtgcatgcctgtaatcccagctctttgggaggctgaggcagagaagtgcttgaacccgggaggtggaggttgcagtgagcgagatcacgccactgcactccagcctgggcaacagagcaagactccgtctcaaaaaaaaaaaaaaaggtaaggagctttggtctctaggtactgaagaaatcattgaagtttttaagaagacaagtcatttggttagatctattttccctccacttaccaatttatttttatttttatttatttatttatttatttattttagatggagtcttgctctgttgcccaggctggagtgcagggacgtggtatcagctcactgcaaccccacctcccagattcaagcgagtcttcctgcctcagcctcccaagtaactgggattacaggcgcctgccaccacgcccagctaattttttgtatttttagtagagacagggtttcaccatgttggccaggctggtctcgaactcctgacctcaggtgatccacctaccgtggcctcccaaagtgctgggattacaggtgtgaaccaccgcacccggccttatttttttatttttgagacagcatctcgctctgttcaagttggccttgaactcctggcctcaagtgatcctcccaccttggcctcccaaagtgttggaattacaggtgtgaaccattgcaatggccttattactactttatatttgtggagtgctttaaagttgacaaagtttttagttaatcctcacactattaccttgtggcgttgaagaacagatttcaggagcgtgaaagtgaagacaccaaaaaggaagttcttgcaatatttcaacaaagagatgaagatttggattagattccagttctacctttttggcaccagggagctgttctgtgaaagacaattttccacagggctcggggggtgggcatgaggcagaggatggtttcggaatgaaactgttgcacctcaagatcatcaattagatttccataaggagtgtgcaatctagattcctcacaggtgcagttcaaaataggttttgagttcctgtgagaatctaatgctctccttgatctgacaggaggcagagctcaggcagtaatgcttgcttgctagctgctcacctgctgtgcagcccagttcctaataggcgacaggtctgtgttggggcgttggggtcctctgaattagaggaatgacagagagaacagactcaggcagctttctggatgtagaaacaacctaacttagtgattatagatactacctgtgataatagtgaactttcttccatatcaaagttacacacctttgcctccggttcttcccacacccttagagcatctgcaaacctacagccctcctcctagctgactgtagtcacatgacttttacctttctggccaccagttgtaccagcagtgttcatctggccccaaattggccaatcattttcctgctcctggaaaattagacttggctttatattcaagtctgacctcaggaatttatggggcaaagtacacagatagatgtgtgtgaatgtccaatcagagaaagcacatctgcagaaagattaagaaattgatgtcgggtgtggtggctcaagcctgtaatcccagcactttcggaggctgaggcaggcgcatcacctgaggtcaggagttcgagaccagcctgaccaacatggtgaaaccccatctctactaaaaatacaaacattagcctccagctacgcaggaggccaaggcaggagaatcgcatgaaactgggaggcagaggttgcagtgagctgagatcgtgccactgcactccagcctggatgacagagcaagactctgtctcaaaaaaaaaaaaaaaaagaaaaagaaaaagaaattgagatactaaggagagagtcaaagataaataaaccatttgaattctgactcctttccagatcgcctttccagtttctcagaagcctagcagtacttactcctcctgctcttgggttcttttttactttttttttttttttaaaaaaaaaaccttgaactcttaaggattaatgctcttgagttatgagatatccctacattccaataactctaccttctatttttattgattaaactagtttgagtagtttctgttcctttcttccaaaacaacccactgagaacttggaaataaggcaaactagatttccctctaatagttaaattggcattctctgagaatatttataaatgtgttaattgaaaaattttggagtgtggtggctcacacttgtaatcctagtgcattgagaggctgaggtgagaggaccatttgaggccaggagttagagactagtctgggcaatgtagtgagaccccccaactctacaaaaaaaaatgttgttttgttttttttgtgtttttgttttgagatagagtctcggtctgtcgccaggctggagtgcagtggtgagatctgggctcactgcaacctcggcctcccaggttcaagcgatactcctgcctcagcctcccgagtagctgggactacaggcacatgccaccacgcccggctcattttttgtatttttagtagagatggagtttcaccatgttggccaggatggtctcgaactccagacctcatgatccgcctcggcctcccaaagtgctgggattacagacgtgagccaccgcgcctggccaaaaaaaacctttttttaaaaattagccaggtgcggtgatgcacacttgtagtcctagctgtctgggaagctgaggaggggagattgcttgagcccaggagttcaaggttacagtgagctatgattgcaccttgcaccactgcactccagtctgggcgaaagagtgaaactttgtctcaaaaaaaaaaaaaaaaagtataaatacatatatataaatgtatatatatagagatacatacacacacacatacatatatatgtattctttatatataaggtaatgtgtatcaagtgatctaatctgctcctaattcacctcctctagtatgcttacaaaatgagagtcctggaatagcagacatgcattgtaaataaatgaacatctttctacaagtatatttccccaaggttcaactgaatatagtttgctataatttcttaaaattcaatcaatttcacatccattaaacttacaagtaccgtaatccagttttcctaggaaaactaagcccagccgaaccttgggaaaaatacctctgtgttaaacatatatacatgatcgattttaaatgttttcaccacaaaaaatggtaagtacgtgaggtgatggatttgttaactcagaagcaggcacaccaaatcacaatgggtctgattcgatcctccctgatggcaatggagacccatctaactaatcccacttctaattacctttctttttctccttacagacctaaaaaatctcaccatttctattagcctgaaaataacatccctctgttcttctcttcctccttcagcactgaatctcgcttacactaggttttacttaatgattctcctccttatactttctgtctcaccagtttcctctcacacttatttacctgctacacaaaattattcttattgggcttatgtgccctttcctccacttattcgacctctcacctggattgatgctcctgcggaaatctacattaacgatagtttgtggatgcctggagctacagatgaccgttgccctgctcaaccaggagaagaaggcactacatttaatgttatcatgggttataaataacaccctctgtgcctcagaaatgcacctggttatatccatctagaaactcaagtctgggctgcttatcttcccgagagatcagctacagaggaaccgggacatttggtctctggcctctccctttctcctttaaaacaaatgaaagggggagtaatgggacataccccatactttcaataagtagcctccaggcattcccttccaccagaggagcaattgttttttaaatagccctttggcgcccagtctattactaaaccatatgagtcattttttaatattactgcatgtgagttaacatagtcttcccaaattaaagttttagatgggccctcaaaatttttagggcatggttttcctgcaggtttatatggaaagtatggggtccctgacttctcgcaacagtggcctacactgcctttcagtttacctaggcctccaaagcactttagcctgtggggcttgccagaactcgggttccagctcctggaatggacagttcccctctggctagggttgatctaatgttccctctgggttactggctgagttctgccctgtgtggctttctgctgtgccagggctgcactgagttcaaatgcagagtctcacaatcattgtattcttcctcccccaggagcacccattctctctttacaccaattggccactgccaggggatgaagagggatgatgttgacaattcaagactatttcttaccctcttcagtgcctgtttccttaatatgataataaaccaggtactgcgatcactcacctgattattggttcttatgaaggtgcttttttaatgtagttgttcagtttgatatttctgtcggagggatgactgctggaggattctattaagccatcttgctctgccttcttgcaacacataaaattcaacagttttgtgcaactgtaagttcaagtgtttgtaattttatttatttcatttttttctttgagatgaagtctccctcttgttacccaggctggagtgcagtggcgcgatcttggctcactgcaacctctacctcctgggttcaagcaatcctcctgccttatcctcccaagtagctgggattacagatgcctgccaccatgtcttgctaacttttgtacatttagtagacatgaggttttgccatgttgtccgggctggtcttgaactcctgacttcaagtgatccacctgtcttagcctcccaaagtactgggattacaggtgagagtcactgctccctgctgcaaatttcttattaaatctgtttgacagattttagaatttctataagtaatgtttaaaattacaaccatttgggctgggtgtggtggctcatgcctgtaatcccagcacttattttatttcttatcaggagaacgagaatcatcatactactttgcatcggaggttaagctcattcttttccttaaaatgggaagataaaggcattaccccctctccgaggcctcatatgatactccccattctgacccagaacacccagaactttggaaattggctattgccatgtctggactgcaagtatgggaagcagaaactattctgtctgttgtccccactaccatctccctctctcagtatcaacgtagatccagacattctgctttacctacctccaacctgtttccatacagagttctgttaagcctccttgcatgctgttagtgagatatatcaaaatttggatgaacaatcaaactgtccaatgcattaattgtcatttatacacttgtattaactcccattttgattccaggaaaagtgtaatgttggttcgagctcaagaaggaatctggattccggtaactttgcccagaccttgggaatcctccccttcaatacatttaattaatgaagtgttacagtgaattctaaaaagatctaagagatttattttcactttaattgctgttatcatgggcctaattacagtcactgcagtggccaccactgccggaatggcattacaccagtccattcaagcggctcattttgttaatggttggcaagccaattccatccaaatgtggaattctcaacaaggcatcgatcgaaaattggcaaatcaaattagtgatttaagacagtctgttatttggcttggagatcaggtagtgagtctcgagcatcacatgcaaatgcagtacgattggaacacttgagatttctgcatcaccccgtattcctataacgagactgatcattcatgggaaatggtcaaaagacatcttctgggtagggaagataatttatcactggacataactaaattaaagagacaaatttttgaagcctctcaagctcacttatccattgtgcctggagctgaggcgttagatcaggtggcagaaaatctttctggattaaaccccaggacttggattaagtctattgggggctccactgtagtaaattttggaattatgtttctctgtttaatcggcttgtttttagtttgccagactagtcaaagaatcctgcgtcaaaatcaagagaacgaacaagccttcattgccatggcacatttattataaaaagaaagggagagatgttgcgggaagtcagggaccccggagggaccagctgaagccatggcagaagaacataaattgtgaagatttcatggacatttattagttccccaatcaatacccttgtgatttcctatgcctgtctttactttaatctcttaatcccgtcatcttcgtaaactgaggaggatgtatgtcgcctcaggaccctgtgatgattgtgttaactgcacaaattgtagagcatttgtgtttgaacaatatgaaatctgggcaccttgaaaaaagaacaggataacagtgatgttcacggaacaagagagataaccttaaactctgactgccggtgagctggacggaacagagccatatttctcttctttcaaaagcaaatgggagaaatatcactgaattctttttctcagcaaggaacatccctgagaaagagaatgcatccctgagggtaggcctctgaaatggctgcttcagggcagctgtcttttatggtcgcagctgtggggatgaaataagccccagtttctcagagtgctcccaggcttattaggacgaggaaattcctgcctaataaattttggtcagaccagttgtctgctctcaaaccctgtctcctgataagatgttatcaatgacaatgcatgcccgaaacttcattagcaattttaatttcaccccagtcctgtggtcctgtgatctcgccctgcctccatttaccttgtgatatcttattaccttgtgaagcatgggatctctgtgacccataccctatttgtacactccctccccttttgaaaatcactaataaaaaatttgctggttttatggctcagggggcatcacagaa

SEQ ID NO: 5133 - DNA, 724 bp, Homo sapiens
accctgtactcccaccaaaccatggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaa

SEQ ID NO: 5134 - DNA, 402 bp, Homo sapiens
acggccgaggaaggcattgctgctggaggggtaatggatgttaatactgcttcacaagaggtgctgaagaccgctctcatccaccatgacctagcacgtggaattcgcgaagctgccaaagccttagacaaacgccaagcccatctttgtgtgcttgcatccaactatgatgagcctactatgtatgtcaagttggtggaggcctttgtgctgaacaccaaatcaacctaattaaggttgatgacaacaagaaactaggagaatgggtagggctctgtaaaaatcgacagagaggggaaaccccgtaaagtggttggttgcagttgtgtagtagttaaggactatggcaaggagtctcaggccaaggatgacatcgaagagtacttgaaatgcaagaaatga

SEQ ID NO: 5135 - DNA, 6095 bp, Homo sapiens
ctttcacgccgggatccgggtcccggtgcttctcggttcattcccagctgggtccgggcccggccagactgggtggaaatctggctgaccttggtggtctgtcttggccagctggagcaaagggatgccaggggacgggtctcggtgcagtgactgccattagcttggggccgcagaaagtttctcccctttctcgggctcctgccaggcccttggctttcagagccaggcccgatttctagataacatttaagtttgcagaaaaggggatgccaagtcacggtggtcacggctgtgggatgcagcctctgagatttgtattaatttttgtgagccggggaaaggccttgctgctttctccgccaggactgatgtgtcttcccaagatgaaagtgcctggtaagggcgaggggcctccctgggaaggtcatgagcatgtaaggtaatggggcctagactgtgacttttggcacgtttatgagtgacatcccccgggagggcaaggataaccatttgacctggtctgtcatattcaggaatagacttcagtttagttgtggtattttctccaaaagagatttgtgtatatagccctagatagtcttgtcaagattaaacccaatttaaactgttaactataaaatattttagaattttgtctcattctagaatggctttattcgaaacaaaaaaaaaggaagagtcccaagtttcgtctcagtgaaacctgccagttcaacactatgatttatttttctttttttctttaattttttttttttttaagagtagggtcttgctctgtcgctgggtttacaggcataagccaccaatcccaaatcccggggctatgatttttgaaatcatgttcgtgagaaggcagagcacatgtgttgagagtcagactttaaacctgggttcaaatcattagtgcttaatcattgtaaagcagttaggaggttgcgttcaacatagcaattatcaaagaatgaatgtataactttaaagaccaatgatattttaaacttttttttttttttgagaacggagtctcactccgttgcccaggctggagtgcaatggcacgatctcagctcactgcaacctccgcctcctggattcaagtgattctcctgcctcagcctccccagtagctgggattataggcatgcgccaccacgcccggctaattttgtatttttagtataggcggggtttctccatgttggtcaggctggtctcaaactcccgacctcaggtgatccgcccacccaaagtggtgatcgtcctcccaaagcactgggattacaggcatgagccaccgcgcctggccgaactttttaaatttatttattactattttttgagacagggtctccctctgttgcccaggctggagtgctgtctcagctcactgcaacctccgcttcccatgtttgaccaattctgcctcagcctcctgagtagctgggactgcaggcgcccaccaccacgcctggctaatttttgtatttttagtagagatggggtttcatcatgttggccaggctggtcttgaactcctggcctcaagcggtgctaggccaaagtgctaggattacaggtgtgagccactgcacccagtgcccccaaagtgctaggattacaggtgtgagccactgcactcagccttaaacatttttttaattaaagcaacctaaggtaaaattttttaaccaaatttaacccattcccaatcagattgaataaatgcctagcagcttatgtgttgtgctaaaacacgatatattatctgccaataaaaaacagtattttgtatttatatagttttattaccaagaagcttactcagctttatgatttcccctttgtaatctgattaaccttcatagtatcttgaagtaatgtatagtgtagcaatcagacacttaggtagtgacttcgtgagctctgacaatgagtcaatataatgcaagaggctatgtatgaagtccaacctgggtgcgtccacaccacaccaagaggacaagttaaaattaccatatggccaaaaattaatattttctgacttatttttgtttaccattccaaccatagtactgtataaaatgtttgctattcattatagacccaggaatggaatattcctaatattaaaacaaaaatttcaacagctatagaaaatgaaagtgagtgtgagatagagatactggacataatgttctataggttttaaaagacttaagtagaagaaatggaaacaatgtctttacttcttggcagtggagtggtaacagctaatggctctttctacctggcatgcagcttcctgtaacgactattattaatagagccaggctgatcgtgaggcgccagaaaaggtgtatggtggaatttaactacaatggcttgtattgcctggatataccctttggtatgcctattttactagaaatgtttgaaaataggaaaaagctcactcaaaagataagctgccagtgggacttgaagaggctcccattacattcctcttccctggagatgttttattcccctcctctcctccagtgttcagtctcatgctcagcattgcaagggttacaaaggtgactacttaagacacagagtttgcccttgaagaacttgcaggataacaagggccataagaaagtattaagtgtcggctgggttcggtggctcacgcctgtaatccagcactttgggaggccgaggcgggcggatcacgaggtcagctgatcaagaccatcctggctaacacggtgaaatcctgtctactaaaaatacaaaaaattagctggtcgtggtggcggggacctatagtccaagctactcgagaggttgaggcaggagaatcgtttgaacctgagaggcagagcttgcagtgagccgagatcacgccactgcactccagcctgggtgacggagcaagactcagtctcaaaaaaagaaaagaaaaaaaaaacaacttcccagcacttgggaggccgaggtaggtggatcacctgaggtcaggagtttgagagcagcctgggcaacatagtgaaaacttgtctctactaataacacaaaaattagccgagtgtggtggtgggcacctgtaatcccagctacttgggaagctgaggcaggagaatcgcttgcacctgggagcaagagattgggccactgcactccagcctgcacaacagagggagactctgtctcaaaaaaaaaaaaaaaaaaaaagtccgggcacggtggatcacgcctataatcccagcactttggggggccgaggcagatgggtcatgaggtcaggagatcgagaccatcctggctaacaaggtgaaatcccgtctctactaaaaatacaaaaaattagcattaagtatcctgagagaagaccagataaaatgctatgattcagcattattcctaaaatgggtaccagttgagcaatacctgccaactcttaatttctgcttaaatgcccaactgcatagtacatgctgttaaattgaggggataggtgatatcatgtaaacccatgtcttgtccctgccagcaaggaaattgtgctttgacttggaaagtatgtaactaagactgaggagaataaattgatgttttcacctctcgtatttgcttctgaagcagaaagtttactaagctaaatcctgaactaggaattagtaatactagtaatagctaattgttaatatatatacagctcttataacagtttctggcataattactatacaaatattatttcttattcttattgggtgcttactgtatgccaggcaatgtttttaacctctttatgagttttcacaaaccccctagaagtacttgtattatccccatgaagaaacaggtcgagagagtttaagtaatctgctcaaggtcagaaagtgaacaaatgacaggtcaggcttcaaacacagacagcccatgtgcttgaacagtgctactggcctcccagtacttactgaggcctactcctataaaattctattgactccctaaagtgatggtgtagggaatgctaactgatgataaagaaaatatgaaacactgacaaatcatttagtgagcatttcattagttagttggcttcctcttctgtgaccttgaattgaaactctactgcaaactaactggttagagaaaaattttatttgcaaatagttttaaaagtttcaaagtaggccgggcgcagtggctcacgcctgtaatcccagcactttgggaggctgaggcgggcggatcacaaggtcaggagatcgagaccatcctggctaacaaggtgaaaccccgtctctactaaaaatacaaaaaattacccgcgtggtggcaggtgcctgtagtcccagctactcaggaggctgaggcaggagaacggtgtgaacctgggaggtggagcttgcagcgagctgaggctgtgcagctgcactccagcctgggcgacagagtgagactccgtctcaaaaaaaagtttgaaagtaaaaccacccattttttttctttttctttgtataaagtaaaggaataaagaagggctactccataagcagagcagcctctttttttccttaaaagaaaaatagctggccaggtgcagtggctcatgcctgtaattccaactctttgagaggctgcggcaggtggattgcctgagctcgggagtttcagaccagcctcggcaacatagtgaaaccctgtctctaccaaaaatacagaaaattagccagacgtagtggcacctgcctgcagtcccagctactcaggaagctgaggtgggagaatcacctgagcccaggatggaggttacagtgagcccagatagcaccactgaactccaaactgggtgacagagtgagagtccatctcaaaaaaaaaaaagaagctgcattaattttttttaaaagtaattttatattaagtttctacgtaatttaattaaacttggaactaaacaatggatatcaaaataatgagggtttttttggtatggtttatttatttatttttttgagatgtagtcttgttctgttacccaggctggagtgcactggtgcaacctcggctcactgcaacctctgctgcctgctaaagtgattctcctgccttagcctcctgagtagctgggattacaggcgcccaccaccacgcctggctaactttttgtttttttgagacaaggtctcgcattgttgcccaggctggagtgcaatgacacgatcttggctcactgcaacttccacctcccgggttcaagcgattctcctgcctcagcctcccgagtatctgggattacaggcatgcgccaccacccccatataatttttttctttttctatttcttttttttttttctttttttttgagaaggagtctcactgtcttgccaggctggagtgcagtggcgccatctcgactcaccgcaacctccgactccctgattcaagcagttctcctgcctcagcctccctcccaagtagctgggattataggcacgtgacatcacgcccacctaatttttgtatttttagtagagatggggttttaccatgtaggtttttgtattttagtagagacagggtttcactatgttggccaggctggtctcaaactcctgacctcaggtgatctgcccacctcggcctcccaaagtgctgggattacaggcgtgagccaccgcatctggccataatttttgtatttttagtaaagacagggtttcaccatgttggccaggctggtcttaaactcctgacctcaggtgatccatcctcctccaccttccaaagtgctgggattataggcgtaagacactgcgcccagcctcatttaactcctaacaaaagcctctgtggcctggcgctgatgactcacacacacacaaaaaagaaatcctgattctagtacagcctggccaacatggggaaaccccgtctctattaaaaatacaaaaattagccgggtgtggctggcgcctgtaatcccagctactcaggaggctgaggcaggagaatcagagcgggaggttgcagtgagctgagatcgctccattgcactccagcctggga

SEQ ID NO: 5136 - DNA, 378 bp, Homo sapiens
ttttaggaattaacagtctttattgggctcagaccaggagtccgtgggtcttgaggacctctgtgtatttgtcaattttcttctccacgttcttctcggcctgtttccgtagcctcatgagctgtttcttcttccggtagtggatcttggctttctctttcctcttctcctccagggtggctgtcactgcctggtacttcaacttgtttctgtagaaattgccagaaatgttgatgccttcacagcgtacaaccaccaccttccggcccagcagtacctgtttagccacgatggccgccaggcggcccaggagatggcctcgaccatcaagcaccaggacctgcacctccgccatcttcggcagccgcttgggaaagc

SEQ ID NO: 5137 - DNA, 1016 bp, Homo sapiens
tggtagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaa

SEQ ID NO: 5138 - DNA, 4247 bp, Homo sapiens
gcactggctattaattcctggagttcagatggtcagtgttacagtgttatctatgtgaagtatgtggaaagttgggggctggggattttcctccaggcagatttcaaaaaaaaaaaaaaaaaggccaggggcggtggcttatgcctgtaatcccagcactttgggagcccaaggcgggcagatcacccgaagtcaggaatttgagaccagcttggccaacatggtgaaaccccgtctctactaaaaatacaaaaattagctgggtatggggtcacgcgcctgtagtcccagattgcagtgagccaaaatcacaccactgcactccagcctggcgacagagcgagactccatctcaaaaaaaaacacctccgaaaatttggtgtcctttactaataattcttgggaagtagaaaaaggatatacgtagcaagcttttgttcccacactatacttggtttctaatttgcagttcccttcttgacctgcatagaataatagttattttccattgggaaatgagaaatcttcaacattgaggtaagttaggatttttttttttttaagaggtggggtctcactctattgcccaggccacccgaggtcaccagtgtggccaacatggtaaaaccccatctctactaaaaacacaaaaatttgatgagcgtgatggtgcacacctgtaatcctagcttcttggggggctgaggccggagaatcacttgagcccgggaggtggaggctgcagtgatccgagatcatgccactgcactccagcctgggcaacagaacgagactcaaaaaaaaagatgagtaagaaacacgtaccaaagcatggaattgggaaagaccctctgggtgtatggagatgggagaagcagggatggactgtgtaggtaattttcttattccatcttccttccctgccttctttctctgctcgccgctcttggtcagtgaatactgtatgacttcagtttttcccatctcaggccttatataaaaatattagagccaggcgtggcggctcatgcctgtaatcccagcactttgggaggccgaggcaagcagatcacctgaggtcaggagttcgaggatagcctggccaacatggcgaaaccccatctctactaaaaatacaaaaaaattagctgggcgtggtggcttattcctgtagtcccagctactcgggaggctgaggcaccagaatcacttgaacccgggaggcagaggctgcagtgagtcatgatcacgccactgcactccagcctgggtgacagagcgagactccatctcaaaaaaaaaaaaaaaaaaaaactgaatggtggcttccactctccctgatcctgttcccgtgggagactcaactattgctattcccatcctgattcaaaaaaccagtttgctctagctgcccagacttccccacaggctgcattcttgcccatgagctcattgttttggcttctttgcctgtataagtctactgccagtgccagaggtctcagcccggggccccctaactagctggggctgcattccattcagaatttcaccacccccacttggtgttcttcccgccctcatgtggtcacatgtgtatgtttactcaagttagcctgggacaaggtgtgctgggatagagagccaaagaagcagagaaggaaaagaatgtttaactgttaggtttcatcctggattagatttcagtaaaaatgctttcagttctgtgccctaaaaaatgttaattttcttgtctggtaggaggagctggttttgaaaattttgctatacatttctggagcagttcccaccgtctccggcccttggtggaaatggggggaggggagacagctggcctgctgcaagggagcagctgttcggtttcactgctttgttactgaactttcctgaggggaggataccttgtttatttccttttgcatgagagcccaaatctaaggaaagtggggcacacacctcaggtgaagggctatgggaagagcatttctcttactttgcagagttttggattaatactagatgcttaagcggtatactcctttcctccacccccctcttcttcatctgtaaaaacaaaaccaaaaaacaaaactgcaggctgcggctgtgggaggtgactttttttcatttctcagaaatccctcatgaggcaaagcagagaaacagaaagagggaaacaactttgtgtcaaaatgaggttgtgtgtgtgtgttttgaaatgaggtggcttgttgtcagctttaaggaacaacagctctgcagaggagcctggtgatggcggggaggagtgctgggctacctgcttccttgccccttgccccacttcaaagctgggtagttggggtcaggtatgaaacaggatggaagtcgctgtatcttcctttccccatcatgaaccatgaaagatgtatcagtgctactgtatgaaagaaaaatttgaccagtcgcggtggctcatgcctgtaatcccagcactttgagaggccaaggcgggtggatcacctgaggtcaggagtttgagaccagcctgaccaacatggcaaaactctctctactaaaaatgggggtggtggtgtgcacctgtggtcccagctacttagttgcaagacagtgtaccttaaacaaagaccaggaatactgtcatttcctggacccaggaaaattggccaggcgcagttgcacgcgcttgtagtcccagatattctggaggctaaggcagaagaatcacttgagccctggagttcagggctatagtgcgctatgttgatctggtgttcatgctaagttccgcatcaatatggtgacttcttgggagtgggggaccaccaggttgcctaaggaggggtgaacctgcctacgttggaaatagagctggtcaaaactcctgtgctcatcagtagtagaattgcacctgtgaatagccaccgccctccagcatgggcaacatagcaagaccctgcctcttaagataaaaattggaaaacactggtaggaaaaaaaggctgtttggtctaaataagtctggattgggtataaatgacacaaaactatcatgaatttgaaagcatttctaatttcttgaaagtctgaaaaagtttaaacagaattttagctgaaaagtcctgaaagacatttgaaaaaaaacagcaagaacacttaaaactattcaaggtttgggctgggcacagtggctcatgcctgtaataaacaaaacaaaacaaaacaaaaaactattcaaggtttggatcattgaggccaaaattattttgataacaagatgccccgtgtgaatgaaactgagtaatagaaggctcatggccagtagtcgtagctactagggagactgaggcaggaggatcacttgagcctaggaagttgaggctgcagtgagctgtgattgtgccactgcatttcagcctgatgacacagccctgaccaacatggtgaaaccctgtctctattaaaaatacaacattagccaggcgtggtgacacatgcctgtagtcccagctacttgggaggctgagtgagtagaattgcttgaacccgggaggcggaggttgcagtgagccgagatcacaccattgcaccccagcctgggcaacaagagcaaaactccatctaaaaaaaaaaaaaaaagtgaagaaactagatctgaagccttaattttctcccctataaacaggacttaacgatactgtcagctatcttattaccgcaaagatttaaagagagactattgatacacgtgctttgtgcttttaccttaaagcactacacaaatagaaggagtttcaggactgtcccttaagggtttactctattaaccattttcaagtccttaaattccctaggagaagcaattaagaaccaggcatcagtagagtatgttgaattaaaaggttctacagctgtattttgaggcctggaagagacacaaacaggactttctatggctaggcagagcagaagtcaccagttaggaaaaatccccagggtcagaaaccacctccctgccaaatttgccctgctgcctgtttttgtatggcccacaagctaagaatcattttggtatttttaaatggttgaaaaaaatgggccgggcacagtggctcatgcctgtaattccagcactttgggaggctgaggtgggagaactgcttgagcctagtagttcaggaccagcctgggcaacacagtgagaccttgtctctacaaaaaaaaat

SEQ ID NO: 5139 - DNA, 1297 bp, Homo sapiens
actgagggggcgaggggaatccagggagctgggcttcccagaccttctcagccagcttccagctctaggcttcagaaccaggctctgccttcgatccccagcccagcagtcacatggcttcgtgggctgaggaggaggctgagccctagggccctgggcccccagtccctggttcagtcccttatctgacttctatattgggggtccatatgaaaccctgtttgtaaatagtttctgctgatgaaaaagaagttgaaaaaccactgctgttgttcacctgtgcccattcccctccccagcacctccttgcctgggcaaactcacctggctccaaggagagccaacttcccaatggccacagaggcgcagctggcaagactgggtgatgttgggccgggggagatgtccacagcgctccgggggcaccgaggagccaccccccccaaattcctgccggcactgcagctggcggtgctgggtgccggggccacaggagcggctgcaggatgtccactcgccagcctcccagctgcaggcaccagcagggcagggaagaggcggagacatagatgagatgtgtggggctgccgtggcagcagagatggaagacacactggacgtgggggcctcagaggcaggagatgttgcgttgagtgcagagttcaggacccagggggatccacagcccagttcccattgatgatggaccggcccccagggccacgaagtgctgcgggtcagagactccacagccatcaggacgcctgccagagccaaggatcccatcacagccggggctctggagagagtgagtgagagcacaaaaacagccccaccatccccagccagacccagggacatggacaggtgcccgatcagatccttcaggctctgctcagcgcagcttggcagccacctgacccccagtgatggccttcccaggggagtccggacaaagcgtgtctcccacacctcctcctcccaccccgacccttctgcagaccactcaccacctgtgctgtctcctgacccagccccagggagaagaaagaaggcatggcgcaggggaagcagaggggctggaagtcattcagggctgggagtaagcagtaaggttttacactcgggactcagcgaaaggacagcgtgctgacttctgagtcagactgatctggatttgaacctcagctccagctcttgccagctatgtggtcttcgacgaatacttccacccctgtgtggtgcagtttgctcatctgcaaaatgggactaatctaatatatatgatgggcttgga

SEQ ID NO: 5140 - DNA, 447 bp, Homo sapiens
gctgctgctgggaggacgacggacggcagcggccaagcaagaagaaagacgtggcagcaagcgggagtcggggatagtgtcatcggttcggtaaagtttctgttctctggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagt

SEQ ID NO: 5141 - DNA, 2517 bp, Homo sapiens
aacgagctacaaccctgttacttgcgcacgcctcgaacccccaactccagctgacgttccctctgccaaagcaagaaaaccacaagtcgccacaggagagcggacccggctacacaaagcgaggcgcccgaccagagggaccctcagaggacgctctccgcccccgggcccgtccccgcccagctcctgcccggcgcctcgcgctcaccagctctcctcctcctcctcccagcctgacaggcgctccagctcgtcgggccgcagcggctccacctcgtccagcaagccgccctcgcccgccgctagcaaggaggtggcgtcccgcagctcttcgctactcgtccgcctcgggcccgacccgggcccgccgcccgacttggcgctgaggcccaaggggaagccccgaggagacgccgcgccggaggagggaatggacgcgccggcccgaaccgggctgccgggcccaagggagccggcgccctgcacggcccccgagcggctcctcagctgttcgttctgcttctccagcttcttcaccagctcctgcagcttccgcacctcctggtccgcgttcacgttggagttaacgtcctccatcccggccccgccgccgccgccgcctccgccgcccgctcgctctcgcagcgacagggaaagagacggaggaaagaggcgtcgccgccgctcactctagccgaggcgccggcatatagcaggaccaggccccaccgccagggtccccccacctcgggttccaaagcgccgctggccccagccgaactgcctcatctgcgccggctccgggattgggggaggcggcgccaatatccggcccctgccgccatcttccctccgtccctccgccccccgcgggccggcccagtcggtgacctcagagcgtcgggggtggacgcggccgccggcgggcgctgagaggacccggcgccagctcgcggcggggcggggccacggacggggcctatggggcggggccggtgcttgaggggcggggattaggccggaaggggcgtgtcggcggatgtgggacgcggccgggctggctagggagggtccctgcagaacgggaggccagcagaaggctcgcggcgggcggggctgaggtggctaacaaggtcctcgaacagcctcgcctgttggtctgggcgtgtgggcgtgttctccaccccttacagggagtgtgggacccgcgggccagtctcgcccttgttccgggccggatctcgagtgggcgctcagcccggcggtggagagacagtttactttgttcagcaaatatttaatcgatgccgacttttaattggagattgtctcggctggcaggagcctctagactgcctgtgtcctgtttcttcccctgaaaataagaaaccccagtttcagacagttaagagaggtctaaggtcaaaataatcataatttcttgagtgcttcctactggccagacagtgtgctaagcacttttaaaggcattatctcatcggttaaaacatagttttcccgacttaaagtttacagcacactggggcggaagcgggggatagtaaaccgcttctctactccctttctccgtttattgactcacactctgttctttggatcacttccttcggaaaaagttcctcgtagtgtgtcttgacttttttaaaagttgtatgttaaaagtagttaaacacgctgacagatactgaagaatgaagaaaattgtaagaatgtgaagtctgcctttagaatgcggcaggaaacctaaacaaaacttaaatgctttgttttgatcacattatcacagtcgttggtcttcagaggtcaattgtgaacggctttggcttgtgtttgcagcttttcttcagttgccgcctccacccttagtttaataacaatgatccagtcctgttacacctgagtgtggactcatgccatgactgacttgcttctaccctttagcttttctagtgccatattctccgcctgccatatctgattcttttcttaaatcccatactctctcattcaggaaacctcttcccaacaattccacaaagatctaattattctgcatattctagcactacgtgatcaatagttctcaataggtgtttgcacttttttttaaattgcttttttctctaagaattatttttcgtttgtttttgtctgtttacttgatttaaggacacttcatttttgcttcccatgtctagtacactgacacagtggacactcaatacttggtttgttgaaagttaagtagactataagttctacttaaaaccacgtagctatttattcgtagcaaaaaacgtatttgtgttaaaagtttgctggctaactataagtcgagtatttttctagctatacagacctagtcaaaggatgtgattgtttgctaacataattgtcaagtaatatatattatctgtgtaatgctcatctaaatatcattgctctttctgaccagtctgaacttgttgccggagggttaaaaatcatgactacttc

SEQ ID NO: 5142 - DNA, 11893 bp, Homo sapiens
actcccaggactagcgagcggcgggcgcggaccggggcctggggtcggaggcggcgcagccagaaaggccccagcggcgctgagacgtttgggggaaggcgggggcttcgcgtttcgatggcgggaagcggaatgaggttggaccggccgggccggcgttcagggacccggcgggaggcggagggctggcgtcctcgcggacatccatctgcagcgaaccaggcagaggctttgggattagatccttgactccttgcgtcagtagttaaggtttgtttaaatataaaatgggatggcccttcttacaaggttgctggaggattaaatgaataggcatgtggaaagcacctagtataataaggctcggtagtttcttccatcagggctggaagagaccacggagcctgctttcctccttcggcgtttggatctcacatatcccttcttctctggcgatcaaaaatccctatcttctgtagagatcccttttacagatcagtggcctccaggcggtatctctagcaacaagtgctaccccaagcggccggccacacatattccctggcttcatgacatagggaggcgcagtccccacgtgatgcagaagggaaatgtgcctgtccttgcactgaccccgtcagccatgtgtgctcctggctgttttctgaaatcaagaaccagttacatccgcccttctccgttctctagttgaaacctccctatccatccttccaacattcatctttgtgatggtctgaggtccatgaagggattaaaaccaggaactggctccttctccaaccactaaagcctcatctgggcccacaagccctggctgttccctggagcgtgactggaagatgtgagcagctttgtgctggagccccatttccatgggtaaactgttcacctgatcaaacagctccccagagttccacagtaccacatatttattttctagaactttgtttttagctgaaagggatcttagaggctaaggcaatcctatcactttacaggtgataaaactgaggcccagagaagtgaagtaacttgcctaggcccacacagctcatcagtaaaagagccagaacacatggccgagacttctccctaatccagcgtctcctccacactcccagctcacccctagggtttgtgcccaggctgaggacactattttcagaggcactaatgtgaggcaaagggcatgttaccagacacagccccgcctaccccggtcccctgaggtggagctgtgcattccactggcttcacggttcccctctgccctggcggcttctggttggtattggcgccaccgactgctctgccatggctcctcagtgagtgctttgggtgtgattgacaagtttccatgacatctcccagggagtggggtcctgatgttggtgacatctctatcgttcatcttttcatggggctgatgaattcctagaaagggtagaaggagaaggagccactgaaagaggctctttaaaacttccctgagtgtcccccagtgcaaatgaacaggagccccaggacacttgaaggccctaggaaatcacacctcagagccacagatgcatcctaatgctctctgcagacggggcacgtgtcggaggtgagaacaacagctccagatgtctctgtctttgcaaataaggcctgtgacatttaatgatgtaaccacctaccttccacccattgttctggtggccatgagtagaaggaattataccaggatgtgataagaaggaattaggagctgggagtcttgctgggtgaggaccttggccccttgcttgcttgccatctaataggggcactcctggcctgtggggtcagggagaactagacccagagcatggttgtctctgtgactagttgagcctgtttctccttcaagggccctggcagtgggaaaacatattatgacaattgcactgttttatcagcccttggcactcctgaagttgccctgaaataaacatccctacctgtatgccaggccctgcctacttctggagctctcttaggtttacaacctacccccgctgtcccaaattgatagggtgagcccagggcattaaatgggtggtgcaagtcaggcttcaggactgacacgggtctatgtgcgctcagtgtgggttgaggggcactgggctgtctttctccctacagtgcatgctgctgccaaaccagagatcacttgtagacttgaaagggaacatgagctttgggtgaaggattcccagcccccaacagaggccaaaaagctaccacccagccaggtaagccttgatggaacatctcttgcacaaagatcaccatgttcattgagcctttagtgcctcctgggctctgatcaacccacgaatcagtatctccgcagcacttcctgtggtttggattcaggttttttacttctgtttcctgcctttatgataggagtttgggtaacctgtgagaaacacagccacagtgtaaacctcttgagacaagctacactgatgggacaatcagggtgagggcaatccggcgccgtggctatgtcagctcatgtgtgctctttcaggaggacatgtctcacagacacagatcttcagctctgacatgctcgatctcacaagcccttttctgaaacctccatcatgtgctttctgattctctacaggcagaaggaacataaagtatgcattttatgatacgactcagcttggagggatgaagtagaaggtcctcactgcacctcatggcaggctgctgacggcagatattttaccgggctcactgaactgggcagtcagggaagggtcggctcctgctctgtccagctgtcttcataagggactctgtgacactttttataaaaatgactttgatttctgcataagaaggcttcccaagcttgctgtctagcagtggctgctacagggaattattcacatggcagcaagagagccctggctccctggaccaggacattccctttgtgtgtgttggaatgagagcaggaggagtgctggtcagaagcccctccccagggctctgggacttcagtgttctcagacaaactgggccgctcctctgagctgggatgctgacccacacttggccccggctctggcatccacaggacgctgccttatccgtcatctcgctggggctgggggctagaggctgagcaggtcacactgaacaaaagaagtgtgtccccatcactaggctaacatctgagtttcttccacagtatttggtaacacagtcagaaacaagactgaagatgattctggaggcaactgggaaccccccagaacgattctgcaggcttctgggaagctgaaaaaccccaaggccagactggcctcagaatgcctgagtccttttgattccactggaaaagccatccatctgtgccaagtgtgtggagagcttcaagagccatatagccctggccaccatgagcacagccacgtgggggagtagtcctgaaagtgtcctggtgtggcaaaggctttccactaagtggacctcagatggcacaggaagaccctcctggggatgtgggaggacactgcctagtgggtgaggggccgctctttcaggtgtgcacactaaatgcagagacagcctctcctggctgccaagaagcctgtgcatgatccaggaccacaaaacacttgcaaactcactgcccagaggccctgtgcctgtctggagtgtgcccagtgtgtctgcgccccacagcttgtcctggcccgccagcagagccgcagcactgcagggcccttctgttgtgagtgccagggcccttgctggctgcctgagcaaggcaaaaggttcaaaacaggaagtctctgggcagctattcccaggtgcagaggggagcagcggccacacaggtgccagtgtggcaggagctgcagtcagaggcagcatctcaagagccctgggagcaggggccagccacgtgaagcccacgagtgtcgctggcacagggaagggacacgaggatcacactgacccaagagaaggcccacagtgaggaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaggctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgtttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctttaccttctaactggcaaaaatgattgagctcactttgaaggactagagaggaaagaaactgaaagacaaaaatcaggtgaatacacaggcacttcccctgcccacctctgttcctggccctgtcccctcgtgagtgagagcagagctcgttctgtcagcttctctgagctcctggtcctcgcttagggacacacaagacagagatgtgttgaaatagactctgctttattcaggtagcaaaaggttaggaatcaaacatggtttttaaaacctcctttcatctttgaaaatagaggagagaacatccctgggccagtcacagttactgtatttggctaagcacacacctgtatgagggacccgcccctccacactgttctgataggtacttagcaccctagaaactcatcctctgcaggagagagaagcaagggtctggagcgcggtcacatactctaaggtatcttccaggacagggggctgggctccctcactcccacctggagtcgctatggctattgggatcaaactaccagttacatactggttacttggaatgtcagacccggtgggtatcagtcatcagggagagggaggggaaatgccaggacacgtacatacggatgctgtcaagactacaggcaaggaggagggtggcgacaagcgctgggactccagccaaagcgggagtgcatgcttcttcccctcccagagccctgtggtttttcttcttgtgaggcataaacaggaagcctctccaacaagggggtctccagcactaggggctgaaactcagccagcctctccaaacaaagcaaaggggccagcctgggccagggcctctgataaggatgctcactgtgtttccacgggggtcctgaatgaggaagttcaggaataagatggcagtcatcttcttccttcttggccattggctgacaaaggggaacggagcaggcctgtgccccttgagaaatcgggtagtgcaaattttatgacaaacagcattctcagtggccccgctgcacagggacccccctttcccaccacctaaggaaggcactggccggtgtcctcggagcacgctgatgctgacgtggagagggcgagttgcttcccctagcttccacctcagctccagaactactcccacagagacccactcacggctgctcacaggatggcctcctgctctgagggattcttcaaggatgaagaggccgcaggaagcatgtgtgctggaacagcaccttgatgtggaatccctgtgggtagggcagaggctatagccccacctaaaaaagcctttctccctccctttccacgagttcacatccacagtgcctgacctgggcaagttcctgaacgcccatggagacggtgatggggagaaggaggcctgtgtgtgccttagccacgcagatagtaacacctcccagagctcccgcaccacaggcctgtggggtccctctgaccgccagacccacagggctgggagacatttccacaggtcaaaggcagaaagcaagaaaggaattcctgactagaactgaaaatgacacgaaagcaacagtgctaaggctaagtactggggtggggatgaaagggcaggtggggtaccagggtacctgcggtaccagggaggggctcggacgccagcatctaccctgggaatgggaagggtactcagacagcagcttctaccctgggaataggaagggtactcaggtgctcagatgccagcatctaccctgggaatgggaagggtactcagacagcagcttctaccctgggaataggaagggtactcaggtgctcagatgccagcatctaccctgggaatgggaagcggcagactatggagaaagggcccacccacaggggcctgcagcacagcacaggacctgcctgagccaggcagcaagcaagctgggatggatggcgcccacttcctgcctgtttaaaacaagtatcaggcagggcagagaaaccctgcctgctgacttgcctcatttcctgcccatggttaaggaaggcagaacctagacaaaatcatcctcctcctgataagcggcctcctgagcctgccaagacggagctgcccttggaaggaaaagtgcttcactttaggtggaaggaagatcggggcgaggagggtgtgaacctagcagtgccagaagcccctctgtgcctctagggcggtggttctgtggttctgaagctagagcaggcccaaagtccctggaggaggttgttcaaagcccttgtcactgagcgcccattcggggatgtctcagtgggccctggagatcctggtgcagagtccccagggcagctcagagaagagtggactagcctgtcgtgcagatggtgcattcagagagcaactcctacaacaaggactttggagacaaattcctacctgtcccactaaggacgaggatggggcagatggcagctaagtccacactgcagccagaggtctttgagggagctcgaggctctcattcactaatcctagggcagatggggagtcagcaggcacttggatctctgctgccacttcatggagagggaaactgaggcacaaagaggaagggattaatcagaccactgcctgcagcagagctggggctgcatcccaagcctcccaactccaacttcgtcccatcctctcctgggtaaaccgggccgggcatgccacgggttaaacgcggctcggctctccgggaagcaccagaccccctgccagaagagcccagctccaccatctggagctgcaggaagagaactttcttgggtgctctgtgcaaagggcttgtgattgtttcgccctaaaggaagccctgggaagaggtagagttccgcacgagaccacggcctcactgcttctgctgtgggagccagggtaggaagtcccagaacaatgcctctgggggctcttgcagccaggccagctgtccctagagcaggggcaacctccccctctaacaaggtggtctttcccattcccacttagactgtgggcagcctccctggaacattccccagggatgtccaacagtctcccctaccaggacactcctcttgccaccaaaactcaggggctgaaacctttcatgatggggttattttctgcagcaccttaaaaatgaacttgagatatagaaccttctggcacatttgtgtgctgtgaggcatggctgtgctgagtggggcctcaggaaacaggtcatgcacctcctgatacccctgctgctctgggatgccactgcccacttcctggtgcttagagaccatcgccaccagcagaagatcctagggcagcctagaatctgcagagcctgtcccagtgatcacagaggcgtctccaaggcagtcccaaggactccctgtccctcaggacatcccgggggcctcctggctggtgtggggatacaggagtctctcgggaggctccatgatgcagtccttcagaacctccgctgcttccctggagggcaggatgggtggcttctgggtcctgggctcctccacatagagggctcccatctcctccttcctgagcctggcgcctgtgagggaggaaggagaatacaattagactgactgacagtgaccgccttccacatccagcttcgcccaggggctgtttggtgaggaaagcttggcagaacagactgaagtcaggaccacgactgctctttgcagccctcatctgttgctactctgttcattcttttatcctgagataggggatctcaactgggggcgattttgtcccccaggggccatttgccaatgtctggagatgatttttgtggtcacaaatggggtgtgtgctactggtatccagtggttatctaataggtagaggccatggatgctgctcaagttcccacagtgaacaggaagggcccccaacagagattacccagccccagcatcaacaatgccaaggctgagagccctgcctggaaggaggcagcggtgcgtagtttggcagtgtttggaccaatctgtgctggtcctgttgtccctgtggaaagagtaactcgcatcagggcacacctgacatcatttttttctccttagcacccacagggctggacacagagcaactcacccagccctctctcggctttccctttctcttatcagtgaggggtctcttttcttatccccacctgccctactgtggcttcagggccaccttgcttcctacagagcctctgtcagccatgagatccagtcccatttctggtgaccacagactcagaggtgaaaactgggagcagcaacagccggaaggaggccagctagagacgcgaggagagagagcactgggagcagcaacagccggaaggaggccagctagagacgcgaggagagagagcactgctccatccttgtcaagtggtcgcgagtggtctggagaaccccaacaatgggcatattttctttggttttcagtgactacttgaagagaaaaatttcctgtctgtggctttcagtaacttgccctcccttctaatacagcttccccctcaagcaagttcttgaccccagccctccggtccagagaggctgtttctgttctcccctgccccgtgagatttctgcctgaaagccccaccatctcctccgcatctcacctcctccacagccacatggacctcttccctcttgaaaattcctgcacggtccagagtctatacagccccacttagaatgtgatggcgctgcctggggctggtcagccctctccttactcccagcagtggtcttgacctttaactagtaccatttgcaccacctgccaggcattgtcctgagtgttttccacacacaactcattcggcagatgagaaaccaaggcatcaaaggacagacttgcccaaggccacacagccagttgggggcagagccagcacagcactgtcaccagggcagacaggctctagaaatgcacgctctctgcactaagccctgctgcctagagcacatgtgcgtcatctccctggcaggggtgcaagctcctggagggtggatgtcacgcatcgagtacccactggcctagcaaatgggtgggtgcatgacagaagctccacaggcacctgcagtcctgtcttattggcctctggctcagcatgaggctgccttgggggagctctgccacgtgtacttacttgcaggggagcgggctggcacctgggcacaggtgtagacatggctgaaacgccggcctgaggaggtcaggtaccagtgctggatggcgggctgggggtcgtactccgtgacggccacgccgttcacagctgtcatcatgagcatgttgagcacctcgttggagagcttggtcctctcatcggtcctgattcggttcatggccttgaacccccgctcacagcaagaggtggagatgggcacacagaccaccacggccatgagcttgcttagcagggggaagcggcagtgctgggccagggcgtttttgcagagcatggagaacgggaggtgctgggcaatggttttcaggcccagccactcctccagcagagcttcctcactgtatcctgttgggagggagcactcgaaatacctggccaggttgagaatgtcatcattcccaaaactggcaagttcaatcccacttggccaggccatggtgtcaaacacctccatgttcttcagctgtgggggtcggtctgcgtcaaacctctgctggaggtactcaatccccgtcaggactgtcctctccctatccgcctggaaccgctgttccgctacctccagtttgtccaagcagatgccgtggagccgcccatccttgaagctggcgttgaattcttcctctttgggccctgcctggtgacggaggctctccagtgccacgtaggcgcggcccagcgtggcgttcacctctgtaatcagcacgatctccttctggcacacctcggacagaggcctgtagatgctcaggaagtccaacaggaagtggcagaacttgacaaagtggaagccgcgcatgagcttcagcatccctttggcccggtgcccaatctggcccccagcctctgccaccctctggaggtgcctggccagggcgggccagctcacgagcagcgcgtgcagcgtgcgcctcctgctggccacccagcggaccgcattcagatccttcaggcggatgatctcctgctccagaggcgccgcaccttcctgcagctcgttcagcctcttgtttgaggactgataaaacttgaagacggtgcggatgtgccggtcacacttcttcaccagatcgatgctcccgcaggcgtccaccacagccaggtgcagccggtgggccacgcagtggacaggcagcagctgcgggatgacctcctggaacttttccacaaggcctcctctgcagctcaacatggctgagccatccgtccccagccccaccacccagccaggcttccggaaggggatgtccagctcatccagggcagaaacgatggtctcgaagtacccatctgctgtctcactgtagagaggggccagagtgatgtaggactctttcacctccatctgcttgaagtagcggatgtaaatccccacgcaggcctgctcggaggcgtcggtggagctgtccagcagcacgctcacacagggcgagttccgcacgtcctccaggatctccctcttcagggtctctgagatgtacttgatgaactgagtgcacgccgtgcgattgcggtacttgcctaatatcacggtccccgtgctttggaggagctgcaggatcttctcaaagtcattcaggggccttgagtggtatgcaatggagtaggcggcattgaaaaagtgctccatgttggccatgaggtcgctggagatctctggaacgagggcagtgtgaggggtgtcttccttgatttcaaccgtgttgacacagagcctgtgcgctttgctgacttcatggtattttaaagtctccactttaaaaggccccgtgtaacctctgactaaccgagatgatttatcatggag

SEQ ID NO: 5143 - DNA, 2377 bp, Homo sapiens
ctctcgatccagcctcccgccccctccccgcctgtccctcccggccccgccccgcctcccgccccaacctagtgcccgacaggaaacctcccacctggcactgcccccaaccaaagtcatgagggcaaggctccggttcctgccctcacagggtcccagaagcaagggcagtgaggacctggcccacgtccctggcacgggctgtctgattctccttcgctgtggcgggaagatggccggatttgaaggcctccgctgctcactgctgtgccttgatcggcctggacgagcccgcccacacctccatcatacccagtgtgaagaggggctggggacccaccactcctgagaacagcatccttgggaagacccagctgtgagtgcacagcaggcacagtccctcaggcccaggtgctatggggccgcagcagcatcaacagcctctctcagctgctgcagcagctctttgggctgtggtgagaacgcgctggtgtccactctctggaagtcggggtgcgcaaccaaggaggccagcacctctgtgatgcgcccaacatcaaaggctgcctgttcgaaacccaacccagcaccgtcctcagcggctgcctccctcaggaccaggagcctcttctcagcgatgaccttgaggaagtggtaaaactcttcaaagttgatgcccgagcaggacctcatgatgacctgggcagagggaagaggccagtgagctaacaccatggacacagtccaagctgcaaaggacccgacatgcgcccagtccccaaggacgaagaagggaccattaagacagaggcactgagaagctgcgcggtgaccaagggagtctgagccatgcagcctaaaagcctcccccaggagggtagcctccatgcgtagccaccccacctggcagtggtggtgccagtcgggcatggagtccctccactcgctgacctcctcctgcacggcgcatagctcctgctgcaagaagcgccacatgttggccaggttgaagccattgacccagttgtggttgatggagatggtgtcatcctggaaggggcacagtgcaggcaggcctgagcccatggcaggtgccccctgaccaacccacatctcctgcgccaggaacccactgtggggtccagccctctgcagccaagagggccctcctgtctcccagcagggcttgctcagcagggaagtgggtggcgggctcggaccacctcaggccacagtgaacccagagcaagtagacccagggaccggcagtgggtgaaacagaggctaggcctcagcgacaccaccttgtgaaggggtcagcctcacccatgagccaccccattccagcccagctctggctgggagagtggggaggtggtgctgccgtcttcctgcaggaaggcccctgatagggggcaggagaagcagcacattaccaggttgtgcacctggtggtgccagccactgggcacaaacaccatctcgcccgcttcctgcgtgatctccaagggtgggccagcaagctggttccgtgggtgcaggtgtgtgtcgcagagtgctggggaggtcacgtcgtagggcaggttgccgtggcggtcccgcagggcctcttcctgccctggggggaagaggagccacttcttcctcccacagacattgacagaccagctgaaggagcggaagatgtcagcatggaacggggacctgcggcagcaagagcgcctggttcatgcctgtaggggctggtatgggctttgcttggcaccccagaggcctggtccaactgaaggaggggtggccccttggtctcaagggatggcacccactgtgaggcctgtgccaagcagcccccctcctgccaccctgggcctcccagtccgttctgtcaccaggccccttcgggttccactcccacatccgtggcctcaccagctgcccgcaggccccgcgtagacaaagcggtagtcatccacatccagtgcatcccagaactcattcagccagtcggacgagaagtacacaggcagggtgaaaacgtcctccaccggaaagtccctgtgaggagggcgcaagggcaccaccgacagcacgtgaggcacgaggagactagggcagcacgagtggggcaactgagaccaatcggctccagtggagcttccagatggctgcagcccccaaagagccccagaccctcctctgagccagacgctgctggcgggggagggggcggggcagtctgactacaatggttctgcttattagaaagtactgatcatgcctataatcccagtgctttgagatgctgaggtggatgcatcacctgagctcaggagttcaagaccagcctgggcaacatggtgaaacctagtctctttaa

SEQ ID NO: 5144 - DNA, 2917 bp, Homo sapiens
tactgatctatttctgtgccaataccacctactgtaactttaaaataggtttttgtttataccaagtaagaataagttaccattatttttccattaatttttttttttttttttgagacaaggtctcactctgtcactctgttgcccaggctggagtgcagtggcatgatctcagctcactgtaacctctgcctccctgcttcaagctattctcccacctcatcctcccgagtaactgggactacagatgcgtgccaccacacctgactaatctttatatttttagtagagaggggggtttcaccgtgttggccaggctagtctcgagctcgtgacctcacgtgatcctcccgtctccgcctcccaaagtgctggaattactggcatgagccaccgaggctggcctgagtattctagtttataacttacaaggtcattcatatgtatatgttgttgtgcttgtctagctattttatattttgttattctgaactcttggcctctatctcagctccagcccctgaaagtgcaggagtgcttttgctctgccagtcggccttttttgggaaatcatatcaagatggcttttccagcacaattacttcctagagtgtctgcttgatgcatggaaactcatagatttttggcatgccaaacagagggttttcctgccgtcactgctggctccagccacagacttcagttttcttacctgttagagcctttgtcctctgactggtggaaatggagcttgcttctttttgttttgcctgccactagtctggcagcctccacctcttgacccttgggtttcttatccttggaatcagatacgaggccctgtgtcttctgttgctgtagaggacacaagtcatattctctgagtggagatctctctgaagctcctctttccaggcttgtactgagggacctctggaccctctaccacgtggtgtcaaagctgccaagagctgtcatatgctgggtctgtaaattgactttctcacctctgaccagatgcattcacttgagcggcacagagatttgggggagtgaaagggcactgtttctttgggtccgtgggcttgtgtcccatcccctagccttggggttagcaggattcagaatttatgagtgtggtctgcaaaagtctacctctaccagatgggggagaacctagtgtgtggacctgaagggttagctctgtgctttagtccctgggagtggccatcttgagtcttggtgggcttggcaagtaaggagacattgaccagattcaaagcttccagaggtggtgagaactccagggccgagtaatggagagtacaaaggtccttcttggcccccatgacccttccaagccaagaacttggcagtagctgtgagaagcagagatagggagaggaggtgaggggcacctatagctcttagccatgagttatgactccctccatccaagggagacccaaggacatgaaaggggactcagttccaaggatcagagggaacttgggttgttttgggataatgactgtggcttgggatgtcacggagatgaacaccagaattggtgtgcaacagatgagctccagtacccctgatagtttgcatgggttttgctctgctgatgatggtcagggacagcagtgaggccctctacaatgccgccttctgcctaaacacaggcagtgcccacaaaaggggagctgtcattatggagcctaggaatggatagtcagagagcagcggctgggcagtgcaactcctgcattggacaaggtcctggctagagaatgtcaatgtccacactgcatgtagccctatcgaggagatgatgtagggggctgtcagccttggagactctagcctaagtaccccaccaccactctggctggcttccaagggcacaaatcagctttctgaatctgacttggcttcctgtgatctgcattcatgaacattcttactagagttctcatggaaaatgaatacacaactatttggtctgaatgtgtctgagtttggtgtctccaaaacaattctctggattagatggagaatgaagaaacttcacaaaggcaaaaggacaggtccccatctcgacccccagagaccacttctcagagtctctatctgttcgtctctggtgttagccacgttcctttactttccctcatttctgtggccactcctgtggcttcctctctttcaacctgcaggctgctgctgccctgcctcagacccttgtaggcttctgtagagatgctactcagatgggggtggagctagatgcagagctgaaacccacctaggagatctagcttggagagcttgtgaatcttaggagagctaggcatagaatgactaaagtttgtcaccgcatgagataaaataaatgaaaagccacttctggagggaatgaggcagtctgcctttattggagagatacatattgttgaacagctctgggcagttgattgtgtgcctgggagagctaaccatgtttactctacacttgacctgtgatggtctgtattgattgtatcacacgcttagctttctaaggctaaccaggtcatcgtcctcagtccctgcctgcaactaggttgccaactggcccttgatttcccacccaacttgttcagtttgccctcaatcctggggcctcactaatttcccaaaaagatatggttggtaccacctgtagtttgctgttgcatgttaacctgacttttgggaaactcaaataaacacttttcaaacgcattgaccatttttactctatgacttctgctttgcatgatcgctagcttggtcacccatcatgctgctttctggtgagctgaaaggaaaataaatggtctaaattgagcaacaagaaagtaaacttttaagcaggtactttccaagtgaaatg

SEQ ID NO: 5145 - DNA, 670 bp, Homo sapiens
ctttcctggtcttctccttgtggagcttggatgacctggattccttgctgctgcttttggctacctgcgccttcccatagtcatcagtctcctcattcgaacgctttgaacttcccgatatccggtccttcatcgatcccgacttgctggagacttcttggcttttttctttttcggtctgtttagcttttagtaagtcccgggaacgcctgtgctggtggtgacgatgtttgtgcaggcggtcgctccgatctgatccacgacgttcgtcgttctcccttcggtctagtttgaaggccatgtcatcggagaaggtgtcggaatcagagctgatatcatcatactccaccaaagtcctcaggcccgggcgccggggaggtccaggaagtgagaagccgacggcccggggctgtggagccgactccagctctggggccctgcgaggactacgcgggcccttcccctacccggtagcccggttcaggacggcttcctgtcgccggggtgccgcggcctaggtgcctcacgccccctttgtccctcgctcctgaggtagccccctttcttgcctccgtttcacctccacaccacacacactctctccctcacacagacccagtcacacactagattaaaccgaaacggcacttggggaaggggggaggggcaa

SEQ ID NO: 5146 - DNA, 9768 bp, Homo sapiens
tctaaattttgctgaaaacaaaatgaacgaatgaatgtatatgatccttacaggctgacaaccagggctacaggcctaaagctcacaagcaacaagtgttggctggacacagtagggattcaccacctcacatctccatgtcattctaagtcgttttttaacgaagtaaaatctatcatttttaacgcacaaaatgaaagctatgcacacttctgagctgactttatcagaaagtcatgaaaaacgagaccagaaagaagtacacacagaagctacaactgaaaaagataaaaagcatcagtcaagatggtgaaaagaatcattagctcgccaggaaagacacgcaaccattgcatgtggtattggcaggagagcctctccacgtcagcgctccgtggacgtgtggcctcgccttggcactcaggctgtggcacaggcaggcatctcagtcccacccatccagggagcactccaacctggctgacctcaagggcgggggccatctgggcatcagccgtggcctgtgagccaaacggtcactggccctgatcatcaaactgacgtcctgcaaacccacccagccacccccgcggttacctgtgaatgatgcccttgccgtgcaagtactctaaagcagacacaatctcagccgtgtaaaatcgggtacaggtctcatcgaatgaaccgattttgcgaatatatttaagtagttctccatttttggcataactaaggccgaaatctgaatatcgtgcagttaaggaagtgtaaaaatctcttgtttcgttttggagcaggtttactccgttgcccagactggagtgcaggggcacaatcatagctcactgcagcctcaacctccctggctcaagcgatcctcccaccttaaccaacccaagtggctgggaacgtaggtacgcgctaccacgcctggctcatgagaagccacagcaaaccccacgttccccgccacaaagagaaggaagtccagagtcagtgccaggctgccacggctcaggggcccagcccaccacagcctttcatgcccccccacacactcctgcccaggagctgaaagagccccacactgccgccagcccctacccagccctaagactcttggcagcgcatcttgctgccgggaagcctctgacacggatcgtcagtgcacgtccagctcctccaccaaaatcgaagcttctcgtgggcagagacgccacccggcatagcagcgcatccccatcacccatcaacctgcacttggcaagcacctccaaacagagagagcacacacactccgccggcagccgaaggagctgcaggatggtgctgagagtgggagcaggccagaacgaagctctaacacagaagagccgggtgctggggagagacggggaggacaggtgggaggactcaggcccctccccaggcaggatggggaggccacgacacttgggccagcttggagggtggcgggggaggagaagagcagatgcagactgcacctgctgggggtgacgacggtgtggcgtggccagcccagccactggcaggcccacaggtcagctggatggggcagaggtggggcccaccccaacttccaccgggccttgcctcccagattcctgagccaaggtttaataacagaaaagatggcgctctaggggagcaagggacgccgaccaagcaagccgcagcagagaggactgtgctggagccacatcggtggcttctccgggaggtaacgtcctgtgcagactcccagccacaccctggcgctgcctcggctgcctccctgaatgtcagcggcctgagggaccccactcggcagggagcgggggctgcttgtgggaacacacagggtctgattccaagtgagaggggtgactggtgtggcttcagacggcaccaaccacgcaaaggatacacagcttctcgtcgtcctgaaatgtgaagtaaagcttaacaaagaaggggtgatccaggcgcgacatgacatcccgctctctggttacataggggaccttgttctcttttatgatatgtcgcttctccagaattttaacttcaggtgagagagaagtgagttactatcagaaacaacaaaaaacactaaagacatgactcacaaaggtaactggtacaaattaaagtctttcaaacattgtacacaacagcctggtggtctctaaagccaacagtgtcctgtaccctgaaatcagcacagaaacaccggccctgccaccccagccgccctgcacggagccgcttgccctgctcccggacgcacagctccctgcagcccatactcactcgcatattctctggaggttgccagttctcgagccaggacaacctggttgggaaagaaaaggagaaaaagaaacacacaatgtaataaccaggacactgggcctgacgagtccctctgccccacacgcacgcttcctgtccccactgaaggcttgagtctacagtgaaatattttgggtcttgtactgacaagtagagctaaaagccaatgctcgtgttgatgtgttctaacagctaagagaaaacatatccatctctctgttgtttccagaagcttctggatcagctgctaacagccctaacggtgcaacacaagtacaaactcaggaacctcttcgactgccacgcccttcaccaacagaaggaagacagtggcgccaccacaagtggcagggcacaggggcttctgtgacaacaatatgtccttctagtatacattcattgcaaaggctgccctgaagtttcgtttttggaaataactgttatcatacattttgtatgatgttgcttgtgggcaccatgaagagagcctggctgtaaaggacagagggagctaaaccagcaatgcatggccctgcgtgcccacaagagggagccacctgcccgggatgcagcaggcctcctgccctgtcctctcagcacccctgagccctgcactcaaaccccacctccgagacagagcactccagcagggcaggcatcccaaacaggggagagaccctccactcggactagcctggggcacaccctgaggcaccagactggagattcctggtgggcccacggtttagccagagagcatgaggcagctgtgccagggaggccccaccaccaccaagtgggacacaagtgtctcctaagacacccacagggggacggcctgaggagcagggagcagaggaaacctgtcccgtgacattcctgggggctggcaggaagaccttcaggaggccacagggccaggtccacctggccccgggctgtgagccgcaatcggggcaggactcctgatgggacacgtcagaagagatcctggaaagcaccatgtgagacgccttgtggcactcaagaagaatgaagttggattctggggactctacatactcaaggtcttcccagaggaatacgccacgcatggatggctctcagctgccagggagaaaggggaagtgggccgggcagggctcccctctctagctcatgtgtttctgtgaggtcacgtttctccacaagagcacgtgctagcttcataagtagaaaagaggaagaaagaattgtgaacgagcaccgatatttagtggaaccctttctaaggggatactgatgtgatctttccgttgtctaaactcaacacttcacaagcaggtttcctacaagaaggaaggatcctcttccagagaatggcgcgtgacgtgtccctccctggaggttgtgaccgtcctcagggggcctcccggctctccggtgctgcagctggctcttgcccagcctcctatcactgtcctttccccctcccctggaaatcaacttttatgtgatctccatttcaggaaagctgagaaagaactgagggtaacacatgtaatctgagacccagtactgtggattccaaacagccccatggaggagcctccggctcaccgtgctctcccgggcacctccctggtgcaggttcagaaagacacggaccacagcccctggagggacagtgcctgctctccacccatctccagaacccagggaaacaggcaatttcacagatgagtcttcctttttcagtcaagataaatgttaagggccatgtatggtggcacatgcctgtggtcccagctactcaggaggctaaggcaggaggatcgcttaagcccaggtggtgaaggctgcagtgagctatgatcacaccgctgcactccagcctaggtgacagagcaagactctgtttctaaaaggataaatacatacataataaaataaagttaaattaaaaagagacatacaaggaagtaaaactgaggccaagcacagtggctcacgcctgtaatcccaacactttgcaaggctgaggagagaatcactcgagcctaggagttcaagaccagtctgggcaacaaagtgagaccctgtctctacaaaaaattttacaattagctgggcacggtggtgcattcctgtaactgcagctacttgggaggctgaggtaagaggatcacttgagcccaggaagtcgaggctgcagtgagctatgatcatgccactgcactcaagcctgggtgacagagcaagactctgtctcaaaaaacaggtaaagctgagaaaagaggaggcctgttctttcactgggtggttgtaagcagccatgcagaatgcccaaggttttccaaagagtttcttctttctgaaaggatctgagtccccaaaactttggggactagtctcatggttgaaggcatttttcatgagggcataatccttttataaaaaaattatttcataaaacctgcaatttaaaaaatctaaagtgtaagggcagcaaaagttaacattaattaaaacaatatgttgggaatatgggtaagctatatttcatgtttttctttgcattgtgaaatatttcctatgtgtaaaaaagagaaaaaaggaaaataaacctcacctacggtttcttcacaaaggtcaggcaagaaagaattattcaggaactcacccaggccctccagagtgaggtgcccccagggctccctggaatggccctagcacgcacacggcggccaccttggcgaccacagtggcggcacgggactctgtctctttagaggcccagatggagacagtacaccccgagttgctcaggcctcccctgaacctgttacaaccttcactaaatccacaaccacacacggcttcatgggtcccacgtcagcaaaacgtcccatgtcagctgctttcgaccttcatttctttgctttcagaggaaaaaacaccccgaagacaggtaacaagtgtgacttgacagtactgcgacaatactcctgtttgtgaaactcggaacacaagactctggaggctgtgtctccagcaaatgtccagagcgtactgttttatgtattcaaaaaaacaaaacagagaaataagaagaggtcaataaatgtccccaaaaaccctggagagatactaactttcaatctaagaaaaagaacagcttcccagggccctgccagtgagacacaaggacacagaatgtaacttgctgatgccaggttaaaatgaaattaactacatcagaaaaaacctccgcagaccatcaagagatgtgtctaacgttctcatctacaaaaccaggttaaatatttagccacactcatcacgtcatctgcttggggggtacccagcccccaaagactcaagtggccttcacaacaggtgacacccctcaaggggcctgagacctcctgcctggaaggacaccagccttgcttggagtctccggcaagccccgaggaaggtgagcctccccaaggaaatcacgtacgtttgacacacagcagcagcaaatactcaccgtggaaaaagagccttccccaaggattttcccaaacttgaagtcctcaggccgcttcttccgaggctgcggcggaggctgggcatgctgcagggagccggcgccgggccgaggctcggctgcagtgccgtccatggcggggccctgcctgctgccaccaggaatgccagggggcgtgctggactcagtctgggtcctcaccattgatggggatgggcaggaacataacaccacgctggactggatgggcacggcgtcatactaggcgacaaagaggaaaaggaagtaaggctcaaggcagctgccttgctctcaatgcacggactaaggtttaaggacctcatttcaacgctcaaaaacaaaccccaagcacagggcaggccagctgagccccgcggtctgctgtgagctgccggcctcctctcctgagtcctgcccgtgccatggctccccgctaatccaccaggcagcgcctcgccctcctcctgtccctcgcgctgcctgagcctccagccaactcatcccaaggccaaggtaacctgagcagagatagcacggcacatctttaattgtgggggggatggagagataagagtgatgatcgcatgtgtttacaatacacagagacgcccagtgctggcaagactataataaagcgagcgcactcacaccactgcggctggcaccaaaaaccgggattgcagtggaaatgtttttggaaagcagtttggcaactgtcaacaaagcgactacagaacagttgtcaatgagacacagaaatacgaaggagaggagggagggcagaaacccagttaacaatgtaagcgggcacggagggaagatcagcgtgcaaagctaggtcggcaagacgtgcaaggtgcacccacagccataacaatccctccccagaccccaacgtgtcctcacggtggtggcagtggccccccgcactacagaagaacaatgcgaggcgagctcaggcgcgctgatggtggtttccgatacaactccccactcaaagaaccccggagagctcttgattccatctctcagtagggtcctgaagtccatgctgtctgaagacacagggtctccccctgcgtctgtgccaggacagagggactgccaccagccaagctgcaatccttttaaacgctaaaaacggccgggcttggtggctcatgcctgtagtcccagcagtttgggtggatgaggcgggtggatcccctgcggtcgggagttcaagatcagcctgaccaacacgaataaaccccttctctactaaaaatacaaaattaggccgggcacagtggctcaggcctgtaatcccagcactttgggaggcagaggcgggaggatcacctgaggtcaggagttcgagaccagcctgaccacatggagaaatcccgtctctactaaaaatacaaaaaaactagccgggcttgttggcgcatgcctgtaatgccagctacttgggaggctgaggcaggagaatcgcttcaacctgcaaggcagaggttgcagtgagctgatagcatgccattgcactccagcctaggcaacaagagtgaaatttcgtctcaaaaaaaaaaaaaaaaaaaaaaaataggccgggcgcagaggccaaagtgggtggatcacttcagcccatgagttcaagaccagcctgggcaaacacagcaaaacctcacctctactaaaaatataaaaattaaccaggtacggtggcatgtgcctgtcgtcgcagttaattgggaggctgaggtaggaggattacctaagcccggggaggtcgaggctgcaatgagccaagatcacatcactgcactccagcctggacgacagagggagatcctgcctcaaaaataaaaaataataagtaaataaataaaaagaatatattcactattttgcttatcaaagtctcttaaaggaggtgacttacctacgctatggacccaattactcagccaataagaggacacggtccctgcccatagaaagctgatgtccagcctgacctcaatacaaaaccatccagttaaagtggtgggggtggctatgcagagacgggcgggtgccgggagagtcaagggcagccccttggctggccaggggctcagacagaccagctggggagatgcatcactcgcccaggaaaactgatgacagcttagatggcactgcaagagcagggaggatcacactcatgtccagaaagtgaaacataaaacagctaaacatgtaccacacagctttcatacaaaaattttatatacacaaattttgaaaaaatagagatggggttttgcttgttgtcccggctggtttcgaactcctgaactcaagtgatctgcctgcctcagcttcccaaagtgatgcaattacaggcatgtgccaccatgcctggtgactttttttctgttttgagacggggtctcactctgtctcccaggctggagttcagtggcatgatcatagctcactgcagtctcgacctcctaggctcaagtgatcctcccacctcagcctcctgagtagtgggaccacaggtgtgcaccaccgtgtccagctaatttttgtagagatggggtctcatcatgctgcccaggctggtctcaaactccagggctcgagtgatccgccatccttggcctcccaaagtgctggattacagacctgagccaccacaccaggctgccccacacattgtaaagtttcgcttccctctaatgtcagattccaaagacagcagccttcatgagtcagaaagaaacatcggtcattttgaaatcaacatccaactgaagtgtagaaaggcctctggatttttgaaacggcaacaacagatgatgtaatacaaagacgcccccaccccactgctttcccactgcatgctttacatgacatggcacagcttccacgccagcagcttcaatcatgtaaagcgaatgcagtcccatcaagaccacagcattggctgagcagctactccatgctgggcaccgtcctgggcactggaagtacagcagagaacgaaaccaagaccacaccctccagaagcctgcattccagcaggacagacagacttccatacacagagcaggaaaatgcacagcgtgtcagatgatgatgattactatgagaaaaataaagcaggcaaagagaacaggactatttggatgagggtggtgcaaattcaaataatcagacagcctttgctgggaaggtgatatctgagcaaagattcgagaaggtggggagagccccggagccttccccgcagagcagaggaggcccgggaagctctggactcatagcggttcagcacggccacgacacggccacttccagacagagcccctggctgctgggtagggaccgcagcacctcagagaaccctttctggggtcacttctggcaccctctgcaaacctcaagggggagcgtgaggctgggggctgtccatcagggtccaggcacctcctgaaggaacctctcaaagccagccgatcaccggctccagacccacgctgtcagacatctctgtggccaccagaccactgccactctcacgggtgtgatgacatgggacctgcctactggtagtcttctgccttcgtggaattctgcaacttccttcctgcctcggccacagcatgtcagccaagcacctgtcagggtccctccctggcaggacgatgtttagaagctcaacaccttgctcctgcctcctcttcagacccatcagaacttgctaccatgggtgtgttttaataaataacttcatttctgcagcaaataaataaataaataaatgtagttgcaatattgcctttaaaagcacttttaagcatcaattgtgaaataaaaagcccgagcaaaagccctctttg

SEQ ID NO: 5147 - DNA, 10721 bp, Homo sapiens
ctaggtttcttcactggcatttccagttgcagtctttgagtagtagtttatctagaagggctgcggaatgcctcctgtggattctgtaccatgttaggtcctaaatgcagacgcagcccttggtaggggcagggactggtgcgctgctcggagggggtcccaaggaccgaggcgggaatactagctccaggattagggaagggccaggaggaatggaagtactttatagtcggtgggagctgccttgtgtccttgcctgtaaccctgacatcctagatatgggaaggatgaaatgagataaccaggacctggcgcttagtaggccctcaccaggtgccaggcacagaagctcagtggcaggcgtgtgccaagtttggggcagccagtggtcagcagcccagctgccccgtggcaccagggaagaggggaagggccctgccgtggagtaggcagagcagggcctggaggggccctgggccaggggcctcaggctgaagcgagcatggccgagtgaagtgcatggcctctcactggagggcagaggctggaacactggacagggaagtccccaccaggccaaggatggcttgaacagctacggagtaggcggctcaggtcaaggatctggccacggcccagagtccaggcactggacacttgggtctctgttgtgtcccaatgcttcctgggccttggtttccccatcttgacacggggcgttggtgcttacctctcaggcattgccatggggtaggaagggggtgtgaagcgcctgtgctgggcttgcaggtagtaggtgctcagcccctcggaacggacgctgctgttgtacacagagaaacagagccaggaccccaggccaggcctcctcttgctgtggcctccctgagatgggacttgggacaaaaggtggtcgggactgccatgccctgccctttccaagcccacctttgtagggggcagccagggctcactccagtggcccatgaaggctttagccctggagctgcccagctagcccttcaggctctgggccactttgctggcctcacatcccagctcaccttcctgctctgcagcctcagagatgcccttccctttctgagccttgccaggtaaaatgcagccctctctggtcctcgtgacgaccacctaaggtgctgggtgcaaatccccagcacacagtaggtgctctatgaacggtcacacttgcctttaccccacagtctccaagcacagcagtgagctgcgattctcacctgtggtgggcgttggccccttttaagccatttactctggggccaattataaatagacacataatcgcccctatctatagagataagacatactcttcagatgagcccgcccctcccctgcccccctccacgctggcacgcgctctccgcagttgaaggcgaggggggatcgggtgctcccctccctcctccatccatccatccctcctccccgctgctcctccatctccaccctgcagaggtgagatcggcaggggccgtgatgtcagaggctcagctgatgtcaccgccccggccctgtgacttcacttgccggcttgggcaggaggagccgcgaggaggctgagagccgagaaactgcccccctttccttttccttctccttttttccctttcccctcctcccccgcctcggctcaggagttgttttcctcccccgtggtcgccgggctggcaaggggtctggggcaagggccagggaaggatgcggctgcaaaggtaacggtgtgcgcggtgcctctcccgcggtcgtgaaagtttgctctggcgtgcgaggcgtgcccgccgggtgctccgccgcgccgcgctgccctggcccgaggctccccgggggcgggcaggggccgcgccgggccagggcagggctgggcaggggcctcccgggcggcctttactgccttgtccccatcaaaggccgcagctgctcgagtggcggctgtagctttgaaactgccataaagagcgatggagggcggggaggcgggggatgttcagagcagtgcccaggagggtggccgggagaggaggggcccgagggggctgctcggggagcgcggcagcagcaggggcgtgaagggcagggccccgggtcacagtcccaggggccgagtgcccgcccccgtcccctccggtccagatccagccgcgcccccgtcccctccggtccagatccagccgccgtgcgcagccagcccgggtgtgagggtgcagagcggcggggggttggggctggctgctccctctccccccctccactatttccaggcatgttcttccacctccagcaggccatttgtcagtggtgatgcgggacaaaggaggggcagtgggtggtctgctgcgagttgggcgatgggcacggagcgagggccgagagaaacgccaacaatgaagaggcagatcgagggctttgctcattcaggctgtcgagggagccgtcattttgtgttagcgtgtgtgtgtctgaggtgggaggaggaagagagcggagaatgacaggagaaggattatgacattgtgttgtctctgtttgtggtaaatgcaaatttggcaccagtggtttcccgggaaaaggagcagcaagtaacccaggccgaggccctggcccagacccacggagggagcccgtgctgggcggcgtggggctttatttggccctccctttttttctatctggcgtgtgcttcttgcatttattttacagtgaagagctggagacagacaggccggcgaggcaggaggagccggccccctcctcccaggcatggcagcccctcctcagctcaccccggaggaggcctgggcagctctcccaacccccaggcgctgtcccagctctccggcctccctcccaggtctctgcccccagccagggtcaccgttccatcattctcttagcctgggcagcctgaggtctctgaaggctacttctgcccgcagctgcttcccaagcgtgaccagagaccgagaacctgggaccgaggctgggatggggctttgcagaacgaaggccagggctgggcgctcccccggctacagtgctggcctggctggcctggaggttggcaaacagctctgcagccaggggctgttagcacagcctcctggaccttgactcctctgacgggcccatgagggcaagggagcttgagcctgccctgggccaggaagcggccatggtacaagtctctgggctgccacagggctcaggcaggtgcagtgacatgggcgcaggtggtcagtgtgtttacagcaggcctccagagagggcatggtggagtgagttttaccagggccaggccgtagctcaggccctagcagagactgtgagttctaagctgagaagccagggcaggaaccatctacaggcagaaggtcaggggaaggctgtggctctccttccagtctcccttcccctggagctggtccctaacctgacgtcaccacctcctcttttctggtcaagtcttctggtctcaattcacttcctccaggaagccttccctgtccttctctcaggtggacttgggtcctgtgcctggcccaccttctttgccctctcacagtcctgaccacacagacgtgggtctgtctccctgttaggcctttgggtgcagagcctgggtgaccatccttggttacagggacacttaaggcctcccctctgcactcctggcacctgcccagagctgggcatagaggagccctgttcctagagctcagaggaacacacccagactcagaccccccaggaagtgggaccaccaggatggaacagctgccctctccccatgtcctagacggtgtgatgggctcacttcctttgggcaaactcaccccaaggggttttttccccacagaaatcttttccctgagtacccctgtgaggtctgacagggaaatcaagagaggcttcacagaggaggtggcatttgaaggccttgaagagtgagtaggagtttgccgtgctaaggcaggagagggtgtaccatcagagggaagtgcaagaacagcgcatccaaggtgtaagaggcgggttgcactctgtggctgaagccgttggaagggaagagtggggagaggcggcgacagtggaagtggggcccttgtttcactggctgggggagccacttgtggaggaagggagaacctgacctgatgacagactgggcggtgccacatggacaccgcagtcattgcaaactcgccttctttggacccgttttcaggatcttgcaaagctggcttgttctagctgctcccaagccagcctctctcaggctgccttgtgctgggattcccagatggcctcagatttgaatttaaagaccagcttgggtcttcttttaatttggagtctcaggaccagcccaggccacattctgagctggaaccaaattggcgggaagcagtttggatgccgatcaaggggtgaagggttcaggagcagctcctccagcctgggaccccgagatgactggaggctcctgtgggagactggggtggctagtcccccagacctatccccaacggagatggcagcacagaggggtggccaacgtcctgaggccagactgcctgggttcaatcctggctctcccatttcctagctgtgtggcttcaaggaagttacctgccctctgtgagtctttgtgttcttgggtaataataatacctacatcacagggctgaggtgaggattacatgagatcattctcacaaagcagtcagccagagcctggctcccagggggcactgaataattgttagcttaaaaaaagataactccagagagcaaaggctctagcacctagtgtctggggtctaatcactcaatccatctgagcctcagtttccctagttgtaaaatggagatggtcatcgtgtctggtaataatagccaagactgaggagcactgactgcgagatttgcaggctgtgttctagttgcctaactatgtattagcttaatagtctctccccaccctgagccacatgtaggggcagagcaggggccagggcagcctagaaactaaaagtgtgcagggaaaagccccagagatttggtagtttctgggtgaagctaaaccagtccccttgcttagcaaaggcaagaacagagggaagtggatggctggagtgtgaggcatggagaccacaaaggcccacccaccactgtaaatgagctgcctggggctggacgcccctcatacgtggcggagtcacctacacaccgtggggccttgagcgagttgtgaccaccatcctggacttcgatttccctagctgtgtgaggcggacttgggtctgttcacctctcaggcccgccactgctctaaggggctgtgattctcttgttgctttggttttcttggaaggtttccatgtaggtagtgacttgggcggtatcatctgcccattgatttttccagaaaggatgctttcttccctcccattctgcactcagcccacagatgagtgacctcttgcctagctttcccatttctcctcctgtccctgctagtaactcacctggtctaggctcagggaccgagagggcccagcccagtagcagctccccagaggcccccagagggcacaagagccccatagacaacacaccccatcacctgtgaggagcacctggggtggtgtctacggggctggggagccacatccagcccacacatggctttgtgagcccgattgccacggaggcccccagtggctcattcactctccctcctcccctcagcagaagctttgggatccaacaggtgtggcttcctccttgctccgctgtgtctgctgggtgactgtaggcaccacacctccctgagcctgtttgctcatggggtgaatcgtcccacctcacggagcacctgaggctggaatgatggcaacagcacttgtggcactgagaagcgcagtcactgtgtgcctgcagccctcactcgggggtgatgttaatgtccctgttctacgggtgaaaaggctgaggcttcaggagcttagggagcttgccgaaggtcacattgccctctgtccttccttattttattttatttattgagagggagtcgctctgttgcccagactggagtgcagtggcgcaatctctgctcactgcaacctctgcctcccaggttcaagtgattctccagcctcagccttccaagtagctgggattacaggcacctgccaccagagatagggtttcaccatgttggccaggctggtttcgaactcctgacctcaggtgatccgcccgcctcagcctcccaaagtgctgggactacaggtatgagccactgcacctggcccttcctttctttttcacacccacctactaccaagaaggcacagaggcagatgatgatgctgggagtccatctgaggcaggacgggtaaaggaagcctagagagccctaggggaggaggctggggagacacaaaacttgtgaagaagtggttaccatgcatgtctgtcatcatttgcccacagagggatatactgataatgggaataatggtcgtcaggtgggcaggggaaggggtaccctgcaccatcatgtctgctgaggaagatacagtcgtggttccctcttcccaagatgtttctgctcacctttgctcaggacatggggttgcttaagggcaatgtgtgggttcagatccggcctctgcactcacctgccgtgtgatctcaggctaattatttattgctctgagccttagcgtccacgcctgtacatggggatggtcatcgtattcacagtgttgtgaggatgttacgagtggacgcaggtaatgcacttagcaccatgcctagctggcgggagagctctaggaatgttctctgttgtcggcctcttgaatcagccttgcctctcctcagcattccctcagcacctgctgtaagtcagcgccaaacccaggcagcctcctcctgtgccctgggctaagccgccagcctccaggcctgggagctgagcgtctggatctgccgcgcagggggaacagcctctgagagttggtgtgttggctcccactgctggcgtgacagacatcctgaggaaatatgtcactttacaatagttttcaaagaaatttctagaaagctcttttaaccctacgggggccattcatagcctggacttccgttaggtcctagtctcagttttttcttgatttgctgaggtcccgccctctcccgggcctcagtttcctcatctgtaaagcagtaactacccagctcagagggctgcccgtgtgagatgaaactgctcctgtgaaacatgctttgtaaccttgagagcactttacagagctttcggttctgtttctggtcattcaccagacggccgcaggcagatgcctgggcagggtcatactgtgtgcccaggctgggtgtgcacagcagtgggatgccagcttggctctcaagggctccctgagtcgtggcctcactaaaacccttgaactttgtaatttctagagaatgtggaaggctttacaggcagccctgctccttcgcagggaaatgctgataagcgtcttgtcctggtcactggttcaacccacgtatgtttttggagcagctccttgtgctgggcactggcctggctgatgaggatgaagctgaagaccagaggtcagccttgcctttgagagcttggcctaggaagagggatatggaaactcacatccaaaaccctgatgactgaggttcagggtgacgtgacacagggcctgcacttctcagaagaggctcagccacagggcaggatcgcgtctaaatacatactggcttgtgtcctgtgctcagaatccttcatcatctcctctttttgcccagggataaagtcgcaaagcctctgtggcctgtactgtcctgctccagctgcatctccagctttctcatttcacttacattaccctgcaggcccctgtgcccttcctggaaatctacttgttccctcctaccgcagggcctttgcccatgccgtgccctctgcctggagctctcctccaacttcaccatgtggttacttcctacttgtctttcaggcctcagctcaaatgtcctagatccccaaggctcagggtccctattgtacatctgctgtgctcctgccacactttcttactaatttgtatcatggctgttatcagatgattatttatgtgatgattctttttctaacagctccatggcaccataaacttcatgaccacagggacccttgggatcaatgcttgtcataagggctcagtcaatgtttgttgaatgaatgaataagtgttaagagtttgtggaggaggtggcatttgagtaagacttgaaagaggatataatttcaatctgtagggaagagggaacggcattcctgctgcagggagcagacaggcacaggacaggaagccaacttgtctagttagacagagaggcagaatgagacctgggagagaaggtttggagaagcaagcggagccagatagagcattgtattccaggctgataggaataaacttgaatggtgaagccgctcaggacccactgacagacttctgagccagggggagcaaagttaaaaccggctttggataactgtaatgaatccgccacagggatgggtgggcagggaaaagtggctccagtcgaggaccagttaagagttggagaattcacggctcctgctgctttctgctcccctggaatcaaacgtgattttgcaattatccccgagagctcgcagggagatgcagggcagtgatgaggaacctcacacggcgtggctgcttccagaagacaatcgccttggcatcagggcagctatccccgagtcactagagggagagacggagttgattaagcatcggcatctgcgtttcttggcttctcctattgagaaggcagcatccagctctgcatccctgcacctgtgtcctggtgccttctattaataagtggcccaggaatcttgacgctgaaggaccaacctgtggcagaagatgagcagaaacatttctgtcaaatgcccagcaaacaagactccacgcctccgtggggagccagcacataagagtcaggactcttgaggacctgaggacaaatcccagcaccaccacttagcagctgtgcaccttcgagcatcttctaagtgactctgggcctccatttcttcacttgtgaaaatggaggctgccctggtgttgtgaaggttaaggttaagtgacatatatggatccccaagcacagggaacactggaggctcaggaagtagtggccgttatcatggctgcgtttttctccatggtttgaattcttagcaggaagcttcggtttcaggcttaaaaatgaagagcatgtcaacaaaacaggatggaacaaagtcttttcccagcatgcctcagcatgtggcactgccttcccgtggagcccagacaatgatgtggctaaaagtcttgagctttcaggcagaaataatcccaaaggaaaggaacttccttattgtcatcttataacaaagcaacgcaggggccctgtagcctgtcagattcagctctgccccctccgagctgctctgtgcctcagtttcctcatctgcaaaatgaggcgagaacagtacccactttatagggttgttgtaaggattaagcaagttactgcaggaaaagcgcttagagcatgcctttgtcactgcgactcttagatcatttcatattcaggttaactctttgtagtgccctgagtgactctgtgggggctttggagccagaagactgagttcaaatcacagcctcttcctagctgtgtgacctgggcaagtctcttaacctctgtgtgcacccatttcctgctctgtacaatgaagatgacaatccctgcctcatgggtttgttgtgaggagtgaatgggatcactcaggtaagggcgccgactcccctgaggcaggcagctcacctggcccctcccagcccaatttacagctgaagaaattggatgatttaaagacacacactggtgagaccaggctggcgccagctcagtgactggcccgatgagagtccagccactggggacagtgagtgccgggcaggtgggggtgatctgtgcgctcaggttgcacgggcttcccgtttcttggcctatcctcaggtgttagctctctgctcacctgtggggaagatgtgtaagtcgattcacagcagctgctgcttgttgggcagaccgtggtcttccaggcatggggtccgagagtctgaggccccccgacctgcccgagctgcccagtgtccagggcttaatatatgactgctggaggggctggcgctgcccatgccgtcctcttacattctttccctatcggcctgcagacttttggtcctactgactgtctaggtccatctctgtctttccagtgtttgctgagtgctgggaagcttggtggttaagagtgcagcctctgaaaacctgggttcaaataccagctcagcctcttccaaactgtgtgacttgggataagttaaactctttgcacctcagtggccccatctgtaaaataggggtgataacagtaccaaactcattagactgctgcaaataagaagaactgggatgataaagggaaatctgcatagtgcctggttcatagtaagcctggattcctctgggctgta

SEQ ID NO: 5148 - DNA, 2553 bp, Homo sapiens
tcgcgcgcgccgccgccccgcgctgctgaagctggcgtcgctgccgccctcgtgccacgcaccgccgcacgcgctggagcaggaggagacgccgctgtgacgccgccggcgggaagggtccgcgcgccatggctggccgctcgcgccctttcccaccgctgccgggaaaccgaggctcgccccaaacggatttgcgtgaaaccagcccaaggttccgggcccccccaaccgagccccgcgcccggggactgactcggggaccgactcagggacctcccgagcgccaggactcagggcccgacctgcagcggctgcaggcccagcgcccgcaagcggcctgggccgagcgccgtttccaggccctcgccaggtctttgaactgcaggtaaagtggcaggaacgtcttccgtctgctcagcgtttggggatttagactcctaaagccagtacctgccccgtttcccccccaggttccgtcctgcccgcgcccggtctcagggtggcggccccggacacggcccgtccccacagacgaggtctccggcctgagctgtcgcacctggcgcggaggtcgcccggggtgccctggctgggtgagaggtggcctggcgggcggagcttgccaagaatcacggccagtccttaagtggatggtggggcccagcagctgctctgtcccccttaacaaaccagggggcatggaggggcccagggcaccgcccccctaccaggctcaggccctccaaggagaacctgctgagacccctgagcctgtcctagaccccggacccctgacccttcccaccccttccagcgtcccagggcgaggccttggacagagctcctggtcctctgcagggagaccatccagcccaagctctgggaggcacagtccattgagtgggcggaggccgcgggtgctgagccggggagggtgctcggagtccatccatccctcagacggcaagtcccacagggtccaacccacctgaaacctgcctgcacggtggaagtggtggaggtggacactcctaggggcttttctaaagctagactcgcagctccttgctcaggaaaattaaactattcacgtttcagatcaagtgttgacagtcaccagtcaggaggagttcttaaagagttttatgttgactgaatattgcacattgagtccccattgagtccctggtgggaaaagtccacaatttcccattgatagctttttactgttgtgaaaaagggaagcgtcagccacacaaaagcctgcatgaccgctgcttcggagaagctctcgaccctaactgcagtcactgttacttggatcagatcaagcgcagtgactttttgggattcagtggttattctccacacttcgtagccatttcaaccaactctgagcacaaaatgcagccatcctctatgcagcaagccctgcccagtcagtgaccctactggacagatccaaggccagccctggttccctgctgcagccaccgtcctgacgttcatcggagcaggccggggcctggccttcccggcacaagtggctgttctgacaggcccccagtttgtcccatctgaactgctgggaggtttccgggtggccagaggagcaaagctgccttccaagtgcctgtctgtgcctgggagaacagagcaggagcgtcgtgcggtccaccgcgcaatgcatggcgattccaggcgctgaacaactcccctggacccttgggcctgcatctgactcccagctgcagagtcagaagctgagtccaggcaactgcttggccactcccgatcgctcctccctggacacccggttaccaaagtcagcaaagaagatgcggtaatcgccgcctgatctccacatggtgaacacaacactcccaccaacacctccttgactggtcggtcttcagcaccgggggtgggcaggcaggtgttctgtgttgacgagaattgcacaggctaaacacaaacacggaaccagagtgagaacacctcactcacggcagcccaggctgctccctaccaggtgacggagcgcgccggggctgtgggtgccaggggctgagtgctagggactcgtcatgagtggggatccccacgttcctgtcactgctgtcaaacagaaggtaaacagtcttatgaatgtatttccttaggaaaacttgtaaaaacttttattaggatatctatttaatactgaactttggcctactttgtgatagactataaacaaattgaggaaatcactatttctcacttctgtattttctcaaaaataattttgttacagagttcaatatactgtgtaccattgatcttctattgtgaaagcaaagaatttcatcaaaatattttaaattatgagtgaaaattgtgtatgttaattttgcagctataatattaatcaaatttcgtgtaattctaatcacaaaatgacgtgccttaagtgcccctccagctgtgggttggcagtgtccagacagggagggcccatcaccgaaatcctgaacgattactagaccaattctattaaaaacatttcaaggc

SEQ ID NO: 5149 - DNA, 2017 bp, Homo sapiens
aattctaatagcataaagcatttttttttcccctgggatgttatcgtccctaagttttacatgttttaaactaagctgtaaatttagcttgaacaattttaataacatttccaaagatgtatcttaaaaaggaatttaaaagaaatactgagcttttgaagtcaaacacaaccccctttcttacaaaagcagtcaacttactttaactgaacatttctttgtcctgaagttagaaataacttcagcaaaaatttctccacagggttgatattttaatgatgggaaccttaggttaatatgttcattttatactagtcgtttatagtcatttgtgaatggaatggtgattgacaaatacatttgctttaatgtggagctggactataatatatatggatcaacttcaggtgttcatgtctgtctgttctccatgtcgagtacgattgtaccttctcttccctcctgcactgctttttgtcgtggatgaccaggctgtgagttcttccagatcaaagatcatatcatgttgtgtctgtagccccagcatgtagagcaatgctaggcagcagtatgtggttaataaatgttggttgaatgaatacatgattgactgaatgcatgtatgtctaacagtgtttgcaactgacagcctttttgaaaaaattattttgaatagttataagttcacaggaattccccctcccattcctcagacacaggagattccttgtctcctccctaccagttttccccactggtagcatcttacatgacgtaatacagtgccaaaactaagaaattgacattggtataatccacagatcttcttcaggatcactgactttacatgcactcatttgtgtgtcctttgtatcagttctaggcagttttatcacatgtattgatttgcatggctaccaccagaatcaagataacagatcttgtgtatgtggggttccatgcccacaaggcttcctgtgctactgttttgtagctaaccctgacccctcataacaggattttaatcatcctgaccttgtgctttacattagcttctgcattaactatggcatgaagaactataagatgtttctgttattaagagacagcagcagtgattttatctgtattcattgcccagtccacagatcatccctcatccatgatcagtttacacattttctgtttaaaaaaattatcttaaagttggctttcctagagtaatgaattgtcaacattatcataatgggagtccactcctattaatcagaacttagagaccacatgttgtgttcattatccagaaaatgtatcaagttgcaaaacttaagtagaatgctaaaaattgggatccacagtattaatgagctaaaaattgacaagtgcatcttagaaaatgcttctgtgagcaaaaaaaatttgcaggctcatacgcaatgaattggagtgttcaacacggtttaattggcggctgtggatgtcttgtgcataattgaggttgtaaagatggatgcatgtggtaggcatggggggtctaaatgggtgagtgtgtattgtaagggaatccgtcccttccgacatactgcaggctgggttgcagatacagtgatccatgtttatgtaagcaaggtggaaacttctgatctagaagggaaaaaacaggtgcttttgtatgtttttctttcaggaaatagttcacattttccagaaagaaaagtttttttttttttttttttggagacggagtcttgctctgttgccttggctggagtgcaatggcgtgatctcggctcactgcaacctccgcctcccaggttcaagcagttctctgcctcagcctcccgaatagctgagattacaggcgcccaccaccatgcctggctaatttttttattttcagtagagacggggtttcaccatcttggccaggctggtcttgaactcctgacctcgtgatccacctgcctcggcctcccaaagtgctgggattacaggcgtgagccacggctcctggccc

SEQ ID NO: 5150 - DNA, 27259 bp, Homo sapiens
gcatttctctaatcgagctgtaacacttgctgctgcggtccatggctccattccttgaagcccacgagaccaggaacccttggattgagaaaaaaccttcaattgggaggatacttcttatctcatttctaggggcccatccgggatttctccacagcactcaagctgagctttcactctctgtccaccactgctgtttgccactgccgcagacacgcgctgacttccatcccttcggatccggcagggtgtcctctgtgctcctgatccagtgaggtgcccattgctgctcccgatccgactaaaggcttgccattgttcctgcatggctaagtgcccaggttcgttctaatcgagctgaacactagtcactgggttccacggttctcttccatgacccacggcttctaatagagctaacagagctgtaacactcaccgcatggcccaagattccattcctttgaatccgtgaggccaggaaccccaggtcagctaccaccaggctagccaccatcttggaaacagcttgcggccattttggaagcgtcccattaccgtcttggtagctctgggagcaaggacccccagtaacatgaggactcacacagactagtgaggggagccagtggcaaactgtaagatgtgccactgagatcccccttcaagttcagttcttcagagtctgcttcagctgcgtgaagtgcttttaccctaagtctccccatcttcttcagaccagccggcatacagcaactgagcaggagccacagagccatcaaagatcttctattatctatatgctgcgtcctagatgatgaaacacaattctcaggaagtattggctccaaactggcattttagctgtgcaggccttttcagcactctctcacactgacagcttctgggtgggtcagtacgtcatctcatggtcataggcccacttactcttctcctttaccataaactaagtcttggtctaatggaataataatgtgttttgatgccagtggaaccaaaactctgcaagtccacagatagtaatgtttactgttgctttacaggtaagaatggtacccccctactaagaaagtgtgtatggcaggtaaacactgagcacacatggatataaacacagggataatagacactgcagactactagggaaaggatggaaggagagagacatgggagaaaaactacctattgggtgctatgctcactacgtgggtctaatacactatgtaacaattctacacatgtacccccgtatctaaaataaaagctgtttttttaaaagaaaaattgctgtaaataatggaaagaaaatgacagggctaatattttgggaatcttagaaaagaattatattcaaattacataagaagaaagacagagtcgggtgcggtggctcacgcctgtaatcctagcactttaggaggccgaggcagacggatcacgaggtcaggagctcgagaccatcctggctaacaaggtgaaaccccgtctctactaaaaatacaaaaaaaaaattatccgggtatggtggcgggcgcctgtagttccagctactcgaaaggctgaggctggagaatggcatgaacctgggaggcggagcttgcagtgagccgggaccgtgccactgcactccagccttggcgacagagtgagactccgtctcaaaaaaaagaaaaaaaaaaagaagaaagacaggagttattatcttagtctgttttgtacttctacaaaaaaaatacctgaaattgggtaattgataaagaatagattttttttttttctcacagttctgggggctgagaagtttaagttcaaggcaccagccagtttgatgtctagtaaggaccccatctctgcttctaagatgtaacctccagaggaaagaaacactgttctccacatggcagaacagtggagctaaaactcatttcttaatgtccttttcaaaagtatttgatctacccatgtgggcagatccctcctggcctaatcgcctcataaaggcccacttctcaatatcattacactgatgattaaatttcagcgttaagttttgagataaatattcaaaccatggcagttgtctatttgaattttaccttcaaaaactccgttcacttatattatcatgtggaacaccatacttctttgagtttgcttcttcctttctctctctctccctctctggatatgccttctcagtgtctcttcattcaatttattctgtctgttctttacatgtgtctattattgagagatcaatgacagttcaagttgcttcttatttttaatgcttttgtatctcattttcatgcctttaattattattgatggactgataatttccaggtctcttctgccagctcagatatcactaatcacagctggatttatatatacactgcttatgagacatcattcaaatcatgctgctcaaaagatgacccaagatctttttattcttaactggggtgtgtgtgtgtgtgtgtgtgtgtgtgtgtgtacatctttctatacacgacactactatagttcacccacaccctaagtcagagacaagttcattgacattgtcacaggccacagccaatcatgtcacagcaactcttagtgaaattgtacacttttgaggctgctagcccagaatgtgaagccagaatcatgctgtttttaagtaactacgtgatcttgggcaatttgtgcaattattctatcccttaattcccacatctgccaaattgaaattaaagtagaactcaacacaaaggtttttgtgtgggtaaaatacattgagatatacacagcgccttactatataaacactgtatgtgtcagctactgttgtgttaagagtattatgattgataacatctactaaatctctctctcgccttactgctatttctctaattcagaattctattattttgcaagtatcactgaaaaagctaacttctctcttcagtgttgctgtttcataatcctttctatatattacagtgattttactaaaatgggaatagaattaagttgcttctttaaataaaattctttaataagattatataatatattttattatatgatcattcttgttcctcctgactaaccaccttattagggattttctggttattttatctttctacataaaatttggatttgacttgacagtgattgcggaaaacatatttctattttgccattattttattacatttatagattaatatggactgaattgtcatcattatgatgttgtgtttttattccaagacattacatgcttatatatttgataacaacttactttaagttctccaatagtatacaatttttccccttaaaaatcatgcacattgattatgaggtctgtttcaagttttttgctttgcaaaatagggtgttttctaattatataatgtatatgttatgaactatttatttttattttgtattcacctaccttaatcatttgccatcatgtttagagtcatttttttcagtcttggctcctgtatactgaaagtgttgaatcgtatcatctgtaaatgatgacagttttgcctctttatttcttatgccttgtcaaatcttaatagctagatacaagaatatttgcttctagctatagcagatgaacttgaatatagccatccgtcttgctagactaattagtaaggctggataaaatatgaaagataaagtgttagagggcacctgagatctctaccaagcagcagagacttgaggaggcaagactccagaaagaagggaagcacataaacataaattagatgttctgttcagatttttgctatgacacatttgccagttgaaagaggcagaaggaggcatctaaaaatcttgaaagtcaaactgtctatgcaacaacattttggacctggtgtgctaaaaaatgaattcacatcagattgaagaaaagcacagggagatgtgaatgatatgggctgctgaataagatgtgtcttcaacacaatctcctattagggcaaaattcaaataaaagaaatatattgagattatatagaattttgatgctgactggccatgaattccagaggacacaataaaaaaattttctgagtgagaggaattggaagataaggctatctggatagctgtatcaggacagacatggctgagaacaaataattgtctgtaatagaacatgcaaattcttccttagaatgtagtaaagggactcctttattcatatgtgctcctgccacaactctgaatgcatagattcttttgacttgacataaatgccacagatttgtttttattttaatgaagtccaataacaggagatccaccaataacctggaggtagcaggtagctattgaaaggaagtttatgaaattattagaaaatgatttattgaaactttctattacccatctcctagcattcaatatctgccctcattaaactctactagtaaatttaataatcaccttttgcacaatcaaatttttattattttggttgttaagtgggacataacaccatggtcccaaattttctatattttaaaatgcattttcttcatttatacttcataccattctaccaattttcctaactggttgaattcattgctttgatttctgattaatttctcatattgtataatccttgagagaaaatacgtccttcacactcaaattgtttgtttccagtgccatatagttaaacctttcttttattcggcatgtatttcaaccttccttgtctctccattaaccactgtcctttcttcccttcacaattggtaaatgttttattttgcaaagaggataggctaattaatttactaaatataatagttttatgtaggaaaatacactgaaattaggaatatgtattcaaaatgacatataacaaacccatttttttccttatcaatgttatcacccaacaatgtggaacaaaatgatgttactcaaagacttcccatttgtcatgttgcttaaagtcatagattccaagaacttaacaacatcgtcaagcaaggacttactgtacttaatatacaaatagtttttttaataccaaaatgtctccttcctttgctgaatgctgattgcatacattaaatctccagttcctcgatgaatgcatattcttttaaaaaacaagctgtcataacctattataagagcatagcaaattagcaatatacgtttacctcctttgtgatagataagtgaagcaagttttgaaaccaagttaataattctgaataaatccacaattttttttaaaatgctgaaattttgtgtaatatttttcaaaggtctttagtgtaacaaattagtgagatgaaatggtaaaatgtgccaattcgcttcctaccatagttcacttatatatcacttgcattttaatccttatagattttaatccttatagatttctgagaagaccattatccttaacaaactaacacaagaacagaaaatcaaataccacatgttctcatttataagtgggtgctaaatgatgagaacatatagacacatagaggggaacaacacacacagaggcctttcagaggatggagggtggaaggagggagaggatcaggaaaaaataactaatggatactaggcttaatacctgggtgataaaataatctgtacaacaaacctccatgacacaagtttacctgtgtaacaaacctacacttgtacccctgaacttaaaataaaagttaaaaaaaggaaaataaatttaaaaagaatattatgtggtctgaacacttatttctgttaatcaaatttctttgtaatcatataattatttagtaccacccacttgtacaacatttattgcatacatcagtgtttataatcatttctaacaaataaacttttttattaaacattgggtagaattttatatgtatgattataatttaatatactgcatcatatatacatacgtaagatgcaatatatcaagttgatataagcagagcttatctgcctgaattcattgtggagatcatggtatcctagatcctcaacttccaatgatatctgtttactcttcattagccaccactgtaaaagaaacaagatttattaaccacttgatggctttctattctagaatatagtgactgcattatcgaaatgcatatggcatgtcatttgggagaataacctggtatagaagacagtgtccaatactcagatcaaaagaaatgaatttgcttcctgattgtgtcaaaaatcagtggtaatctgttagcaattcacttaaactcttttaaggcttaatgtagtcatacaactatgaatgcattatcaagcggagttcacatcattttcagaattgttgttatattattttatgaacctctgtgttttgattatatagttggtagctagctgctgcactaaactgtgagaaagaaaatgacacctaacatcctgaactaggtaaggttatgtgttactacaagctgacttgatgctcccagctagagaacactgttctcctggtgaacataaacaatctcacagagcataacaacatcaggtcacgttgaagggatgataaagtgagataaaacaaggtcaccatgtaccccatgaagtactcgaacatcctcctctctctgctaaaatgaattatggctgcttctttacctagtctatccttcctgtagataagatttgttgaggttctcaattatgaacttgtctgtcttcctgacagcatccaatcatgatcaaagcctgaatccttggaccctcccctgaattaccggaccaaagctcaaatcctgtaataggtctttctcttactgagagaggcactatggctttctttgctgtgtgttttcctttcatgcaaagagtcataaattcaacttgttcaactatcactgtgttcttggtggcctttgtctggagatatttgacaactgaaatttgttcaatttaagtaatgctgatgctttgcaatgaatgctatttgaaatctgtattagcagttatataacttctgctctagcactctatgtatttacttctaaaattaataaaattctgacatgtttataatattctatacttacatgtgtttctccttcaagattttaatttgttatgtttcatggtagtatttgttttagtaatgtacttatgtgatagttattatatgttttaaatcatatctcagttgagtttttcatccataggccacattaatcattttaataagccatgcaggttatatcaattcattttaataaataatgtgatttaatagtttaccttattagtataaacctaactctattgatcttgaaatgcctaaaacatgatttttttgtcttttcttaaagttattaccaataataaatcatattgttttaattctgaaataagtatttggaaactatttcaattttgagacagtgaaatatgttatttttgtggttgcataattttattatacagaattaactgaccatattggatagtttcgatctaatatactccagtatgtcttttatgctaagtatttaaaatgatagaaaatatattttgctcacattgacagaattaaatttgagcaattttctctttctctttgtttaactgaagataattggtgcatctacaatagaggtcattgctgtatctttaacatttcatctataatccttatgaaaagattgcaatatttgccttccttaattaagtattcagttttgcaatttttaaatcacaccaataataagcattttttaggaagaatggagtagagattacagaattattagttttataagcaaagcatatgtgaggtaagtactatattaggtcatatttatttccttttgacctgaaaacttattgaatcttcctgaagttcttattttaggtaaaaatgggacaaaacaaaacaatgacaagcaaattctgttctaaaaagctttaaaactgatatcaaaattactcagctagtaacttacatgtttgagaatacaatattatacacccatgttcatagcagcatttttcataatgcaagatggtggaagtagccatgtgtccatccatggacgaatggaaaacaaaatgtgttataaatatataacagaatctttttcagacccaaaaagggaggaaattctgatacatgctacaacatagatgaactttatgtgcattatgctaagtaaactaagacagtcacaaaaagacatattgtataactccagttatagggggcacctagagttgtccaactcatagacatattaagtaaaatggtgaccaggtgctgagggaagggaggattagagagttattacttaatgagtatagagcttcaatttttcaagatgaaaagagttaggaaggtgatgttgatggttgtacaatagtgtgaatgtatttaatactacttgactgtacacctaaaaattgttcaaatggtaagttttatgttatatatgtattttaccaaaatttaaaacaaacaaacaacttctcacatatgtttatacaaataaagggataactcagccaagctatttaataactttgataaatctacacggttctacgcagaactactatctttagagattagaagaaaataaaaaaatatctctcacagtttgcaatccacctcgtcatagccaaaagcaaacttcctaaagggaaaaaagtctttatacaataattaagggtttgtttcagtcaagaagaagacagatccacgcttgtaaccttatgtgcttttcacattatttcagaacattttgttaaatgtaaaatgctgtaatattttaacaaaaaaaaatcaaaggaagttttttacaacattgtacaccttagaaagttcataaatattgtaattttctttatttcatataatagtgactactcatatggttatgaattttcactagaacgtttagcataagacattgttgcaaacattttcaaaatatatcttagaaacttggggggatgataaaaatttaagatgttaaggtgaaagggaatttaggtattatctttttcaaatatgctatagttacaggagtgtttgtcaactatagatgaaatattgtaagtcggtggaaagttttaaccttccttggtagttgtccattctgtctttggtcaagtccatttcctagaacattatttttttgtcctaaaatttaccaactagtcattagctacatatctaaattaaccaaaagggatatcaaaaaggagtgagaatacattttatatcccttgtttgcacataggtgttttataatttccctcttatcccttttggttagtcaatcccgtctatgtgttttagacattccaagacaattattgtgactcattttggctatgctttttcccttttcagtgtttttacatttgtcacatccttgatccaaaagattcaccctctcttcctatcccagctaacactcttcaaactctcttccacaacctattatttatttttatctttaccttttcataaattaatgtgttacaccataatcattctttatgaatacttgtcttgaccatttaattgaagataccttagttcagggacttgttatattcacctttgcagcctcacttctaagcagagtcagctgcctattaggtaatcaaagaccccactgaataaataaatcgggctagttctgccctctggaacttccaactattacatttactgaatctgaaatatcagttattattttctccttccttctttatctatttagtgtttaacaaatacctattgggtatctgctacatattgaacagatatacagcaaagacccagaaaaaatatgcctgtcacatggaaatttttgcagtcagttaagcatatcatgttctcttgattctaaagcactgttacgaaatttgatgcacttaataaacttaataatcacttatatatacaggcatatctcatttcattgtgctttgctttattgcactttgcagatagtacatttcttacaaattcaaggtttgtggcagccctggttccagcaaggtatcagcaccgtttttccagcagcatgaactcactttatgtgtttgtggcatatttttctagttctcacaacacttctaacatttaaattattattatatatgttatgattatttggactagtgatccatgacgttactattgcaattgtttttgtttttggggtaccacaaaccacagccatataaaatgatgaacttaatcaataaatgttgtgtgtgttctgactgctctaccaattggccattcctctagctcgctctctctccttaggcctccttattccctgagacacaacaataacaattcataattctctaagtgttcaagtgaaaagaagactcacacatctcacaaatcaaatcaaaagctagaaatgattgaagatgaagatatattgaaagccaagagagtctgaaagctaggcctttcacataagtgagccaagttgtaaatacaaaggaaaagttcttggaggaaattaaaattgttactccagtggaaatacaaatgataataaattaaatcagtcttaatgctgatataatttttttttgtggtctgaacagaatatcaaatgagctacaacatttcctgaagccaaaacctaatgtagaacaaagccctaaattttctcaattctttgaagactgacggaggtgaggaagctgcagaaaaaaattttgaagctagcagaggttggttcacaaggttttgggaaagaagccatcttaatgacataaaaatgtaacatgaagcagcaagggttgatgtagcagctgcaggaagctatctagaaaatccagctaatgtatgaaggcagctacactaaacactggattttcagtgtggatgaaacaagtttatattggaagaagatgccatttggatagtcatactgtattagtccattctcatgctgctataaagaaatacccaagtctgggtaatttatgaaggaaagagttttaattgactcacagttgtgcatagctcgggaagcctcaggaaacttacaatcatgacagaagacaaaggggaagcaaggcacctttttcacaaggtggcaggaagaagaagtgcagagtgaggggggaaaaagccccttataaaaccataaactcttctgagaactcactcactatcataagaacagcatggggaatcacacccatgatctaatcacctcccacgaggtccttccctcaacacgtggggattacaattcagattaaaatttaagatgaggtttgggtggggacacagagccagaccatatcacatacctagagaggaaaagtcatgcctggcttcaaagcttcaaaggcagtctgactctattgttaaagactaatgcagctggttggtgattttaagttgaagccaatgctcgtttcccattccaagaatcctagggcccttaagaattatgctaaatgtactttgcctgtgctctataaataaaacaacaaatcctggatgacatcatatctgtttacagcatgagttactgaatattttatacccactattaagacctacttctcagaacaaaatattctttgcaaaatattactgctcattaaaacaatgcacctgtcacccaagagctctgatggaaatgtacaagattaatgttttcatgcctgctaaaacaatatccattctgcagcccctagatcaaggattaattttgactttcaagtcttatgattttcagaaatatattttgtaaggctatagcttccatagacaatgattcttctgatgtatctgggtaaagtaaattgaaaaaaactctgtaatagagtcatcattctagataccattcagaatattcgtgatttatgggaggaggctaaaatatcaacattaataggagtttataagaagttgatttcaaaccccatggatgattttgaggaattaaaaacttcagtagaggaactaactgcagatatgatggaaatagcaagagaagtagaagtggagcctgaagatgaaaattgttgcaatctcatgataaactttaatgaatgagaagttgccttacacatgagcaaaaaaaaaaaaaagcaatgtattaagcaatgtattgagttggaacttactcctggtgaagatacttgtaatcttcaccaggaacctggtgaacgttcttgtaatgacaacaaaggacttagaatactatatattagttgattaaacagcagcagggtttgagaggattggctataatttcaaaagaatttctactataggtaaagtgctatcaaacaacattgaatgcaatagagaaatttttcttgaaaggaagagtcaaagaggcaaacctcatcatcttgttttgagaaattgccactgccatctcaaccttcaacaaccactaccctcatcagtcagcagacatcagtatgaagtcaagagcctccaccagcaaaaaatgtataactcgctgaaggctcagatgagagttattttaaattaagttatgtacattgcttttttagacataatgttattgcacactattgatggtaaggttaactaactgccattataacttaaagaaaatttgaggttaattttattctgagtgaagtttggggactaacagtcttgggaacatagacccagtgcaaaccaagagagtacccacagtggactacacaagacacagtatttataggttatattacatagaagataggagaagggggtagtgaaacaaaggtgatattcttacagttttgattggtgctcagtgatgcaagtatataagataagcaaatatgtggtgaatgtatacagggtaaacaaacatgcaggtgtcttagggtctggagatggatgattgattctatcctgactgtgcttgtctgataggcaaggttgtaatcagtacatgccagtgaaatatttgacagactccagccatacaggtgagagttcagctttagttcataggcctcgtttctattacccatatgtccaaactgcaaccatctcaggtcactttacacatttttctttcagattttctgtttcctgacaacactatatagacaatagtatagcgtaaacacagcttttatataaactgggaaatgaaaaaaattcatgttacttgctttattgcaatatttgcttactgtggttttctggaaccaaacttgcaatatctttgaggtttctctgtaaattgttcaaaaaaatacatcttttttccaaacactaaagtgaaaaaatataactttcttttatatttggggaagtgtatatttatatatatcatagtaaaaataatcaacatgattgatataagaaaagtatttgaacaagttcataaagttatttttacatgtaaattgaaagagaaatggttaataaagataaatcacatgtcatttaacttatatgtaccaaattacccaactaaaaattcatgtttacattaaatatatcactaagtatgaataaaaatgaaagtatactagaaagtgtccttgctactttctcatctgttggtataggtcagctaacatcagaatgataaacatatatgacaatttggagtctaggcatggagatataaaacagaagaggttattattatgctaggctataattattgtagtaattgtttttgctagaagcgttttttctcatcatgatggtgtttttgacaaagcaccagtaacaatggtccaattagttatacaaagtgtgaaaatgcatttgtgtggggaaatgtgatatagaaattgcatagattgctcaggaagatattaactgaattttgagatgtaatcatctggtgctcaaagtgttcagtgaagttgtcttacatgctctgaagcagagctatcacagaacactccaactattactttcaatttagaccatcagcttcggtccatttactgagtggttaaatcagagcaattgattcttctgaatctctgccagttatatccaatatagttcatccaggccatgtgcattcagctgagtgttatttttggacttccataagaactgttctatcatcaactgaacagacatagcttcagaaagaggttcatcatgtgaagagcggagattgcacacccaggtcacaagtgacctttcattaaattacagacaaaatcctattctaaaaaaggccattgaggtatgtgacacctcataacaaggttattttccattcctgtataacatcccacagaagcattatttgtggatgtgaataatgtattttcagtaataaacgtttcacaagtccctatccatttataactcacctatttaataattatctcattttctctatattgcacaagggtgccacaaaattaattataatctttgtatcttgtttaattatgatgataacccatggtatgttttatgaaagggttaaaagggggttacatatataaaatatgatctctaagaaaatttagattgtatgtatcatagtaattatttttttgtttagaactagatagtattggctacaaaaaaagtcattcttcaaaaagtacaaataagttattatttaaattttcattctaatgacagtttagtcagttgcacacacacacacgtaacatatatgcatttactgtatttatctatatgtaaatatattttttaaagagatgaaaaatagtaaacactaaagaaacatttattgcttactaactgttagtcattggacttaatattttatttttttttaatattttaatgctttattagtaaaattttgcatatattcaagagtgtggaaaacatatagatatagatatacatcttaattaataatttagtgaatgactatataaaaaccctcaactacttagattttgaatcccctgtcttgtactgcaatactactgtcaggagacaatgcttcatagttaatgtttctgaaacgtgaggactttgtgaagaaagattatacaaagtcatattaacctggtctagcaaaaatacaatatctgcatcataacaacagtggggctacttattagtaattttgtaatagtctactgttaatcctgctgttttttagaaatttgactagtaaattaagtggggtcatgaaccactattggatttttaaatctttaatactgacatgatttcctgccacaaccctgggattagagaattaaagatggtgctacccttctcaccagctcatcacacaccttttggtaaacagaatgttctctgggccctaccatgaaataaagttcattggcaggatttctggcctgacttagtagctctatgccatcattcccctttttagtttttagaattttgctgaacgttaacaaagaaaaaataatcttatgaattaaaagggggttttattatagatcctgcaactaataatagaattaatagaatagcaacaatatatatgtgcaactttatgtcagttatttttaaagcctacatgaatggaacacttgttgaaacataatttatcaatcctgacataagactatctgaatagtttttatcggcaaataacatatttctgttttaaattcagattatccaacaaagaaaattccaggaagaaacgggctaactggtaatttttcaaaatatttaggaatgaaatgatgagtcttacagattctttcagaatgcagagaaagagggtacacttttttattcattgtatgaggtaaagttaagcttgatactaacatctacaaaggatagtacaagaaagacaagtacaggccaatcgctataatgaaaatagatataaacattctatacaaaatagcagataagatctggttacatacaaatcaaataatgtgatttattttgtaaggcaaaattttctattgaatatcactataactagtcacattaacaagaaaatggaataaaaagaccatcatcatcttgtgggataaattttttaattttgataaaataattgaatattttatcaaataccataactagctatggataacaaatgtcagcaaaacataagtaaaagctattgcttgtgtaagaatatctaccaaaattaaacaactattatctcattcaatagtgaatattgaatgctttctttgtgatatcattatgaagaaaagcacaaccactatctcaacttgtataaatattatataagttcctagctggtataatagaaaaaaataggttaaagtttttgaagaaaaaaaaaaataaactgtctcctagtctcagatgaaattaatgtgtgaataaaaaaatgaaaaaaaaaaaacaaactggtcatttaataaatgcatgtagtgagttctctgtataaagcttaataaagtccagctataatggtggaaaccaaggaactggctgggatgatttaaatgtcctttatttttagggcttagattacatgaggatatgcatttgccaaaacccatcaaactagacacttacatctatattttattattttcacattacttgcaaataaaaacaatttggaaaaagtgataaaacaactaaatgtagcatgttaattttaattctacttctaaaaactgctaattgatagcattattttaatgtaagtaataagggtatagctttcattatactatttatacaacatttctttacgtttttcttttactattaactaataaatttttcactttaaaataaagttaccttatgtgattttcatattgtagcataaagcatctatgaaagaaaagagaccccttttctgcatagatgaccagaaagaaaaagataaaatgtccccagtcccaacagcagtcttctcataaagtcactcctggccacaaaacagaagattctaatgactcctagaacatttccctccatcattatgtgtgaattccacagggcaccagaatgtccatttctactccattaccatctttgcactgcttttccctatttaccatcttagtgaagcaggaggtgtataatcaagtcttaagccataccctggcagtgtaaacggaaacccagctgcagcaactccagtctgtgtccaaggctcagatttgagccaattcctattcctattcgtattcctttctcaattcctatttttcaaaggaaagccaggtattccttgctcaaggagggtttgagatggagttttaaaatctctcaatgcattgtttactgttatatttcaaaaagtataattatctttgtgaaatatttttacgtgaaaatgaagattattaatttgatcaagcactttattattatgccttctgttaagtaattactgaagaaaaaaatagtaattatacctaaaggaattatattggttagtatttatggaatattacctatgcaccatgtaatgggccaaactctattaactcaactcatggatgaagtaattgaggtacagaaagtcacagagaaagtaaattttgggactggagccaattcagagccttctgacactgaaaccagatcttctaagtgtaatagtctaagttctttctagtttaatatatgttatcatattaagaaagtattcattaatttttatcttattagggaatgggtattaaattttgttaaaggaaggtctttttagcagttatggggtgatcatattatttttctctttttatatcaattaatatggtgaattacattaatggatttttaaatgagagttttaaagagagagagaattaatgtaaggatcttttaactgaacttcccaataaatgtgaaagaagttataacacagaaaacagccattttaaattctcaatgaaataattaactttgacaaggatcctcagtccttgtcaaaataattgtggggaaagtttgtggggaaaggaggtctagaggtccagagattcataccaaccattacctgtccaccccccacctacccctatgttttcattttagaccagtgcttgttaatcctccctgaacagctgaagagcatttattttatttatttgttttttccacctttattttagtttcacggtgtacgtgtgcaggtttgttacatggacaaattacatgttgttgaggcttgcatcacccaagtagtaactaatgcttcttattaatcaagggaaaggcgtaccttggtaatggagtgttttcacagaaaccacctgaatcaagtaattcattttgggaaaatgacaatatttactgatttaaccatggaatggatattaaaaacacaagttctacagcattcttgcaaaaacaaaacaaaacactgagttgtatcaaaacaattattagaaaatactaatagtggaagatactagtaaacaactcacccagattactcaaatatgtcaataatctaaaacataaacacagacaggaaaatgctctgattaaggagactaaagaagcgtaaaacctcagtaccatatatgatttttaattggtctctagatttgaaaaaaagctatgaaggacatcttgggtacaattaggaaaacttgattatgtacttatacattaggtaatattataataccatatcagtaataaatatttgggatatagtaatggtatattaccactgttcttaggagatgcctgctgaagtatttggggacaaggagtcttgatgactgcaactttaattttaaaacatgcaaagaaagagagagagagagagagagtatgtaccagaatatattgtataattctttcaaattttctgtatctttaaacttttttacaaattgaaattaaaaacctatataaagcacttcattacatcccactatttaatagtaaatgtgcttcagacactttgttcaggttaacacgaaaagcacaagcagtgtcaggatgcagtcaatacagaacaataacaacaagaaaaccacaatcattgaatgtcttccttttaagctgtcgtgatattttataaaactgtgtgtatagatccgtgtttaaaattatcctcacattttgctttcccttgtttcttcctccttcattatttgtcttaagtagttttttcaccttggtgaaatagttttttccccccatcaattctgttatattcatgtaaattaaaattcagtttttttttcctttttttcagaaaaactatagtaacttgatttataggtacatgtaaatatgttttaaaattcacacttgcagaaaacattttcagtctttcattgacatcaataaggctataagaatggtatactttaagttatctttacttcagctgaacattagctttccatcacactttaatagtgttcatggtggggggtgtttagttagaagtcaggccagagaaaaaagcctcaaaaaactgtgtttatgtaaacttattttatacattactatattcagagaatgcatactaatgtgtaggtatgtacaaataaatgcatgccacagagtatacctttcatgggaataaaataaagtttgtttttctagatctatatttgtcatcttgcacttttatatggaaagtgaatgctctaatgttaccggtaggaagccggctgattgtttgagcttccacatcttaggcaatagtcccgtacagagcacttctaaaatcagtaagttatgcaaaaattgactaaaaatggagtaaagacttaaatgtaagacatgaaactgtgaaactactaggagaaaacatacgggaaattcttcttgacattggccaatcggtttatgaatagatgctgaacatcatcagggaaatgcaaatcaaaaccacaataagatgtcattttattccagttagaatgcctattaaaatgacaaaagataacaagtgttgcagtgatgtggagagcccttacacattgttagtggaatgccaagtagtacagctactatggaaacagtgtggaggttccacaaaaacttaaaaatagaatactatataatccagcaatcctactactgggtatatattcaaagaaaatgaaatcagtgtgctgaagagatatctagactcccatatttattacagcattattccctcaaaccaagatatgacatcaacctaagtattcagcaacaaatacataaagaaaatgtggtatatatacacaatagaatgctatttctccattaaaaaagaatgaaatcctgtcatttgtgacacaatggatgaatctagagaacattatgttaagtgaaataagccggacagacaaatacctcatcatctccctcctatgtaaaatcttaaaagctgatttcatagaagtatagaatagaaaggtgcttagcagaggctggaaggaaaaggggaaaggagggcaggaagaggttggtcaatggttaaaagttacagttagataggaggaacaagctctaatgttctattggacagtagggtgacttctttgttaataatagtgtattgcatatttcaaaatagctagaaaaaaggactttgaatgttctcactacaaagaaatgttaaatggttgagctgatggatttgctaaccaccatgatttgatgattatacaatgtatacatgtatcaacatggcacatgttgcacagatattatgtgtcaattaaaaataagataaacttaagaaaattaatgagttatttgatattttgtgttcaaaggtgttacttgcaatctagataaatagaaactgattagctatagaaaaatattttacattattgtatacaaatctatctagatatgtgtcagaagaattgaatatttacaaaaaatgacatataggaagcactgaattatcatagaatgagagctatctagacttgcacatcattttcttttttaaacttttattttacattcggggtacacgtgcaggtttttttatatatgtaatttgagtgttgtgggggtttggtgtatatatcattttgtcacccaggtaataagcattacacctgataggtagtttctctatcttcacccttctcccagcctccacccttaagtaggccccagtgactattgttcccttctctttgtgtccacatgtattcaaagtttaactcccactcataagtgagaatatgcagtattcggttttccgttcctgttttagttggcttaagataatggcttccagctctatccatgttgctacaaagaacatgatctcattctttttcatagctgcatagtattctattatgtatatgtaccacattttttaattcagtctactgttgatgggcatgaagattgattccacgtcttcactattgtgattagtgctgcaatgaacgtacacatgcatgtgtctttatggtagaacagtttattttcctttgggtatacacctaataatgggattgttgagatgaacggtaattctattttaagttctttgaaaaatcaccaaactcctttccacagtggctgaactaatttacattcccatcagcagtgtataagcattcttttttctccacaatacagaatctgttatttttctgacatttagtagtggccattctgaatggtgtgagaaggtatctcattgtggtattgattgcatttctctaatgattagtatgttgagcattttttcatatgcttgttagctgcatgtatgttttcttttgaaaatgtctcttcatgtcctttgtccactttttaatgaggttgtttggtattttcttgtaaatttgtttaagttccttatagatgctagatattacacctttgtcagatgcatggtttgcaaatatttttcccattccgtaggttttctgtttactcagtcaatagcttcttttggtgtatggaagctctcaagtttaattgggtcgcatttttcaattcctgtttttgatgtaatggcttttggcatcttcatcatgaaatcattgccaggtcctacggccaaaacagtatttcccaggttatcttccagagttttactgtagtcttgtagtatagtttgaagtcacgtcatgtgatgatgcctccagctttgttttttgtgcttagtgcatcagttttctttggctactcaacaaatgctagagacttaaaagtttaaaaaatacaagtttattgtcacagtttccaataataaggagcccagatatgggttagcttagtccttccctccaggcctcaccaggctgaaattgatgtgtcaggctggggtgtgatttcattttaggcccagggttcttttccaggctcctgtggctcttgacagatttacttcctcacatgtaactgtggaatccctagagggcgtgtcttcataatcagccgcaaactgacttcaggtgggtgtccgtactctttaaagacttacctgattatgtcagactcacctggataatgtccattttgataaaattaaagtcaactgtttagtaacttgagtagaggaatgatattccattatatttacaggttctttctgcactcaaagggaggatactatacagagaatacgcaccgggaataaaaatttcacaggaccagttagaaattttgcctatcccaacagttattgaaaaaactgtagctcaaatagttaccctgacactagtatttggtcttggaaaactcacctaagtagttccttagattgtgtgtttcaatacacttagttctaacatggaaatatgaagatcagctccaaatatttttttcccatgaaaaccatatgatatgtttaaatgctccaggacatactgtgtattcttagaatggaccatatctaaatgaaatagagacttggtctctatcagaatccatactaatgtgtaggtatgtacaatatcagtaataaatatttgggaatagtaatggatttacatggagttaacaatctagaaaaacagttttttagttacaaagatatttagaaaatataactttccaatgtcattcttaataatattaagagttccatgcttataaatattgttctgtattatcatcaactgacatagtttacatacgtgtctctgttcaaatctcatgctgaaatgtaatccccagtgtcggaggtggggtctagcgggaggtgattggatcatgggggtggtttctcatgaatgggctagcaccatcccctgggtgacgtcctcgtgatagtgagtccttgagagatctggttgtttaaaagtatgtggcacctccctgcttgctgtcttgctgctgcttttaccgtgtgatatgaaagctccggtttggcctcccatcatgaatgtaagcttccagaggcctctcagaagcagatgtcactatgcttcctgtgtagcttgcagaaccatggctgaaggaaataatgtatacagtggtccatttccaagacaaagtgccttaaatcggcttaggtcagcaaactgcaaaagaaatagaatgtactaggcccttgcgtggatagccaatgcctgcttgttggactcactgccccccaccccacctttagttggctcacctgaaccaaaaaagtcgtctaagataaaagtttactagcccgcaaaatagcttgttttgtccattcttatcagcctgcccaggtacttaggtcataagtcaaatatataaaaagcccctgagctaactaggattgcaatgcattgtgggctgcaacaaaatgcagcaaaacaaccctaaaaagaacacctaaagcccctacccaacaaccaataggtgatgtccgggaagactgtgaccccatagtactcaggctatgaggaacctggaaagggacttgcacactaggggataaaatgcttgttaaaaactgtgctgggttctttgtagattctggatattagccctttgtcagatggatagatggcaaaaattttctgccattccataggttgcctgttcactctgatggtagtttcttttgctgtgcagaagctctttagtttaatcagattccatttgtctattttggcttttgttgtcattgcttttggtgtcttagtcatgaagtaattgcccatgcctatgtcctgaatggaattgcctaggttttattctagggtttttatggttttaggtcttacatttaagtctttaatccatcttgagttaatttttatataaggtgtaaggaaagggtccagtttcagctttctgcatatggctagccagtttttccaacactatttattaaatagggaatcctttccccattgcttgtttttgtcaggtttgtcagagatcagatggttgtagatatgtgtcattatttctgaggcctctgttctgttccattggtctatatatctgttttggtaccagtaccatgccgtttttgttactgtggccttgtagtacatttgaagtctggtaacatgatgtctctggctttgttctttttgcttaggattgtcttggctatgtgggctcttttttggttccatatgaaatttaaagtagtttttttccaattcttttgaagaaagtcaggggtagcttgatcgggatcattgaatctataaattactttgggcagtatggccattttgatgatattgattcttcctatctatgtacatggaatgttttccgatttgtttgtgtcctctcttatttccttgagcagtggtttgtagctctccttgaagaggtcctttacatcccttgtaagttgtattcctaggtattttattctctttgtagcaattgtgaatgaaaaacaaccccatcaaaaagtaggtgaaggatatgaacaggcgcttctcaaaagaagacatttatgcagccaacaaacatataaaagaaacctcatcatcactggtcattagagcaatgcaaatcaaaaccacaatgagataccatctcacgccaattagaatggtgatcatcaaaatgtcaggaaaaaacagatgctgcagaggatgtgaagaaataggaacactgttggtggcagtgtaaattagttaaaccattgtggaagacagtgtggtgattcctcaaatatctagaactaaaaataccatggacccagcaatctcattactgggtatgtacccaaaggattataaatcattctactataaagacacatgcacacgtatgtttattgtggcactgttcacaatagcaaagacttggagccaacccaaatgcccatcagtgatagactggataaagaaaatgtggcaaatatacaccatgggctatatgcagccataaaaaaggatgagttcatgtcctttgtagggacatggatgatgccggaaaccatcattctcagcaaactaacacaagaacaggaaaccaaccaccacatgttctcactcataagtgggagttgagccatgaggacacgtggacacagggaggggaacatcggggcttgttggggggtgagggggagagatagcattagaagaaatatctaatgtagatggcaggttgatgggtgcagcaaaccaccatggcacatgtatacctatgtaataaccctgcacattctgcacatgtaccccaaaacttaaagtataacaaaaaaaattaaaataaaaaaaaaaaccggtactgggtgttcctgctcatcagacccctaaccttgcaagaccatcattaaaagtctcacttttgctattttccaggtctctgagtccattctttgggtttggacaagtgcgtttgtttctcacatgggccagttgaacctcttctttataaattatccagtctcaagtatttcttgatagcaatgtaagaatgacctaatacacaaaccattggaatactttatgatcccttgtggttactctacattgttccttcccacaccattgtggagagatcttctttccaactctcctccttttacccactttaagtgtgctatttgttttatagaggaattctaactgaaacaacattaaactcctagaaagtctcaaaaaataagaaagggttctgttttctagaaagagggagaatctggtgataaacttataatacaatcttatctgttaacaagaatctttttaaaagatccaatagtacatgagtcaaaagtaaatctgaagaattatgctggttaaatactcaaaaatcccaggtagaatggaacatgagaatgagactcatgtctgaggcaaagtttgcataggaattagtttagtctccaaactcagtctttgtgtttagttgtcagtatactgaaaattaagtttgccagctctcactgcttctagatatccacccacctttatgaagcaggtggctataaaagtttttgtatggaacctgagatgtcccagaaaaatgcattccaactactggatttcttgaaaaaaaaaaaaaaaatcctggcatttcatccaccaggtaaccattcattgaagtccagcattcagaagaccacacacacacacacacacacactcacacaaacacacatacaatgttgtcagttgactttttattgcatgaatttgggagttaaagtcagagatgtcagatatcctgaagaaaggctttaatgttagagagaccaaaacaaataaatgaaactgcctaagagagtctggcagattggagggtaacagacaatttaggaattaaagaaaattttaaaagagaaagcaagcaatgttcttagcaagttaagagaaatataacaactagaaaaatatataaaggaaaataagaaagatatttaaaaatatgtatttaaatgttcttataatatgaaagatgaaactgagaaagtgtttcaggaagtaaaaataaaaatattagaaaaatattttaatggggtatattccagaatgttcaatatccaaataatggaagttgcacagttggaaaccagagaagacaatggagagaatattttcaaagaaaaaatataagaacaaattcaatattgaaaagcaagattttagattaaaagttcacactatttaccatatgcaagaaataaaaggttagttcaaagcatcattaatatttctaaacaataaaaatacacgtcctatgatcttcttatgtagggggaaaaatgaaggatcatatataacaaatcaagaatcacaatggaatcagactataaacagcaaagtagaaagtcagaaaaaaaataagaaatcccttcaaacatctgagaaaaagagatttatgatctagaattctatatcta

SEQ ID NO: 5151 - DNA, 17470 bp, Homo sapiens
atttttagcagacatggggtttcactgtgtggtagccaggatggtctcgatctcctgacctcctgatgcacctgcctcggcctcccaaaatgctgggattacaggcgtgagccactgcacctggcccacttaaccagcattttaacatatttcttctgaaaatctgattaccagaatttaattacattagaagaaattttttaaaaagctcataactattacgtagcaaatatgttttcaaagaacttgttttaaggtgggtcttggtggctcacacctctaatcccagcactttgggaggctgaggcaggtggatcactcgaggtaaggcgttcaagaccagcctggacaacatagtgagaccctgaccctaaaaaaaatacaaaaattagccaggtgtgatggcacattcttgtgtgatcccagctaatcgggaggctgaggtggaaggatcaggttgagctccggaggtcaagactgcagtgagttgagatggcgccactgcacttaagcctgggtaacactaagcctgggtaacagagggaaactctgtctcaaaaaaaaaagagagagaaacccacccagtttgatgaattagatgcatgttaagtgaaacagttttttagatagtgtagaattaacttcattatgttcacagttaaattcatattagactgttacctattctaagatatttgatattaaccctcaagggacattggctacattttttttttttttttttttaacaaaaccttgtagtttatgttagtggtctccaaactttttggcaccagggactagttttgtggaagagagttttttccacagaccccagggggagcacggagtggatggttttcgggtgaaactcttccaccttagatcatcaggcattagttaggttagttagattctcataagaagcatgcagcctaggtcccttgcttgtgcagttcacaatagggtttgtgcttctatgagaatctaatgccgctgctgatctagaggaggccgagctcaggttaatgctggcttgcctgccgctcacctgctgtgtggcctggttcccaacaggctaccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtgagcctccgtgcccggcccctttgctacattttaatgataatgaaaatgtaatccaagtgtcagattattcagtagcttcctgtcttttggtttgtgggaagtttgatacgttattttttaatgtttcttagtcctttgttatatttcatggatagtggggaagtgagtctgtgacttgattgaaatatattgtacaatgcattcatctgcatcataggcacttggcttttaatggtaaagtggaaactaaacttctccttaggaacaatttgcactaatttatttaactgatattgatgatgctccataaagataaaaatgtcattgcatggaggcttacttgtgatgtaatttgtactttggagaagtaaatcatagtatgattttagatgttttattaacatctaaaatgtttcagtttctgtagtagaatattgttaaataaaatggtaaacactgtaaaccttaatactccttcccaagaagaaaccattaccaccactacctcttctccctccaaaacagaaaccattaccacctccacctctaacaacagaaaaaaaaaaccaaaaaataaaaaaacccttttttggccccacaccttttttggctcacacctgtaatcccagcactttggaaggccaaggcgggatcctcttgagaccaggagttcgagcccagcctgggcaacatcaggagacctcatctctactaagaaaaaaaaatggctgtgtgtcgtgatacacctatagtcccagttatttgggaggctgaggcaggaggatcacttgagcctaggagttcaaggctgcagtgagccatgattgtactactgcactccagcttgggcagcccaggaagactgtgtctcaaaaaacaaacaagaacacctttttaatctgttaactcatggtttgtttaagattttcttttagccatttttgatgccttttttttttttgagacaggttctcactctgtctctcaggcgggagtacagtggtgtgatcatggctcattgcaccctggacttcccagaatcagatgattctcctacctcagcctcccaagtagctgggactacaggcacacaccaccatgtccagctaatttttgtattttttgtagagactgggttttgccatgttgcccagagtggtcttgaactcctgggctcaagtgatccacccaccttggcctgccagagtgctgggattataggcatacgccagctgcacccagcccatttttgatatctcaaatctttcatcatagtttagtcagccatatttttcctagaatttttttaaaaactattttgtcttgctatcaagctattactctgtagttttacatacattctttattttaactaaactgttatgagcaataatttgtgataacttttttttttttctgagacagagttttgcttttgttgcccaggttggagtgcaatggcgcacatgatcttgactcactgcaacctctgcctcccaggttcaagcgattctcctccctcggcctcccgagtagctggaattacagccatgcaccaccatgcctagctaattttttatttttagtagagactgggtttttccaagttggtcaggctggtctcaaactcccaactttgggaggccaaggtgggcagatcacatgagaccaggagtttgagaccagtctggctaacatggcgaaaccccatctctactaaaaatacaaaaattagccaagtgtggtggtgcatgtctataatcccagctacttgggaggctgaggcatgagaatcacttgaccctagaaggtggaggttgcagtgagcagagatcgagccactactccagcctgggcagaaaaaaaaaaaaaaaaaaaaaagtgaagttaaactaaatttagatctgttgagtttgaaatgatggttgtatatacctctaagatcagtaaaacctaaatcaatctagagaacaggtgttaaagatacatttttggtggggtgtggtgcctcatgcctgtaatcctgccattttgggaggccaaggcgggtggcttgcttgagctcaggagtttgagaccagctgggcaatatgaagaaaccccatctctacagaaaatacaaaaattagccaggcacagtgctacacgcttgtggtcccagctcctcagaaggctgaggtgggaggattgcttgagcgtgggaggcagaggttgcagtgagctgagattgtgccactgtactccaaactgggcaacagagggagaccctatctcaaaaaacaaaacaaaacaaaacaaaaaaacaaaaaagattttcatgctctggtaaaataagtattaaaattaggaaactatggatgaattgaatgttttggtctggtcgaagtactgtgcattaaatttttggttacattttactttgataagcagtgacggttcagtaattttgatgatagtctatacatcatgtaacttgacttatttagttgtcaacaaatatcttttttttttgagacctgagtcttgctctgttgcccaggctggagtgcagtgctgcgatcctggctcactgcaacctctgcctcccggattcagattttcctgcctccgccttctgagtagctggattacagatgtgcaccaccacgcctggctaatttttgtatttttagtagagacagggtttcagcatgttgaccaggctggtcttgaactcttgacctcagaagatctgcccacctcggcctcccaaagtgctgtgattacaggcgtcagccaccgcgcccggcctagagataccttttaaggtggttctaaagcctcagaaattatttatcctgaagagaaagattaaagttttattcattgcattatgagggaaagtttaggcagagtatcttatggttttgtttttcattaaaagatcaatgttctttcagattttaagtccatttaaaaactttgcatagtaatatatgtacatggttgaaaaaagtctaatagcccagaatgcttataataaggatcaagaattctgtttcactccttattgccactctccaaacaacttttttgtatcaatttaagggttacaggtgcagttttgttacatgaatacattgcatagtgctgcagtttgggcttttagtgcatccatcatccaaataatgtacgtgtacccattcagtaatttcttgttactcaccctcctcccagcctcccaaccttctgagtctccagtgtcgttattccacactgtgcccacatgtacacattattttgcttcaacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtgtgtatgtgtcccagtttttctttatccagtcgtctgttgatggatatggagattgattccctatctttgctattgtgagtgttgctgtgataaaggtacgagtgcagttatctttttgatataatgatttattttcctttgggtggatacccaatagtgggattgctggattgaatagcagttttattttttatcatttttacttttttgagatggagtttcgctcttgttgcccaggttggagtgcaatgacatgatatcggctcagtgcaacctctgcccaccaggttcaagtgattctcctgcctcagcctcccgagtagctgggattacaggtgcacaccaccacgcccagcaaatttttgtatttttagtagagacagggttttaccatgttggccaggctggtcttgaactcctgacctcaggtgatgcacctgccttggcctcccaaagtgctgggcttacaggcgtgagccaccgtgcctggccagcagttttattttttagtcatttgagaactctttatatggttttccatacaggtggtactaatttacattcccgcccacagtgtgttaagtgttccccattgtctgcatcttccccaacatctgttattattattgtttctttaatagtggccattctgattggtgtaagatgatatgtcattgtggtttttatttgcatttcctcgatgattagtgatgagcatttttttcacatacctgttgactgtttgtatgtcttcttttgagaaatgtctattaatgtcctttgctaactttaaaattcttaaaaattttttattaaaattttttcttaagaccagttaagtgcagtagtgaaaggggagtaaagagtatagaacaaggaatttgatcggtaactgacagtgaaccatcaattgggataactcactaccagttatcagtagtgaggtattcagaacagccctttgcttactttttgatgggattatttgtgttccttgtaaattctggatgttagtaccctgtgagatacatagtttgaaacttttttctcctattctgtaggccatttgttcagtctgctgattcttttgctatgcagaagctttttagcttaagtctcatttgtctatttttgttttttttttttttgcttgtgcttttgaggtcttagtcatgaattctttaaattcatgaattcttagtcatgaattgtatagatcagtgtccaggagagtttttcctaggttttcttctaatggtttttatagtttcaggtctttggatgaagtctttaatccttcttgagttgatttttgtatatggtgaaagataggggtccaatttccaaaggaaactttcaaattatttcttcctgtggtattgtcgtgactatataatatacatatgttatgatttatgattgatttctgctctgataaaggaggatttggcttctttacatctgcttccccaatagattttttaaaaatcacttttaatttctctgctagttatctctgcagtttatatcagaactttccttcatgttatatagactgttgatcttgatgtaccaagcagtaacttttgtttgtttgtttgtttttttgagacggagtttcactcttgttgcccaggctggagtgcaatggcgcgatctcggcttgctgcaacctctgccgcccgggttcaagcgattctcctgtctcagcctcccgagtagctaggattacaggcaggcgccaccatgcctggctaattttgtatttttagtagagatgaggtttcaccgtgttggtcaggctggtcttgaactcccaacctcaggtgatccacctgcctcagcctcccagagtgctgggattataggtgtgagccaccacgcccggctgcaactcttctttttacctttccttttccctttatgtgcttacatctgtcatttctgacattgacattgtcaaggttgagaacagttatgcgctgtattgtactccttactactttgtttgtttatttatttatttttttgagacagtcttgctctgttgcccaggcttgagttgcagtgagccgagatggtgccattgcactccagcctgggtgacagagtgaaaaaaaaaaaaaaaaagttaatgaatagtttctacattattatgatcatgtaatatttttcacagcagaggcaagtagtatgtaattacatttctttgtattgtttcttggtttttgaatctgtaactgcatttttcttgtcatattttcacgattcattttatcaatctttttctgtggtttgtcattattacttattttatgcatatcaagtccctcccaccctcccctgctttcccttagtcctatttccttcagtttgggctagaagtatttagacctgttgccttgtttttgtgctgaacttttccttactctttttgcacagtgctactactgttattagagctttatcatttcttgagttactaacttgttttaatgcagtacacccacataaatagctaagaaagaatatgtgagaaataaagttttgaatccttgcttatctgtaaaagtcctcattagcccttacagttgactggtattattttattcaagtgcaattaagctgaaaattgttttccctcagagttttgaagggattgctccagtgtcttctatgtccattgttgttggtgaggaaaagtcggatactgtgtgattcttcttcctttgtgggtgatgtgtttcatattttcatccatccctttagagccttcttttatcctcattaaactgaaatttctcaaagatgtccagatgtgttttcttctccattacaataagcaaaatactttatgtgcttcacttcttgaaagttttcatgttacggctttagtgatctttcttttttttatttttttgagacggagtcttgctctgttgcccaggctggagtgcagtggtaccatcttggcacattgcaacctctgcctcctgggttcaagctattcttcttcagcctcccaggtaactgggactacaggcacctgctaccacacctggctaagtttttgtatttttagtagagagggggtttcaccgtgtttgttagccaggatggttttgatctcctgacctcgtgatccgcccatctcggcctcccaaagtgctgggattacaggcgtgaacccccacgcccggcctctagtgatcttttctttgttttctctatagctgcttttagttggattattagacttactgaattaatcctccccaatatttttgtctgtttgtttgtttgtttttttttggtctggccatctcttctactttatttattcttggaccttttaattttatattggaagttatattttaaatgtttgagatttctccttcatttcctcccccgccaatatcttttctcattttatggattaataatcttcttgagtctctgaaaatgttaataaggtttattttttttttaaattttgttgccctccctcttacctgtcaactctattgtaatttttgttgttatcttagtctcatttatattgtaggcttttaaccaaatatctgctgaccttggatatcactcagctttaagatttagtagaagggttcacaatgagctcttggtgggaattaatggttggcaggcaggctttactttagggttaagctgttaattagtcttttgtattctgacattcaagagtccattgttttaccccaaagtgccaactcccatgctaggttcactagtttcctctctcccagactccagtttctttactttagaagagatctctttccattaattttactttgttttttaataataatttggctttaaatttttttaaactactgtttaaaatggtcttttgctgaagagagataaatgtatatgtttgatctgctatttgagccagagaatctctttcagttctcaaactggactagaccaaaaactaataattatttagatatttatttatccagtgtttcagaatgtgttaggttgtagaaatataatagcagctttaagtggaggtgttttgcgtgtttataaaagcgagtactggctgggtgcggtggtgagcgcctgaaatcccagcactttgagaagccaaggtgggtggatcgcttgagctcaggagttggagaccagcctgggcaacatggtgaaaccctacccctaaaaaaatcccacaaaaattagctgggcttggtggtgcgaacctgtagtcctacctactcagaggctgaggtgggaggatcccttgagcccaggaggtggaggttgcattgagtcaagattgtgctgttgcactccagcctgggtgacagagctgaaaccctgtctccaaaacaaaactgagtactcattatgtgtgttaagccttttacagtatgtggaagattagaagatgtcacataaaaagttatgaatgtaatacattctggtaaaaataaagagcacaggagggcataacttaaaaagtaaaaggggctgggtgcagggggctcacgcttataatctcaatacttgggaaggccgaggtaggaggatcacttgaggccaggagtttgaggccagcctgggcaacatgtgtttcactgggtgacagagtgagcctcttatctaaaataaaaaacaaaaaatgtgaaagaccctcttttccctgttttgccccacatttcagagacaattactgtatccttgacttttgttatgggtatacctttgctatttctatgtatgtgtatgtacttatatccatttttatgataatgggatcatttaatttatatcgtgatttgattttgtcactttgtggttgatcttaggcatctttccattttagcttatacacatctatctcattcttttcaaaatttatccaaagatatgaatcacgtgcttaatttgccaaggagtgttttaggtgtaaggattcagtggtgaaccagagagaccaagctcctgcccttatggaacaatatttcaacggtgagaaacacaaaataaatgcatttctcgtaattagtctcaaatactgagaagtgctatgaagaaaataaaatgtggtactgtactgagtgtgtctgttaatggtatgagagagaacgcatgtggctaaggtggtcaggaaggtctgtatgaagtgatggcattgaaacacacgtgaatgatgtggaggcattttaggaagagcaggatttattgtgaagactcaaaacaagaatgagtgttgtattagtgcgtttactgctgataaagacatacccaaggctgggtaatttttaaagaaaaagaagtttaatagactcatagttccatgtgtttggggaggcctcacactcacagcagaaggcatgtaacacgtgggaattatgggagctttaattcaagatgagatttgggtggggacactgccaaaccatatcaagtgtgttatactcaagggatcctcccatctcccaaaataaacgattggtgttactgtgcaatgaggggaacttaggagaccatatttgagaggcaagcaggagcccaagcagtgcccttcacaccgtggtaagaagctgggattttatccttagtgcagcaaaagcccttagaaggttataaaccagggcacccataaggctgtgaaagtaaccttgacagatatggcttagagtagagtgatggcagaggagaaaggcaatcagaagtgtttggaaagctcaggaggctgaggcaggagagaattgcttgtacctgggaggtggaggttgcagtgagctgacatcaagcccctgcactccaacctgggcaacagagtgagactccatctaaaaaaaaaaaaagcttggaaagttacagcggtaagatctgctaaaggatttgatgagatggatatgagataaagaagaattaaaattgtcttctagatttgtggcttcagtagttgagtggacagaaatgtcatttacttagattagagattgatcttagtggagaaacaggttttaaactagattgaaggccctctgattagttaaaccattcccctactgatggtcatttagttgatttccagttttattatctttgtaaggaatatccttgtacttgtgtatttgtacgtgtggacatattctggaagataaattcctagatgtaaagttctctcatcgaagaggacagtacatatgtttcaagttttgatggatattcattagttgccctccaaaagtgaggtgttggcttggattcccccaacagagtatgcctttttcctggcatcctcactaacaacatacctggtgggagagaaagtaggcagggcctacatttctgaaaatgggagtgggagttctaatagcattttttctttactaaatcactttggcactttgttcctagaatgaaaatcagcaattgtcgttttctttttggtatccctaaagtcataacatgtctctggccatagttttttccagttactaatcatatagctgttggtcagtccttctaggcttagtggtatttatggagcctttcataataattatgagaattacaatgaaaatgaaaactattaattggtttaatgtatgccaagcactatcctaagtgctttacacgtactatattaatttatttaatcctcacaacaacctaaaaagtaattactgttattatctcgatttcttgaagtgagacagaggatgtccaccaatctttgtcttttcatttatgtattttttaattaatttttttctgtcaaaatatcttttgggaagtttggcgctgttacttgaataccttttgtcagtagttgtgggtcagaatccaaacacagaataaatggcaggaaaaggcacattcagtttaggagaatgctctgcttatgggtgatagtgtttgtaatgctttgggttttggttttcagaactgcctatgttcaaatcccagcctcacacttagtagctgtttgatttggggctgatcattgatctatttttgtagctcagtcttctgagctttaaaatgggaaaacaaggttttgtaggttgtaggattgttgcgggcagtaagttacacatgtaaaagtggccagcacaagaggaagcactttatcagcatcaactaatatttttatataattggctaagagtgggcagtcctatctagcactcaaagtgtggggaaaatactggtgataggatatcacactcttactgagttatatatattaatatttaggtataaaacttagaaagtggggtggttcacgcctgaggctgaggcaggcagatcacttgaggtcaggagtttgagaccagcctggccaacatggtgaaaccctgtctctactaaaaatacaaaaattagcctggcatggtggtaggcacctgtaatcccagctactcaggaggctgaagcaggagaatcacttgaacccaggaggcggaggttgcagtgagccaagatggcgccactgcactccagcctgagtgacagagggagactgtctcaaaaacaaaacaaaacaaaacaaaacaaaacttaaaaatggttaggcactgtggctcatgcctataattctagtactttgggaggctaagacaggaggatcacttaagcacaggagttcgagaccagtctgctgggcaacatagtgagacactgtctctaactgggggggggaaagaaaagccaggtgtgcggccacgtgcctgtagtcccagctactcaggagtcgagatgggaggattacttgagcccaaaaggtcgagaatgcagtgagtcatggttgcgccactgcactccagccggtgcaacagagcaagaccctgtctcaacaaacaaaaaacccttaaaatttttttaatgctactattgttgtaatgagtcatattaagtgggattatacatgtaccaaacttttattttttcttgagtgagattatttcatggttattttaattggcatgccttacgattgagttaaattgattatatttgtcacttttttttgcaaactgcctaccagtaccctatttcgggtactttgcagcttcaaataagaaaaattttaattaaaaatgcattaaaccataaataaaatttacctcacatgactggaagtccaggtgtaattcagtggctcaattaaattatcacggacctagatggttttcattttcctgctgttttatactcagcttgttgtcgatagttgctaaattaattcacttaaataatcatttaccacctaaaatgtattaggcagtagtccataagcacgggaaatacagcagtgagcaaaacaaagttcattgccttccttcacgggcttatattttagtggggataagggagaagacagtcaaacaaataggtagaatttatagattgtcagaagatgttaagttttatggaaaaaaataaagccatggaagggacgggaagggctgggttggattgttttaagtggggccatcagagaaggcctcagtgagctgatgtttgaatagaatcttaaaagaaataagaatgcaaaggcagatatttggggaaagagcattgctgatgcggggaacagtgagtgcaaaagccccagaggcaggaatgtgcttagcatgttcatagaactgaaagggccagtgtggcaggagctgagttatggagaaaacatcataagagaagtagcgtggggagtcagattgtgcagggccttgtagaccattgtgagatcttttgacttttactctggattagatgagagtcctttgggggcttttaagtggaggactggctttatctgaccaagactctaaaactctcatgctggctgctgtgttgagactagaatgaaggagatcaaggaagaagcaggcatgttagataatattagcagggtaacagatgatttgaagcatgataggcatcagagaaatgttgaagtaattctgcatatgttgaggcagagccgaaaagatttgttgagggatgtggcatgtgagaaaaagaggattcgtagttcacaccaggttcaatgaccagtaaagatgaagtatatttgttcatgcacatctattttatttggaattaaaaacctttcctggaagcccttagcagattttttttttttttttttttttgagatggagttttgcttcttgttgcccaggctggagtgcaatggcacgatctcggctcactgcactgcatcctctgcctcctgggttcaagcgattctcctgcctcaacctccccagtagctgggattacaggcatgcaccaccatgcccggctaattttgtgtttttagtagagacagggtttctctctattggtcaggcaggtgatctgcctgcttcagcctcccaaagtgttgggattacaggcatgagccaccgcgctcggccaacagatttttttcttaaatcccatcagccgtgattggtatccatccatgtcctagatacaagtgagggtgagagagcaaggatgttccttgcagccatgataatgggaagtggactctgtaaggaacaggttgtgagtggggagtggctattggttaggtaactaatagtctgtttgtcattgcccatttttctgttaagtcgatcatcctttttaaatgatttgtaaataatttttgcatgctaagaaagtaagtatttgttatataattctagattctaaatattttggagctgtaaatgaggttttaaactctgagatcagttttctaattttgaaataaagtgaatctccattgaaatttacaagtaggggctggtgatcgcagagtccaatgcataatttatagtttttcctattctgggtgcagttgtcattttaacctgaatgccaggtagttatctttataaaactatcatgtgtgagttatagaggtagcattggggtggtggaaaaaaacaaaacaccacttttgaggtaggatctcactctgtcacccaggctggagtgcagtgatgcagtcatggctccttgcagcctcaacctccctggctcaagtaatcctccctctactcagcctccagagtagctgggactacaggtgcataccaccacacccggctaatgtttaaatttttagtagagacaagatatcactatgttgccctttcttccttcaaaaaaagctgataaactggcttattatataacaaggaattctcattttattttacttatattgtattattgttctttaatttcagtgatgtgaagcagtgttttttggaggttttgagtgtgagctttctcatcagatactgaagagtttttgagccttaactccattacttaattagctgtgtgacccagaccacttcattgtacagctccgttcttgttgtgctggggagggcattcacacaaaatacaatgaaattgtgcttcctggtggttctgatgtgactttaggcaagttcattaaacactgcgctttcaataagataatgcatgtggaatgctgagcacagtgcctttaagacactgaaggggatatgagaacagttccatagcccttcatttttacttttgattaagagttgtttactaataactaactaggtgagttataaatggggaagtagggtcattgtgaagtggctatgaaacagcatagaggatatattttaaaagctgtatttttactacctattttcaaactgcatatttcattttagtttggagaactttactgaaaaataaagaagtagtagtatgtgagtttggatcatttctgtggttaggtggtggctacactaaggcctttccaattcttggtcctgtgagaggtaggtagggttgtggggggtaggggagaacagataaatgagatacatttatatttttttgcatggtaacttataaggcattgccaagagagggaattcactgcaggcaaagaaaaatataaaacatagtgtatatagggctttgtagcatccgtggtttcaggcatttatgggagccaggcaggggtagggtatggggttgaaatgtatttcctatggataagcacaggactactttatatcacttaatccaagacccttttactggtgaggaatccagcatttaaatttatgtatgtatatgataaagctagaatttttccagatctgagactcaaagctctttgtgttttcgtttatactccagctcttttgaggagctttaaagtctagttacaaagacaggaaaaacaagaacggccacagtggctcacgcctgtaatcccagcactttgggaggctgaggccgagaccagcctggtgaatatagtgaaaccccgtatctactaaaaatacaaaaattagcccggtgtggtggtgtgtgcctgtaatcccagctactcaggaggctgaggtaggagaattgcttgaacctgggaggcagaggttgcagtgagctgtgccactgcactccagcctgtgtgccagagactctgtgtcaaaaaaaaaaaaaaaaaaaaaggccgggcatgcagtggctcatgtctgtaatcccattgctttgggaggccaaggcaggcagattacctaaggtcaggagttcaagaccagcctgttcaacatggcaaaaccctgtctctactaaaaatacaaaaactagctaggcgtggtggcaggcaccataatctcagctactcgggaggctgaggcgggagaatggcttgcacccgggaggcggaggttgcagtgagctgagatggaaccagtcagtgcacttcagcctgggtggcagagcaagactgtctcaaaaacaaaaaaacaaacaaaaaacaaacaacgacaaaaaacctaggaaaaacatacatgcaacagaatgttaaagaggag

SEQ ID NO: 5152 - DNA, 6607 bp, Homo sapiens
actggggcgctacggttcctggagctgggcagtcttctcgtcagagtggggactggtaagagcgacctccccgccaggtcctgtgtgttgccggctgaagaagggtaggtgaaaaattcagacccagcacagtgtttatgttggtcaaaaatagaaaactatgtctggcgcgttcgaggcgggaggacccttcaggccaagagcagcctagcaacatggcgcaaccccatctctgtagtcctacctcagccccccagctacttgaacccaaaggttcaaggctccagtgagctatgatcccaccacagcattccagcctgcgagattgaggccctcacaatccagtggaggagacgaaactcatctgcctctgtccctctgggcacacctcatgccaggtgcatctgtggacaggggccatgctcctgggcttccaaagttggagaaagctgccaggctcagacccacctaagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatcccactcagtacccataggccaggcatggggacctcaacacacctgagccccagacatcacctttcattctggacctaccatgaaagacttctgaatccaggaagagaaactgactgggcaacatgttattcaggtacaaaaagacttggactgtaactcaaaaatgatcaaataatagtgcatgcatcaagtgcaatgggaagctcttctggagagggagagaagcttccagttaaggtgacattgaagccaagtcctgtaagataaggaagagttgtatgagagtggggagggaagggggaggtggagggatggggattgggctgggatgggatggagtgagctgcccaggcagggaaaccagcactatacagacctgaacaatgaagatggcacattttgttcagggaatggtgaattaagtgtggcagaaatgctttgtagagacagtaatttgcttgtatggaattttgcccaagagacctcattacagtttctaattttttgatgttatcatgcatcactgcccttgtcagatagtatcatgatcacaataacatcaagcataatatttcattgattctcacaaaaacaggtgggtgccacagttatccccattatatgcacaaaatgatgaagacttggggttaatgagcgatttgcccaagctcacctgaatattaagactgagtcaaatgttagtctggtctgacttcaatgcttgccttgttcatgagcaccatgcattgcctctcctatgcagttaagcaggtagacaggtgagagaagagcccgtgtgatatcgggggaaattcaccccgatatttcatgtaggttcttttctgttttccctgactgttggccggtctgagaaataaaggaaaagagtacaaaagagagaaattttaaagctgggtgtccaggggagacatcacatgtcggcaggttccgtgatgccccccaagccgcaaaaccaacaagtttttattagtgattttcaaaaggggagggagtgtacgaatagggtgtgggtcacagagatcacgtgcttcacaaggtaataaaatatcacaaggcaaatggaggcagggcaagatcacaggaccacaggaccggggcgaaattaaaattgctaatgaagtttcgggcacgcattgtcattgataacatcttatcaggagaaagggtttgagagcagacaacccacctgaccaaaatttattaggcgggaatttccttgtcctgataagcctgggagcgccacgcgagcccagggcttatttcatcccttatctacgactgtaaaagacagccgtccccaaagcggccatttcagaggcctccccttagggatgcattctctttctcagggatgttctttgctgagaaaaagaattcagcaatatttctcctatttgcttttgaaagaagagaaatatggctctgttccacccggcccacaggcagccagagtttaaggttatctcccttgttccctgaaattgctgtcatcctgtttttttttcaaggtgcccaggtttcatactgtttaaacaacttgtgcagttaacgcaattatcacagggtcctgcagggacattcatcctcagcttacgaagatgaccggattaagagattaaagtaaagacaggcataggaaatcacaagggtattgattagggaagtgataagtgtccatgaaatcttcacaatttatgttcagagattacagtaaagataggcccaagaaattatagaagtattaatttggggaactaataaatgtccatgaaatcttcacaatttatgttcttctgccgtggcttcagccggtccctccgtttggggtccctgacttcccgcaacacgtttctctctactcacagacttctgaccaaatgtgtgtgcagagtttctacaccagttctccaactctctggataccaaccgcgtatcccacaattccattctgacactacctagagttagcgcagaacccacaggttaggggctcagtcccacaagaccactctcacttcagatgccagttgcaagtcctaggttgtcacctgtattttgaccaaccagttagaaatcagggtttcccatgaccctcttcttgagtttaattatttactagaacaactcacagaacttagaaaaacaggtttttttctttcctttttaagagacagggcctcgctctgttgtccaggctggtgtgcagtggtgcaatcattgctcattgaagcctcaacctccagggctcaagtgattctcctgctgcagcctctcaagtagctggaattacagggttcccaccaccacatttggctaatttattttattttttgtatagatggggtcctcttatgttgcccaggctggtctcaaattcctaggctcaagtgattccgcccacctctgcctcccaaagtgctgggattacgggcatgagccagcgcatctggccaccttattttctattactggctcaatgtaatggctccatctcaggaacagccaatgaaagagatgcacaggacaaggtaagtggggaggggcacagagcttccatgccctctgttgggcacactaccctcccaggacctccttgtgtttagcaacacagaagctctccaaaccctgctgtttgggtttttatggaggcatgattgataaaatcattggccattggtagttaagtcaatctccagttccttttgcctcctggagttcagcaggtgaggctgaaagttccaagcctcaaaaaatgtggttggggccaggtgcagtggctcactcctgtaatcctagcagtttggaaggctgaggcacatggaccacttgaggtcaggagtttgagaccagcctgaccaacatggtgaaaccccatttctactaaaaataacaacaattagttaggcgttgtgagacatccctataattccagctactcgggaggccgaggcaggagaattgcttgaacccgggaggtggaggttgtagtgagctgagattgtgccattgcactccagcctgggctacaagagccaaactccgtttaaaaaaaaaaatgtggttgctttctctggcagctagccctcctcctgaagcagtctaggagcttgcagccaccctgttagctcaacagcatcccacatgcattcttaccatgctgcagatctgaaagaccttagaggcccttgtgtcaggaacctgggactaagactaaatatcaaaacagaaaatgctcctattacctctgtcacgaagggctttataagagctttggaagctctatgccaggaaccaggggcagagaccaaatgtatatttcttttcttatattggagacagagtctcactctgccactgaggctggagtgcagtgatgtgatcatagctcactgcagccttgacctcctaggctaaagcaatcctcccaccttagcctccccagtagctggaactacaggcgtgcatcaccatgtccagctgattttaattttaattttgtaaaggcagggtcttcctattttccccaggctgatctctaactcttggcctcaagcaatccttcctctttggcctcccaacttgttgggattacagatgggagcccccatacccaccaatcacaaggatctttataagagaaggaggtaggagagtcagaattagagaaagtgatgtggtaatggaagaagaggtcagagagggagatttgaagatgctgcacttctggccttgaatatcgagtcacgaggtaagtcaaggaataggggtggcttctagaagctgggaaaggcaaaggagcacattctgtctagagcctcccccagaaggaatgcagctcctctgacaccttgactttagccttaatagacctagttgggcttctggcccccagaactgtaagatggtagatttgtggtgtttgatgccactaaatgtagggtactttgttgtagcaacaacaaaaaatgaacatgaagctgggacctcatgttacagttgctcacgcctgtaatcccagaattttaggaggctgaggtgggaggatcgcttaagcccaggagcttaagaccagcctgggcaacataataagacctcatgtctaaaaaaaatttttttaaaaggccagacgcagtggctcacgcctgtaatcccagcactttgggaggccgaggagggtggatcatgaggtcagaagttcaagaccagcctagccaagatggtgaaaccccatctctactaaaaatacaaacattagccaggtgtggtggtgggtgcctgtaatcccagctactcaggaggcagagaatcacttgaacccaaaaggcagacattgcagtgagccaagatcgcacccttacactttagcctgggcgaccgagactccgtctcaaaaaaaaaaaaaaaaaaaaaaaaaagccatgtgttgtggcatgcagctgtagtctcagttcctagggtggctgaggcgggaggattgtttaagcctgggaggttgaagttgctgtgagctgtgattgcaccagtgtactccagcctgggcaataaagcaagaccttgtttcaaaaagaaagaaatgagcatggtgggaatggggacagatggcagtgttaagtagagtggtcagggttggcctcataagtgaatattgagcaaaagtttgaagcaggtgatggagctggccaaggtgctgagggaagagcattgtaggctgagtcaacaggataaaggcattaggaggaaactctctggtgtgtctgaggctctgaaaggaggccagtggagcaaagagatagagggagcgaagtcagcaaggaggccagggagttgctgggctgggatcggtacagatcgtgtaagccctgggacgctattgctggggctttggcttttactctgactaaaatgggaaccaccgagggcttctgagcagagaggcgatgtgatctgtctcctgatttaaaagcacgacctggctgccaagttgagaaagactatgggaagatttgggtggaagcatgggggccaagctgtggcaacatcccgctgggagatgatagtgatcctgaccgggttcacggtggtggtgagagatggtcagagcctggatacatgttgaagtcagtcagtaggatttcctgacagactggatgtgagctgtgagagaaggcagtggtcaaggttgagtttgattctgattgaattattaagtaattttaaaaaacactactgcctttcccaatcctaccaagtaaaggatgctagataaaagaaatctcaagttaggccaggtgcagtggctcacacctatagttccaacagtttgagaggcagagatgggagtatgttttaaggccatgagtttgagagcagcctgggcaaaacagcaagacctcctctctacaaaaataaaaaaaataaatttaataaaataaatatagccaggcatgacggtatgtacctatggccccagttactcatgtggctgagatgggcagatctcttgattctaggagtttgaggccagcttgggcaacatagcaagacttctctctctacaaaaatgaaaaaaatgcctgacatggtggtacttgcctgtattcccaggtatgggggcagctgagtcaggagcatctgttgaacccagttggtcaaggttgcagtgagctatgattataccactgcactccatcctgggtgacagagtgggaccctgtctcaaaatacaaatacaaatgaaatctcaagtcagaccagtcccttctaggctatgtaggccttgtaaccacatagctgcatgatcgggtttgtgtggctgtggatgaggagacccctgtccaattgttggctatgtaatcagtttatttttcgatatagtagtcaaatatatttcatcatacttgatggtctcagatatgtatggattttggaattccccttggaacaggttgtaacatct

SEQ ID NO: 5153 - DNA, 821 bp, Homo sapiens
ggttctgtggaaaatctgatgtgccaagaagtgttccataccattctgagaactctggatacctgctcagacagctctgtttcagctaaacagtaacatctgggagggaagcttaatgtggaatcaaggatgaagtttaacacaggaatgagaagtagagcacatagctgctaagataaggctggagtctcagctcattgcaacctttgcctgccaggttcaagtgattctcctgcctcagcttcccaagtaactgggactacagaatgtaatcatcgcaaggccaggagatgcgtttggtctgtgctgcatctcaagcaggacaatggctggaacatagtagggtctccaaaaatgtttgttgaacgttgctgatggcggcatcctggagtaggaaaaagactgaagagtggaaaaagaaatcctgacatgaattctgggcaaaggcaagcagtagctgacttggaaaatgattacactatagatggcagcacaccactacctacgatccgatcaccagcctgggtttgtaagtcagagctgttggtcaggagatggcagctaatgagtaatcagtccaaactgaatggcaaattaatgtcttcattaagtgaacaaaccagcttcctccataaacaaggtcagagtatttataacccagtgtatttcataaaagcaaaaacgcatctccatttacataactttactatggagctcatgatttatctgcacaaagcatatgcaaaatctcacttgtataccgtctttaataaggacccatgccattctgatgtaattattaataaagtcacacttgataa

SEQ ID NO: 5154 - DNA, 2866 bp, Homo sapiens
gtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaa

SEQ ID NO: 5155 - DNA, 1017 bp, Homo sapiens
ggatcacctgaacctgggaagcagaggttgcagtgaactgagatcacgccactgtactggctgacaaagtgagacccctgtctaaaaaaaagataaagagagttacctgaatctggaatccttaatcttggttttccttaaactttctataagtccagcatctgaaatattttgtcaattatcacattaatgtgttcattttgtaagtaagagtactcaatttaaaatgatcttactttaaaagtggcctagtttgcagtgcccagcaggacactgacagtcacagctgtgtgactttttgtgggttacttaatttttttgagcctccttttctcttctattcaatgaggataatagggcctacctcataggattattatgcattcccctctgttaatgcacgtaaagtttttacttggaaaactaactcaccatttaacaaccattctaagcaccataggatatattttgtttcacaaatttggtattcattcagaataagtatttgaaaagtgagtaaattctatgcaattatagttattaaatgacttataaactgtgtttctcttccacttcttgctacatttaatcttctaggtgttcagatatctttggagattataggcagcaataaagctaaggcagctaacctttcaacattcttgtgtcaggctaatattttggtgaaaggaattcttgtgtttctcaaagaactagagctgaagcagaaataagttccaatgagcaagtgtccaatcggaccattgaatgaaatctagtgttttaaacaattctgatgtttcaatgttttgttctgttttcttttgatcttgtgagcagtaagacatattttatgtgggtggtaaaggaagaaatcaagtaacagaatgaggaattgttcccaggaagagttagagttgggacaaatgggttgttaactttgatttttagatcttctctgaagacattaaacatggaatggtcatctttagaaaaataaaagactatgcaactcca

SEQ ID NO: 5156 - DNA, 13842 bp, Homo sapiens
acgcaggggaagggcggcggaacccacagctcgagctcaggtgattctgacgcaggcgctccacggaaaccctccgagaattctgggggccgtggggccgcccagctcagtccggagctccggaactcggggaagagcgtccgggagccgggtctgggttccgcactccgtccgccccgatggcagagagtgagatacggacgccccgggacgaggggctcaggacccggctacggacacctgcctccatctccctccaggtatttcaccccaataataaaataataatgccagaagctgaagagtaatcaggacctcaggattactcatagataacacaagtgtgaagagaggggagagcagcaaaggctgagctgcgtgtgcctggtcccttccagactttccagataactttgccccacggaggacaaggaaagccaaaagagagaagccaggattgttagtcttggaaaatgcctccatatagaaacatgagccggagaataaatcacttgcctctctaaccagttggatttggtccgtgagttcctagttttgttcacctgacttagtccctgacttttaaagtcaagtgcatcaacatgctgccagtactttgatgaacatctatacaggatccatctctacagcagtgaattccacctggggtaaagtatgcatgtaggttaggatgctacagtgggactctgtctgctttttctgtctgtttctgctaaggcctccacacattagatggtcagtactctttgttctatgggaagggctagaatacctaaacaggactttcacggagggagcaacaaaccagttttgtggctctcagcaaacatccatctcaaaggtgagtttggaaataatggagagtatgtcagtgtgtttgtgtctcaggcctacttcccacgcctatgggggaagggtgggacttatctctctcttccctcaagcctgctaagaggagattagactatatttgagataaatacctccagcacagtgacagccatgcagctcatgcctgtgaaatcaaaaggcaagaggatgcggctggctggctgctctgagggcagagagaaaagaccagacagctcttggaacagactgttcttccagtgacgatggggacaaagatgcatgagtgtatctccaggactggatgtgagctgcatgggagaaaaagagtgcaggcctgcagcccgggaaaacccaaaaggatgccataaacccaacaggaagatgggttgtcagggccccaggagctgagaaaggaataaaaatgacagagagagaaaagtacattgtccacatcataaataacacagctgaatgtgcccaatgaggtcctcagagaacccacagaagtgcccatgggaacagttctctctgggactcaaacccagggagaggtgcttttaaacatgcaaagagagggaaccatcatcatattacattgcagtgtccacatgaataagaccctaacttacctcatatttctcctccttcctctgctttaatccaggaggagccagagacctctcagtaagtgaagaagaggggaaataggtaaaaagccactattccccatgttagatgaggaaataggaacattctcctcctctacccaacacccactgtagcttttagtggctggagtcaggagagaaaagttttcatgttaaatgaatttcagaggtttgactatgacatagaaatggatattttaattactgaaataaaactgttttgtaattagaggtgactggaagacattttatcctcagcagaagaatagataaggataggaccttccctcccccttggaccccaccaaggttttatccagaggcagaggaagaagtaaccctttatgtgagtttgaatgggcagaagaagaaaaggatgaagttgtcttctaattgcactctatgaatgttgcttttttgttaacataaatgtcacatatatttttagctggtgtaacaaaaaaaaaaacatctcaagccggcttgcataataacagctttgggcacagtctgatcaaggccccggttctgtttgctagtgatcctcctgattctgccctctctccatgctagtttcttcctcagattgacattcctcttggtcaccagatgcctacaatcagcgggtgcaactctctgctccctgctcacttctgaaggggagagcatggataccaaccacagaacaaagccctgcagtctcccgctgagtagaacacccacgaagaagtgttggccatttccctattgccagggaaatatcatgtattggttggattaggcctgtattaatccagttaatggaacatagttaaactatcccagaccctccatagacactagagaaaaggtgaatccaacccaaatgtaagactgctactcaataggacagaaaaggcatggatgtcagtgaaatgggaaaaaaaatgtgtgccaaaggagatcaggaaggactgaatagaagacatggcctttgaattgaagcctttaatgaggaaaggggattgacattgtatgagggccagggtggagagcgggttgtgaagaggatagggaaaatgcaaggacactgcggatataagaattaatgggagaatcatgggccacaaagcagcaggattatattacagagattgtaagtagtgtttattgaagcacagggtactggggaggtggaggaaagatgaaactgttaaggaatttagacacagcatgtagtggttggcaggaaacagatgacactctcaaacagggtagttgaggagagctaataaagggaccatttaccaaggtgtagttaggattaagagaaagcaaactgggatggtgctgtgctatgggctagcaacagcaggaagtcatttctgtccctaggtctgaagagggaagcaggggagccaacaccaaggaaccagagatcttagagtctgaaagtctgcatgatagaagccatggcctttagtagagggatcttgcctactcttagcagcctggcttggaggggcctggggaaataataccccaacctctctcctcttcttcaatattgatgacttccattggttaatatcaaactggaagttggagagaaagggagtctatctatacaagtcagcaccctgtagcccagaagagagtaaaaagggggtaaaaagcaatttccgagggacaaacagaaaacacccagcacagaaggaggaacaaacatttggaggaacaaacagaaaatatcagaaaacattttaatcctgggtcctgggacgtcatggaaggttttgaagttaggagcaccgccatcctctagggggagctcaagcatttctctccactcatcccaaaggcggtgcatcaaaagatcagggtgaaactgacttcaaggaaagagccctcggctagaggaagaagcctggagaagtaaagggattgctcctggaattggaaatctaccctttgcacttctatttactgcatttggattgatttgcaagaataaccattaaaataatcaaagctaaaaattaagaggctgatagaacctggatttgagcccattgacaaaggaccactctctgctctgttctgttctcatgctgctggtttagtcagctgagtcaaaggttgcctttgcttagaaggcctaacaaaaccagagcagggtccatggaaaaggagacatgaaaagggacatatttcctggtacaacggagtaagtgtactcacaccaccctgttcctcccactgaatgcggctaaaaaacctgggcagaataagtggagcatctgaggactctgaaaagtaaataatagcaggcagattggagatgaagaccaaaatgcaaacctttcattggagaacagtcttcccccacaccatcccatagaaatactgttcactatatctggttcaggaggactgactctcccaactcctttctccaggagtggatacatgatccaggactggccagaattctacatcaagcagcccgtaggcacggaggagaatacaaattagaggatcagccagcaaacttgatgggtgatgagaactgttcaagacaaccctgaagatgttgcttatttgataaggttgctggtgctgctgctactgaagatagaacaacagttaagctttctgtgtatgtgtgtgttttccatctgtttttctttgtaatcagtcggtataaaagtgagcagtgaagaatcggggggaaataaatgtactttttaaacatgttaaatttggaaaatatctagagctcagaagaaaagtgtaaacttaagttagagatttgagagttagtgaagctctaagaggggcagagtgtaaaggtgagggcaacaagtatatgtgcacacacaatcacacacatacaccggtggcaggcaaagaaagattaaatcccttcttagcaaaacttcaattctgagaagatttttcctatctgaatttgttgaacaatattagagattttttttttctaaccacttcataaataataaaactgagcaacagagaggatgggtggctgacttgttaaggaactcctaattagtgctaaagagtcttaaaacctaggtttctgggctcccaattccaggttccttggaagtcaagagaagacaaaaacatacgatcatttactttatccctaacttcacttgaataaaacattccataagattaaggttaatgcttcctttgtctgacacatctatttaagccatatgtctggttagtttcagcacgttactaggccagttcagcaatgctcgaaagcaattcaattttcaaagaacagttctcgagatacatacaataaagctcagattaaccaggaatcatcgaaccagagttgttttactttctacttataaagaacataagaaagcactcttgatctaaggcatgacactgagctggctcacacctgctctgatctttattactttctgtatgtaaaattctcacagtacagtaactgtgaggaaaataataattttgtgcacaatactttaggtaggaaggaaactatattaataataattcaatttaagtagaaatataagtaaacttaattacaggcttttgaaaatccaagcctatttattttatccagttttaaaattcaattcctatttattaactatttaaacctactctgtggagcatacttatacccctcgaaattatcagaattaagaaaaattcagtaattcctgtgtcaaaaatattctgtaaaagtaaactgttcaacagagaaaaaaaaaaacaaaaatactgcatgaagcacatatggtaaacaaaaaaactgaagtgattatcataatcatgaattttaagaaactgaaaatgattatcaaggtaaacaatatatgaaatataacaaatccaaacaagatcatgtacctacaaaaccaatttttctaaataccatcctaacttttaatagcagaaaataacattgtttactgcctaaaacattgtacagaagagagagctctaaaatactaatcacaagccaataaatcttaccttctacaacaaattgcccacttctgaaatttgttttcattactacttttctatgtgcactaacttaaagaattgcaatggtacagtaaaagatactttgcaactagaaacaaaattctagattgttttccaaagttgggtacttgcatattaaattttctcaaaaggagacccacctgtgtaatgttcttatctatctggaacaggggttggtaaactttttctgtgaagtgccagacagtaaaatattttaggttttgtgaattatacagtctgtcataattatacaactctgcccttacagtgaaaaatctgccacaggtattacttaaatgaatgggcaacgctgcattccagtaacaacttatttccaaaaatagacaacaggctagatttggcccataagctgtagtttgctgatccttcacctagaaaaccaaattttctctcaatttctcatttccaggaatgtgtatttatttattcaggaaaaaaaaatctactaatggtaaaaactggtgttagaatgatatactttataaatagaaaaaaactacagaatgttttctctagagacctgtaagagtgaagatctgactaataaatgaagggaaaaaggtctcttcagagatgtttgagtctagcatttgacaaagtctaaatggattatttcttctattttagctaagcaaggtcacccaataagggttaaataattttgacacccataggtagttctaaaactattccatattagggcagaaacacagtgataaaatgaaatctttcattaaatatattaacatagttctatattttggctgatgttctgtaccacctaagacaatgctccaccaacaaggttgaaagacatttatggtaacagcaacataattactgcaactcttggtgtataatgacaactgtattaacgagatatgatttactccctggataactccaagaacataggacacagaataaagaagtaaacatctcaaaccttgataaagcaacaactacaaactttcctttgccactctcttaagtgcacctttacttccctgaagtatctgctcccctagccacatgggcccagaaactcagaggtttcatatgtaactgtgcatcagaaaaaagagcctgggatggaaaaaaagatgcctgggtgcagaggtgtgtgcatatatgtgtctgcctgcctgtcttaaaagtttatgattgctttgatatttaatataaagcttggaacacaatcagactgagaaatataataagtatagtacacctaaagccatctgatatccctctaaatgaaaaaaacaattatttaaatattggtaaataaaaacgaataggatacacattacccatgagataaacttgtcgaaaaagtttaatatgaagctaatcagtagcaatcaatcagacaaatctggaatgtagaacccttcataagacaattcacctggatttttcataagtcaatgtcataaaaaataaaggcagggaatgaatacaggttggagactagactcataacacacatactgtcaataattatttcttggattaaaaaagctataaaggaaattttgggggcaaccagagaaatctgaatactaactgtctgttagataatatggtatcaatgttaaatttcttggataataaagtatgattatatacgggaattcttaggtacatgctgaagtatttagggataaaacactggtatctgccattttcaaacggctcagaaaaaagttttattaatatacagataaagtagtgtcataaaatattaagtggtaaatccaggtgaaagattttcatgtattaatttttcaacttgtctgtaggtttgaatttttcaaatttaaaattttgagggaagggggtttatcaggataaagtcttagtttggctccttcttgtggggtataaacagatacttactttccatttcagcttcccttagtttattactctttcagtaccagactattatcaatcccttagtttattcctcttttagtaccagattataatcactgaggcctcatttggtgaattctatcaagggtcatcttgggagtcacctccttcaggcaatttttcttgactttccagggtaggctaaggaccctgttaagacagtttgtgttttactaccatgtagaaatttccaactacttttttttgtcctttactaggctgcaggttctggaggttccagcatagttctgacacatggtaggccttccataaaggcttgtggaacatttaccatctagggctaggtggtaaggagcaccagagagagaggcatagtttgaaatccacagatacagggaggaagaggcatttttattgtatcaggcctaaggctaggcaatttatggttaccattttattcaggtaggtaatttttaaaaagaagagttctagctgtccctctatgtaaatttaatatcttaatgttagcgagtcacttggaacactttgctttacatcatgcggcctctgcttattagtcgtagagaagttatttaaactctaaggcagttttcacacctgtaaaacagggacagttcttactgtgcctgtttcaccacattttaaaaaatatcaaatgaaaatatacttaagtaaatacggaaaaaacaggcattaagtggaaagtctgcactgttttctcccttaattcatcctctctgcagcttctcaaggttcctctagtccttcgctggctggagaccaaatggaaaagataggtctctgtctacttcaaggctaaccttaggtagctctgtaaattttggggtttacatctttaatgcctccaatatattgagaatgcgccatgaattctcagtaagatttatagcttataaggcttttagaaagtttgctatttactaaaaacctgaaagaaaatgttattttagtcaattattgaaaattacaacatttattggttcaacgattaatcaatagtatacttttcctacttctactgaaacttaacagaacatttcttatctatgatgcaatttttaactaaattgtctatacaaatggaaaaaaaaaacaccccaaaccataaataccacagaaactttttaaatttacacagtgatttcccctgaaaccactgcacaaccaagcaaaaaaaaaaaaaaaaaaaaaaaatcaaagcaaggcaaagttcaggttaagaaggcaagcaactggctatacatactgaaaacttgtcttcaggctactaacttactttccaaattggacaaaagtcaaaatgctaaatttattcttagctttgaaaatgcaatttcctggttctgttagatgagtttcaaatcacatgcttttaggaaacatgcaatataaacatgtttaaaggcatatactcaaaaatttatagtagtttcacaagttctaagctacaattttattccccatattaactatcagagttagcacagagacaagctcacagattgcatctaatctttggttgcaattgttccacctgttatctagccctctaagaaataaaacaacaacgacaacactttgaggtctcaatccactttacgaaaagaaagctttatgaaaaagcctgaacaatgaattcaaacattaaggagaaaatgagaaacgttaggtgtgtgaagtaggaaatgttaatttcatgcacttaggaacacacactcacaccccacagtagtagaagcagtagaagaggaaaacactacatgtgtaggggtagaaatatttgttacatcatgatgctggctggcgatggagggttgccgccttagagccccctgaatggaacttccactctggaaagcattcactacatccatctgcaaggaatcagagattgtgacagcttgctcagcaagagagagagagaacaagagaaaggaccattccatctatcaacatataaaaagaaaaaggcactttttacacagcatataggcaagaatagcattttgagatgaagtgggggatgggggagctaggaaaaaaggagcttaggggcatatagacacattctttcataatcagttaaaagtctcactcattccaggcaccagtattacttttcaagagaatacaatttgtgggttgggaaggctagagaggaagtttaaggagcacactcgaacctcctccccaggtcaaaaagccctggctcccatcatctctcctacctctctaccaggcccatacctgtgtttggattctgttcagacctctaaaccacaagatttggccacgccgcaactccctttcagcgtgatcaatctcttcaacatcctctgctaattcctcctcaggtatttcttccttttgtgttccatgaccagcttctttgaggaattttaaacggctagttggaattgttgaaataagctacaacacaggggaatgaacttagaaataaatcatatcaagtaaaggtaagctgatcaactgtaatactaaaggtattaaaagtggtgagagtatccgactatctttaccaatgaagtaatgggatcctgttgattagtctttctctcccagagcaaaatacattcttctcttagctacacaaaagatttgagtttgaaggataaaaagttttcctaaatggaaattaacctgattacatttttcatattttcatcaggacattcaagacagtacattgtaaaaccatgctctgatatatgtatttacttaaaaagtcctatttattttgaatacaatgaaaatggcaggtggtcttactagatgcaaaacacgtttacatttcattaatgctgtcagagttcaatgagaaaaaatgtataaaatttttaaaaaaatcattaaggttacactgaaaatagttttgttacatattttttttaaaatgcaacagtttaaaattggattagtactgattgatgacgccaaacaaaaacagatgccctagaaaacacaaaggatacaagaaacaccaatacacgtatattagcttatgtgttaacatccattctctaaggcagcagttgggtttatcagggagaaacaagcatgtagtcagctacagaattctgcttggagaacttctagtacacccacctcatttcaccaaggtgaaataggcttcaaggcacataaagtgacttgctcatggagtgactaggaacctaggtctcctgaccaccaaaggcagtgcttgttctaccatggtacacttagtatgggtcttacttaaaagatgatctctattaatgaggtactcaaaatagataagaaacctcagaatctagaaacatagttaagaaaaagaagagacacaaagatgtaaagattgggctacatttaaggaaaacctgaaagtctggtttcactgatttgcagaatgacaataaattagctcatgcaaattatatgccataatatatattaaccttcatctatgaaaatgttagattttctataaattagttttatagtaatgggcttaaaatgaacaatgcataaatcactgtcacatttaaaaaataatgacatgcatttgcaagtaagctgcctatagtaaatatgaggtatatctcttatttcaggcactttatttcatatatacactgttaaagctattcaattcaaatctaaaacatcattttgtgacccctttttccaggtaacattatttttataaaaacattctctaaggtcagtttttcctatgctgcatattggattaaattacagaacaaaatgacaatgtatttttttttttttttttgagatgaagtctcgctcttctctccctggctagagtgcaatggcgcgatcttggctcactgcaacctctgcctcctgggttcaagcgattctcctgcctcagcctcccaagtagctgggattacaggcgcctgccaccatgcccagctaatttttatacttttagtagagacggggtttcaccatgttggccaggctggtctctaactccttacctcaggtgatccacccgcctcggcctcccaaagtgctgggattacaggcgtgagccaccgcacccggccatgtattttttacattgttgtaaaaaatttttttctgaaaatgtaaaaataggttatagagtaaaagatacagatattagcatcctaaccagttataaatacatcatttttaaaaaccgctacaaaacttctaaaaaacaagttaaaaaaacacataaaaagttaggatagtattttatagtacaggcataatcataatgaacaagtgacatactggaactaatacgacattaaaaaaacttatctttgaatgccctctctttactcaccacattaaccatttagaatcaagtaatgaaactgttaaagaaaatacacactagaaattaaaaaaaaaaatcactttaggtttaaacaaaaactgatgaaatttttacctggccccagagtaatgttcccattcctaggaatattgaccatagccactgttctattgaaagttctgaacaactgaaaggttttccaccaaactgcacaattattatctggaggaataatcaagagtaaatttacttaaatcttaaattttaaaattcatatacttaaaaaaatatcaaatttatgtcctctaaaacaaggtgaacaaccactattctgatgaattgtattatattagtcacaactgaaaataagacaactgaaatagacctttcctctttcccctccagtccactttgcctcttagaaaaaaagacaactgaaataaagtaaaatctctgcccaatatttttgatgcatgcgtatttcatgtttaaattacgcttactaaaaagtaaaattcttatgaccaagaataataattttatactgtttccaatataaccccaagcaactacattcccctgtatttagtacaactcttcaaataatctgtgcctttctcaaaatatagtactcttttgtagaaaagactgtatgttactggaaaaatgcacaatattaaaaaaattccacatagctgtttatttctagttaacatttagacatactaagataaacacagactatatgagaagaaaggcaacttggaaagttctatgaaatatgggctaactcaggtgaggtgatctcagatttgctctcctttatgaaaagagtgaggtctgatgatgaatataaattcataatacagtgcttatgttttgcttgttattctaaaaggcctaaaatagtgtgcatggaaatattaagaattaactggggttgggtgtggtgactcatacctgtaattctagcacttttggaggctgaggtgagaggactgcttgagcccaggagttcaagaccagcctaggcaacatagcaagaccctgtcttaattaaaaaataaataattttttaaaaaaagaatcaattaacaatattcaccctcctgtgagtctgacaggcctctctttgatatggcagttaactagttcccaaatattaaaatcaaaaataattttggtagttaacattttaaaaccttaaagttacaattcctttctttttagctctactttattcaaattcaagtcattttcacttctcggttccactattttttaagttaatttgtgcacttgtacagatagatttccaactgctttgttagtagcccaattagattacaactgatttgacaatcaggtctggattttagtagagatataaaactgaagtaattttcttttataaatcaagaaaataatgagcatgaagaattcaatatgtatttgtacaagtgatcttaattttttttaaaatttaaacctgatcttttttttggtataatgtgggatgtaaaaagaatactaaaatgctgggaaacaattaattgattggctgactttgtttcctaagaaataatatctttcactttacagttggaagaaataaaactgtttgtctagttggttgtggcatttacttctaagaacaggagattcagttcccatattctttaacatataccttaaatcaccatgatattatatatgtcaccaaggcaacagttccacacatgttccacacaagtgattgctagaacaagctgtttacctaatgtctcccatttaacaggcaaatttgaaactatcttttccaattacccacctgtaccacaaaagtgcctaaaacaattgtgcagaagatggcattgttaaagattccttcgaatacatttctttcaccatgaattttccggg

SEQ ID NO: 5157 - DNA, 484 bp, Homo sapiens
ggcaagatggcagaagtagagcagaagaagaagcggaccttccgcaagttcacctaccgcggcgtggacctggaccagctgctggacatgtcctacgagcagctggagcagccgatgcagctgtacagtgcgcgccagcggcggcggctgaaccggggcctgcggcggaagcagcactccctgctgaagcgcctgcgcaaggccaagaaggaggcgccgcccatggagaagcaggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcacggccggcccggcatcggggccacccactcctcccgcttcatccctctcaagtaatggctcagctaataaaggcgcacatgactcc

SEQ ID NO: 5158 - DNA, 1533 bp, Homo sapiens
tctgttttccataagcactcaaatattttttcaaaaactttaaaagcaaagcacaacttgtgctctgccactgccaaaaaggatttgaagcagcaaaatattaagattcaggaaaactgaagactcttttttgtttttttttttaaaggcaagagccaaggaaaaaggtgtatatggcgaggaggaagaaaaactttatcagaatgctttcgctaaatgaagcgattatagttgaaaacaaaacttcatttccttagagggaagccaaagcaaagagagaaccatgagacgtgtcccaactctctatttcaatgaaaggaaattcaccattcatcaggagggatacttttttgtttgtttctaagctagcgtggggtatacagagaacactgatcataatggttgagaactttgatagtagttataagtggagttgtccttcctttggcaaatgtcgtctgacaggtgcctcagtctaacactcaggacggagttcctgattcctccaccagtgagcctcatcccctaaacagttcttcctataatctctacttcaacaaatggcagttccatccttccagttgctgaggctgattgagtggagtcatccttgatccctcttctttcaaaccctgtagctgatctgctagcaaatgctgtcaggtctgcctttaaaacacattcagaatctgatcacttttcaaaccacctccactgccaccaccttatccaaaccatgatttatctccaggattactgcaatgttctccctgatcccaccttcagtgtattcagatcctattaaatatgtcacatcaagtcactcacctgctcaaaaccctccaatgtcccaatctcattcagaattaaagccataaatcccagggggctctccataatctattgtcatccccatctgtcacttaaattctgtcgttttacttctttgaccttacctgctactcttccttgattcataccacttggcatcacacgcctctttgctattgtagaaatatcccagacatgcttctatttcagggcccttgcaagggccttgtagagctctctgcctaaatgcccctctaagtggccactcccttctctcttcagctcttttagagctttattcaaataccaccttcccagtggggctttccctagccttcctgtttgatattgcaaacacttctcctcctgccccagcatatgacattttgcatctgcatctcctctttctactttatttgccccctcagcacagttcactatcatattgtatatatacatatatttactttttcttgcttatttctatcttgtacactagaatacaaacacgatgaaggcagggattttttttttcctgctatatcacccggtttaggacagggcttggcacacagtgggtatacaaaaatctgttttaagaaagcagaggccgggcgtggtggctcacgcttgtaaatccagcactttaggaggccgaggtgggtggatcacttgggtccaggagttcgagaccagcctagc

SEQ ID NO: 5159 - DNA, 4561 bp, Homo sapiens
ccgggcagggctcgggacctgcagcccgccatgccagagtcccccgcggtgggctcctcggcagcccgagactcctcgacgggcgccgcccactgcgcccggtcccatcgaccgcccaagggctgaggagtgcaggtgagcaccacaggactagcgggcagctcctcccacggccctggcgtgtgatccactaggggaagccagctgggctcctgagtcaggtggggacttggagaacctttatgtctagctaaaggattgtaaatgcaccaatcagtgctctgtgtctagctcggagtttgtggatgcaccaatcagcactctgtatctggctaatctggtagggacttggagaacctttatatctagctaaaggattgtaaataacaccaatcagcactctgtgtctagctcaaggtttgtaaatgcaccagtgttctgtgtctagctaatctagtggggacttggagggccagataagagaataaaagcaggcggctggagccagcagcagcaacctgcttgggtccccttccacactgtggaagttttgttttttcactcgttgcaataaatcttgctgctgctcgctctttgggtgtgcactgcctttatgagctgtaacactcacctagaaggtctgcagcttcactcctgaggtcagcgagaccacgaacccacctagaggaatgaacaactccagacgcgccgccttaagagctgtaacactcacggcgaaggtctgcagtttcactcctgaagccagtgagaccacgaacccaccagaaggaaaaaactctgaccacgtctgaacatcagaaggaacaaactccggacacaccatctttaagaactgtaacactcacctcgagggtgtgcagcttcattcttgaagtcagtaagaccaagaacccaccaattctggacacagtgcaatcatagctcactgcagccttgaactcctcaggtcaagcaatcctcctgccacagcctcctaagtagctgggactacaagtacacaccaccatgtccagctaatttttgtattttttatagagatgaggtctcactatgttgcccaagctggtctcaaactcctggctttcagaaatcgtccttcctcgtcctcccaaagtactaggattataggtatgagccattttgcccaatctaatttgtggtcttttcacaaataccctccccctctcacattccgtgtgtgtgtgtgtgactatcataaatactgtcatttttttccatgttgatgaaagagcttaatacaaatatataatagaaggaaaaaataaaattgggtaattttcacttcgttgatgttattattattttccaagctttgaagcaatcacagatgagaagatcttcatttgaaaacacataaaagtcctgaaaatagtacaattaaaatgaaaaggaaattaccagagtaaataattgctgtaaatatgacccacgaagtgttaatttccaagtctttggaaagtctaatgtatgtctggggcggggaggggagccaaagaatgcaggaggaatgttcctcaaaagaagaaacacaattcacacaaaaggcaatgcttatttttaaatggttcaacctcacagtaatcaaagaaatgcaaattaaaagtacaataagaaatcatttatccattgtagccgggtgcggtggctcacgaatttaattttttatgtaactcgcaaacttcacaagtgtggagtctgagaccggaagtgctaccaaactccactgaaagtgaagtttgaggccagaagtgggatttccttgctgcataataaaagtgggctttggctgagtaaaattggaagcagagagggcttagaatagatgtttataaagaaagaaaatcctaattgaaggggaagaccaggtaatgttataattcactattttgagaaaatggaatcttttgaattcattctccttgtaatacaagggaaatgaaaatctatagtacaatgctcatggcacaattttaactgtttacattaaaatataaatttttccagaaaaaaaatttaaatttgacatatttaatgaaacctcctataacaaaaggaaaattgctatagaaataaatgtatatatatatatatatatatacacacacacacacatttatgtatatatttgagattttccattcatcagtagtaacctctctaatgtagaccaaccttgtttagtagaactttctgtgataatggacatgttccatagctgcaccatccaatatggtactcactagccatatgtggctattgagtacttgaaacatggctagtgcaacagagaaacttaattttgaattttatttacatttaattaatttaaatataaatagcccacatgtaactagtggctaccatataaacaacctagctctggtctagatcacttagaaatgtggggagagtcaaatatgtatagatttgatatcactatcagttatttcttatctgtatcaactaccattgaccattactgaaatcattaatgcctgaagaagtgtgctccaacattaatttagcaggattttgagaaatactgtcatgtgataggccaaattgtaaagagtactattttgttttcatcagaaattaaataccctcttgcggagattttctatttcttttggtattctgtcatacaatataattttttatgtttactttaatatttgaattattacagtagaatttctttatgatactttctcagagatgaatgcttttcatatggtcgataggaagacattataaaattactttataagcctgggacagcaacttttaaaatggcctttgtaaacaagactacatgaaaaagataaatacactaatgaaaattctaactatggggacaaatatttttaaaagtttagttataattggctgggtgtcgtggctcatgactgtaatcccagaactttgggaggccaaggtgagtggatcatctgaggtcaggattcaagaccagcctgaccaacatggtgaaaccctgtctctactaaaaatacaaaattagccgggcgtggtggcaggcgcctgtaatcctagctacttgggaggctgaggcaagagaatcacttgaacccgggaggtggaggttccagtgagctgagaccacaccattgcactccagcctgggcaacaagagtgaaactccatctcaaaaaataaataaataaataaataaataaaataaaaataaaaaaaggaaaaagttttcttacaagttctgcaatgcaacttggcaatacaacttggcaaataattccaaaaatgtaatcggcctcaaaaagtgctccctagccttgtttctccaaaagctgattctacttccaaagcacacatcagagtttaaatctcccatgaccttttcaggcgtttagtggaaatgatcattaggatttgtgatgatacttttataataatgctagacagtaatattatagataggataattgcgtataaaataatattgaaaattttaaatttgtatagattttaaaagttagtaaattcatatcttgaatgctgattatttgtaggacattgaacctagagactctgggaaatatttttttaaatgggagacatccgtccttttaggaactccatttattggacctgggcatgttcttttggaaggataggattcagataagcgagagagaggagacttcctttggcataaccttggacaagctactgagtgttccttctgcagtgaaacaataggattctggataaaacatactttctaatgaattacttgacttcaggaaacttttttaacaactctaaagatccttcttccttgcctcaggatgaaaaaattaaaaagcatgaggtgaaactgctgttgaagagtaataaacaaacaggaaaagtgggatggacaattaaattgtatgggttgtatttatttgcaaagatactgttggaagtatagcagtcacatgctctattagactgctcctaaaccgagccttatttgaaaaaaaaaacaaggagaaccaacaaccacatttgtagacccagttttttggtgtcctttttttttttccttttggtatcttcagttaagtagccaaccactttcatattgtcagatctgttttcagaaagagggcctacttttgctcagaaaccagtgttctgtgtggagaaaacatgggtctccattgaaggaatcctacaaatctctgatatctgcatgtttgagaaagtactttcattcagacacatggactgtaacttctgagtccttaaccaccacctcaaattagtatttgtctacttttaagtgtatttaactttttgttatgaaaattcagaatatattagaaaagtagagggaaaagtgtaatgaaattttgtataaccatacctaccttccacagctatcatctcatgggccaggttgtttcataattgttgtttccactttccacttccacctcaaattattttgaagcgaatcccagacatgacatcattttatctggtaacatttcag

SEQ ID NO: 5160 - DNA, 4219 bp, Homo sapiens
attgtaattgaattcttcctaaaaattgagaggtttccttttattaacttttaaaataaagaaataagtagtttcattacgattattttgcaaactattgccagtcagaaatgcactttttttttccctgaagttttaggagccgtcactaaaacattagtcttgtgattgttaaaacttgtttgtaatgggttggtgcaaaagtaattgtggtttttccattactttcaatggcaaaaaccgcaattacttttgcaccagcctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttactatgttaagtgagtcaggtgtgctttttatttcccttgtttctcattttgccctgtcagtggatggtagatgctttgtatatcttaaatcccttaaaggatcttaaagacatccctcaggtgttctatttaacttttattttattttattttatttatttatttattttgagactgagtcttgctctgtcgcccaggctggagtgcagtggcatgatctcggctcactgcaacttctgcctcccaggttcaagccattctcctgcctcggcctcctgagtagctgggattacagttgccgccacacccggcttatttttttgtatttttagtagaggcagagtttcaccatgttggccaggctagtctcgaactcctgacctcagatgatccgcccacattggcctcccaaagtgctgggattacaggtgtgatccaccgcacctggccctaacttttaatatacaacacacacacacacacacacacacacacacacacacacacacacacacaactatttcagaagacagtgtgttgccttacccagaatgagtgctaggattacaggcgtgagacagacacacatacacacacatacacacacacagagtctttattgcagaagacagtgtgttgccttataggcgtgagacacacacacacacacacacacacacacacacacacacagtctttattgcagaagacagtgtgttgccttaccagaatgagtgcttggattacaggcgtgagccactgtgcccagccctaacttttaatgtacatcacacacacactcacatacacacacacacacacactctgactgtctttattgcagaagacagtgtgttgccttacccagaatgagattgaattgttttgcttcgttttgttttgttattcagtgttgcggtagcagatgcattatcaaaggaaaaatatttggctcctttaattcctctgaaaacatgagtattttgagttctgcagcacaatgactgtaggactaagctaagtctgctttgcagatatctgatcagatagtcccttcattctgtagacgtgtattggttggtccaagacacagtgagtaggagctctgtggaccaagacaaagctggactagagagtacagttcaaacttggcagtttctctaacgactctgtatagcttctggcttctactactgaaacaagagtttagatcactgatggagaggcatagtaatctgtttgtgctttggaaaaatatataaaagtttttttcccctattttttgcactttaaatctgttttgaaattagaactgatatacatttatttgaataatgtgtaactattatggatctattttaatgaacaatttttaccatttcccaagctgcctgtttattataagcatgacatgtttactataaaccttttgcccccataatttctttttttaaaggaaattaatattagtaaaataaacacctctttaatggaagctgcaaccttctagtgatccaagtagacaatagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgtt

SEQ ID NO: 5161 - DNA, 4184 bp, Homo sapiens
agtttccctcctgcagcgtccggaggtgctgctctgggtaccttctcaagtcccttcgacccagcccgccccgcagcctgattttctgagacctcgtcccgggactcacggagctcgtgtccggcaactgctgtgtcctcctctccaagaccctcccgcttcgggatccgggacaggctcctccaaggcagggcggccgcgccccacaggtcttccctgagacccttggcggccgcagcagcccggagcagcagcccccctgccgtggccccttggccccgggcgcgcccggcggggtccatagtctcctccgcgggccctgagcgcagggccagacccagactcggacccagatccagacccagactcggacacagatccagacccaggcaggcccagggcgcgggggctggacgcaggcaggtcagcccggccggagcgcaggatcgagtccgctctctgttgtggcggttcgctgggcaacaagcccctagtttccagccctgccctgacttgggctggcctgggataatccgccctcaggtgtggcgtgcacagtgctaaggtttggttctctggaaaataaaacatccagcgaccatcgagaacgggccatgatgacaatggcggttttgtcgaatagaaaagggggaaatgtggggaaaagagagagagatcagattgttaccgtgtctgtgtagaaagaagtagaaataggagactccatattgttctgtactaagaaaaattcttccgccttgggatgctgttaatctataaccttacccccaaccccgttctctctgcaacatgtgctgtgtcaactcagggttaagtggattaagggcgctgcaagatgtgctttgttaaacagatgcttgaaggcagcatgctcgttaagtcatcaccactccctaatctcaagtacccagggacacaaacactgcggaaggccgcagggacctctgcctaggaaaaccagagacctttgttcacgtgtttatctgctgatcttctctccactattatcctatgaccctgccacatccccctctccgagaaacacccaagaatgatcaataaatactaaaaaaaaaaaaaaaaagaataagcagagaaattggggagggtattcaaagctgaacaactaatggtccaaggatatcactatcactatcattaacacatgctttagtcaccaggaactgccaattttacttctcaaatctcttaattacatctgcttctccatttttatttccattgccatcattgcttgtcactgaatttattgtaataacttcttcataagaatttattgtaataccttcttcataagaatttgttgttagatggatttattgtctgttgctacatttcaggcacagaattaagcaccttttgcacagcctcacttaattctgaggtatggtgtattctattattagccccgtttgatagaaaaggattctgaggcttgaagacgttggtggaagaaacagaacttgcccctaacgagcatgacttctaagaatgtgttgtcaagggcgtgactcactcaccttgctctacagcagggggtcactttgctccatccccaggccaaatcccgctgctgcctgttattgtaaataaaatttgttttaacacattaaaaaaaaaaattcctgcaaaatctacaagccccaatgaactcccagctctactctaccacttctttgtataattttgagaaatgtcaaggttgaatttataactaacactataggaacttcaatattaaatcatttctaaatgggcttccaacattttcttttgaataaagtaagacttgatttctcatttgaagaccatgaattttaatctttcctggcggattcttttgaaaagtgaaataatacagaagcaagtcaaattctgaccccccaaataaacttcaaataagaaaggtaatcaggttttcatttatttattcttcttacaaatttacaaaagatgtatcattttaatgtaaattatgtaatatcaatgttcatttcaaacttgtcagtttttcccttcaaattattgtgcaccaaatttgaggcattaaattcaaaacaatgtttcctaatcaatgaaaaaacaaacatgacaaaatattatttattttatcagaacaccgcccataacctcaaactttcctcttttaaaaaagggaaatgggcctaatgtttgtaatagagatatgataaaaacaatagcaggtaagttgaattgagtattatgcagaaatatcagacaatgtactaatatggaaagtataatatgtaaatggaaaaacagggcaccaaattatatgtatatgtagcatgtttacaagtaaaattctaaaaatcaaaagaaaatacccacacaaaagaaggaataatagtgaaaacagcagcagatcaatggaaagcatacagccaagtacagaaaaatctcccagtctgggtaacaaagtgagaccccctctctacaaaaattagccaggcatggtggtgcatgcctgtagtcccagctacttgggaggctgaggtgggaggatggcttcagcctgggaggcagaggttgcaatgagccaagattgtgccactgtgtgccagtctgcgtgatagagccagaccctatctcaaaaaaaaaatttttttttaatataaataaaaaataattttaaaaaaagatctgaattgtgttatccaagtttgaaactgctttcaaattctaaaccaagaaatttacttttaaaaaaatcctcttatcaatgacaggagaaaatgcatcatcattttatgctatatagccttataatagtatgtggtacttatcttactctaacagatgagacaaaaactccaaagcagtgcattatgtgaaacttagccatagctggactttatttccctgacagcttgggctaaataagaagctatgaagtatactgtgggaggtattttctttttcactctgtttcaaatatcaggttagttctcaagcagaatattaattctaagcgtgctaatacataaaagcttgcccacatgatctggccctactcatctctctgatcttgggccctacaattcttctccattcttcatccactgtttcctggtggagagccatcagcttctatttcctccctttgcctagaacttctctcccccacctccacttccgaatttttaaaatagttttgatccttcgtatcattaaggtttcaggttaaatgtcacttcctcagaggagccttctcggatcatcttattctaaaagtgtcccctaccttcatgttccattcccttatgctgttgtctctttcctttgtaacacttaccactgaaatgtctatttgtttagtgtcggtttccacaactagaatgtaaacttcataaatacagtgatttttaaaactttgttgggccaggcgtggtgtctcatgcctataatcccagcaatttgagaggccgaagtgggaggatggcttgaggccaggagtttgaggccaacctgggcaacttagtgagactccagtctccacaaaaaatttaaaaattagctggtggtggtggggcagacctgtagtcttagctacttgggaagctgagatgggagtatggcctgagccacggaggtcaaggctgcagcaagctgttatcatgtcactgcattccaacctgggtgacagagcaagactctgtctcaaaaaaaaaaaaaattaattaagtttcttactgcatctccagtggctaaaacagtacccgacctgcaataagtatttgtcaaataaatatggaatgcaatttagccatgggaacagtaacttgtctttgagtcctgaaagctttaagtttttcccctaaaggtctagactaaaaaaatatgttcaattctgaagtaaacctttaaaaccaggtcctgttcaaggattccatatttttaaaaacatcttcctagatttctctttgccctcctctaccagacgatttctccctagactcccactttgtatattcatctattatagccctccctacattgaatagaaactgtccctggggtggctctccattttttgaggacaaacatgtcttaataatctttatgtcctttatcagctaggattcagctataattaataggaaaacccaagtaactatggc

SEQ ID NO: 5162 - DNA, 4997 bp, Homo sapiens
ccattctttgtcacttttattcagtagtaggttttttttccttattttcagtgccagacacggcgaggagtgattacagccaactgttactaaaacatttgtttgcaacatataccccctttataccactgaccccaaactgactcattttgtgtgctttcattctttctttttttaatataccaccaccaagaccgggtggagggggcaagggtaagagatgaaggggagcagtccaggaggccagaagaggaggaatgctacaagccacagtaagaatgagctgtatttaatttaaaaaaagggggaaggggtgtaccccacaaatgatacagtaatgaggatacacaattaaatcccatagcatgactgaaggctttcactgtgtttgacgtcatcacaatggaaggcataaaaagtggagtaaatcaatgttgatacagtccaatctagtccattaggcaagatggtgcaagaagtcatttaaattaaaagtgccctacccttacctaaatggctagcagacatggagaacaccacagtgatgaatccacagagctttctccatgtagctataacaatgtgttgtcgaatggcacactgtcaaacactggaaaggggcgccacaatggacctctctcttttataggaacgaatgctagattcaactatctcaactaagcaggaagtgggttcttctgctaggaatgccaaccctaattcactttgtcttgaaatatatacagattgtttgtagtagctacggcaatgatattttccttggggtgccaggctgtgtgaaggattttcttattgaagtctaggctgtcaacacttatttcatctttctttcgcttgccacttgcacagactttgcgaggcttcagaactgtgcgaggcttattgttttcccgcgatgcttctagggttatgtctcgctttgtgtttctgtcaaacattctgaagaaattattgtaagatccagtcatgacaacactgtgaaaatagacagtacactcagtcaaacaagcagaacaagaaattgttttcaagtaaaatgattcggcaattaaaccataggaagctacttcaaaagcagatttaaactaagggacaggggctgttgacatcaactcaatcactagaataaaccagaaatacggtactaattaactgggttttctgcttattctttttatggctaccaaaactatcagcaaagttgacagcatcctcaagtaaaacttcttaggagtgcagaattatcgttgttaagtatttttgcaactacaggctatgtgatcaaccaggccagccagcttctcaaaggagcaactatctgtggaactcacaggttctaaaacaaaagaaccccgcatgaagtagctgtagctgttcacaagaaaccaatgctttatcttatgatttacattttttgggccgggcgcagtggctcacggcctatatatatgtatttttcaagacagggtttcactctgtcacccgggttgaaatgtggtggcacaatcacagctcactgcaaccacaacctcaacctcctgggttcaagcagtccttgcacttcagtctcctgagtagctgtgactacaggcatatgctgccatgtccagataatttttaaatattttgtagagacagggtcttgctatgttgcccaggctgtaatattttcttaacagaacatcattttacttttaccacttagaacattttaagcaaatatttataaaagtatcagtttaaaggggtggcaaaatttttaaactgcccaagacacttccttgtcagttctatttgccacccattactgctcgacatttattaagtatcctcacaaacaaaacttcgtaagtttgaagctcttaatttggaaagggtctgctaccgctgcttaccaatggttcaaattattattgtaaataaggattacaggatactggggaattgttcaaagtaatacttacatacaaaggtcacctactgagtacaaattattatctatttagtaatgtcaattcccaaaggacacttggcaacaactttaatcaaactcaaggtaatgcgtgcccctgaagatgacaaaactgtatttctttaaaaatggcttgtgtaatttagattgacatccccatatcatctgagtttgcgtggttttaatgtattaggacacctaggctgtggctacttgaaactttaaaaaggtatcattaggccagcatttctgtggtattcctgccaaaaatgtatagcctgaatctaatcatgaggaaacattctataaaataactggcctgtgttcttcaaaatgccaaggtcatgaaagacaaggagagactgaggaactgtttcagaataaaggagactaacaagagatgacaactaaatgctggatactgaaccagactgactttgttctgtgccataaaggacatagttacagtaactggtcagtttcagtgggtctccggattagatggcagtactgcatcgctgtgaatgttgctttggatgctgcactgtcactatgttggaaagtgtttttgtcaggaaatactcattcaagaatttagggttatgggcatcacatctggcgtaaatggaataaattcccatgtggcacacaagttgcatgtgagcacatgcgcacgtacctatgtggacaaatatagctataaataaacagagaatagaacacgtgatacagcaaacagcgacaggggaacctgggtcaaggccagccaagagttctttgtgttattctaacaaattttctctaagtttgaaatagttaaaaaaaaatttttaatattaaggaaaacaaatcgtttttttctgataatagaacataaaactgctaattatctgcttaaatacaatgaaaaactggttgtagctgtgcgccacaccttatttcagtatctctttactcttcaaatttgttaatcttttttttcttcttccctttccttctttcttcttgatgcctcaggtttagtagtagcactcaaaggcaatgtttgctattaacagaactctaggtttactagtccttatgtcaaaaatcagataattttaaaagccagatgaaagaaaacattctataagttctattatcctctgtaacacacaacaccatgaaatcggaatcatattaagctctgtgataaaactgttgttgaagtatctctgattactttaaatgtcagtttaattccaaaattatgttttactactttctgttctactggaacatagtggcaaatagacaactaaaagactcaaagtaagacttattttatctttaaataatgggtaacattttactaaaaatgaatacgaaaaaggaattacactacggcaaaactggaaattataaaaagcaaaggataactactactaaaattttaaccatatatattatggttaacatcatacataacatacatatgaaagaccacttctatgaggtgttaatgtagcatctggaaaacctggtgtttctaacaatccaaatgagttatctgccgcctgaatgtttctgcaacagtttaatggaagaataacaaccaagctgaagcttcaccgttttaatggttagcatgtcagaaatgtgatctggttcataaaagaaaaaaaattctagacatttaaataatttagattacctagaatttgtgtacttttatatttactagtgaaatacaatgctttaattttttatctaccagtactgctgtgctatatctaaaattactaaatttatttcaaggaatccctagagacgaagttaggacctggaatgaaatagttgtttcttttctttaataaaattcatatttgagaggtttgacttaattacctgtcagatccattccaacaacattcaaatttgtcaaatatgcagtcattttcatacagtgaacagagtttacttctgaggtattcatgcacctgggggaaaaatacaaatatactgcactgaaattaggaaaatgatttaacaagtccatatctttaaaaagaaaaaaagggcatatacagacacatacacacaccttttaaacctattaatctcaatcttctcagtaacaataaaggcattttgtccttttacaaaacacacaagcccttcagggaggtacattttcctactggtatgacaaaggaaaactccattctgggcatggcacacatagcctttataagcctgaataaaacattcaggccaaaaacacttgaaaatggcacagttaagagactaataaaagaacattatagcaatatctgaatatcactattcttggctttcagtccattaactactgataacaacactgaaactgtgcctatttctttcttaaataccattttctgggcataaatttaactgaagcctatattttccattataaatgcacatgtatgcatagcgtaaccatgccttggtttggtgataaattatatggttattctgggcatatattattaaaaatttgatagtatcatattatacaatgtcaaaagctaacaaagctgtgcctgttttttgaattatataattctgtatttactaatatgtcaaaaaaggataaactagaaatctcatatttaaaaagtctgagaaatatgacatatttcaacattaatattaattacaaacaaaagttccaaagtatttgttgtaactcaaaggaaaaaaggaagtgtctatatttcaccatctctttttaaggagctacttaaggagaaatgacagaaatgagaaggtaccttctaaatgcttagaattctctattctatatgaaacaatctaaacttattttcagtgtctattttaactttaaatatagtggaatgattcaggccatgtctctgtgacattaagtgaaaatctgtaatacagaggaatagcaactcatgtggggttaggatcaaaagtgagcatgtaacacaaaaaaatcagtaagaaaaaaata

SEQ ID NO: 5163 - DNA, 3278 bp, Homo sapiens
tggtattttgtttttgcttttgccacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctcagacagtgtatgtattctcgatataacttgtagagtgtgaaatataagtttaactaccaaataaggtctcccagggttagatgactgcgggaagcctttgatcccaacccccaaggctttgtatatttgatcatttgtgatctaaccctggaagaaaaagagctcagaaaccactatgaaaaaatttgttcagtgttttctgtgttcccgtaggttctggagtctgaggatgcaaagatgaataagataaattctcagaatgtagttataatctcttgttttctggtatatgccatctttctttaacttctctaaaatattgggtatttgtcaaataaccacttttaacagttaccattactgagggcttatacattggtgttataaaagtgacttgattcagaaatcaatccattcagtaaagtactccttctctaaatttgctgttatgtctataaggaacagtttgacctgcccttctcctcacctcctcacctgccttccaacattgaatttggaaggagacgtgaaaattggacatttggttttgcccttgggctggaaactatcatataatcataagtttgagcctagaagtgatccttgtgatcttctcacctctttaaattcccacaacacaagagattaaaaacagaggtttcagctcttcatagtgcgttgtgaaatggctggccagagtgtaccaacaaagctgtcatcgggctcacagctcagagacatctgcatgtgatcatctgcatagtcctctcctctaacgggaaacacctcagatttgcatataaaaaagcaccctggtgctgaaatgaacccctttcttgaacatcaaagctgtctcccacagccttgggcagcagggtgcctcttagtggatgtgctgggtccaccctgagccctgacatgtggtggcagcattgccagttggtctgtgtgtctgtgtagcagggacgatttcccagaaagcaattttccttttgaaatacgtaattgttgagactaggcagtttcaaagtcagctgcatatagtagcaagtacaggactgtcttgtttttggtgtccttggaggtgctggggtgagggtttcagtgggatcatttactctcacatgttgtctgccttctgcttctgtggacactgctttgtacttaattcagacagactgtgaatacaccttttttataaatacctttcaaattcttggtaagatataattttgatagctgattgcagattttctgtatttgtcagattaataaagactgcatgaatcc

SEQ ID NO: 5164 - DNA, 591 bp, Homo sapiens
atgtcctccactggggcagctgtctccgggggactcctggtgaccttgggggaggctggtctgggaggcacctcagactctgtcctttccttggtagctgctgaagccaaggctggggccggagctggagctggagccggagccggagccggggtggtggctggggtgggcacggcagtggacggaagttcctcagaggccagcctgtcactgactgtgtcctggagggtaacagctgagaagaggcctgacacgttgaagttgatgtctccagggaagagggtgtctgcgctctggatcagcgcctcgacgacgcccaccacctggatggaagacacggaggctgcatccagctgggcctggtccccttctttctcaggtggccacagcaagttgggtcccaggactatggcgatgttgctgggtgtcatcttgttcacctcctgctcctcggccagccgtgccaggaacttcatcaggtacctaaggttgctgaggttctcggggggtaggcggctgcacacctcttggagggcctgcagccgggcccctggctccttcaggctggctgccctcatccagtcatcatag

SEQ ID NO: 5165 - DNA, 3010 bp, Homo sapiens
caggcatggtggcgcatgcctgcaatcccagctactcgggaggctgaggcaggagaattgcttgaacctgggaggcggaggttgcggtgagccggaattgcgccattgcactccagcctcggcaacaaaagcaaaactccgtctcaaaaaaaaaaaaaaaaaaaaaaaagccgggcgcggtagctcagctcaagcctgtaatcccagcactttgggaggccgaggcgggcagatcacgtggtcaggagatcaagaccatcctggctaacacggtgaaacccccgtctctactaaaaatacaaaaaaattagccgggcgtggtggctggcgcctgtagtcccagctactcgggaggctgaggcaggagaatggcgtgaacccgggaggaggagcttgcagtgagccaagatcgcgccactgcagtccagcccgggcgacagagcgagactccgtctcaaaaaaaaaaaaaaaaaaagaataaatggaagtcaacaaaaacaggtacaagaaatttcagtgaagaaaaaaggaattttaaataaattaacaaaagaaaactaatagaatatatgctgtaaagtgttacacagtcattaaaatgcagctatatactggctttgaatatattggcagccaataaagataaattaaccagttgagattcatacagtccaagtttaccagatgcttaggagacgcaaagctttgcctagcattctgtcaagaaaggttttgctgtctgtgtgactaatcttacatgaatgttttcccagaattgagttttccaaagaaatatgggaacaaggggctggagttgtgggtattctgttttgtcattcaaaggcagatctttctacattacaaatcaaagtacaactgacaacctctcgaaattgaagaacctaagcactagcccacaacctcacatctgcctagaggaacaactgggtagaaaagaccaaccaaccaatcttttgcccttcagtcagcccttctgcctattttgggcttaaatttctataaacacttagttctgccctttcaaattgaagggttattctctttggtgaaaaaattaggagtgggttgttacgacatgaaatacagagggcccttcccttttttgttttgaaacttagccattattattgtgtgacttacaatatgtattttaaaatttatattattttacagatctcacaaatctatgaggttgagagggcagatatactctatggatgagaaaacttaggctctactcgttcagggtcacactggtgacagctaagtcttttcagttacagcctgtgccctttgacatgttgcttttttcctctccccttattgtacatgccctagttccaggcctttgccattctggtgtttgaccatggctcacaaatctcttgctaatatctatccactccaggtaaaaagtctgcctgtcctatatttttatacatgtcattttaaagaaagagttgattagagctccttatgcatgcacattcatttcttggatgtctttccttttttaaaactgaaatcatgttttagttttctctctttttagaatttaattcttgggaatctttcaagtctaacacacatgataaataatgcatatatatgtaactatatgcaacattcccttcattataaatcttgactgttttaaaaaatggtttgaatacagaatatttgcatcagttttttcctttaatttgaaatactagagtagctgttcttattgcttcctttaaaaactacgattgaagtacacaaacagtatcaaatgttctactttgggcaaaactagactttactgtatcagaaaactggaaatccaggccgggtgtggtggctcacgcctgtaattccagctactagggaggctgaggcaggagaatcacttgaacctgggaggcggaggtcgcagtgagctgacatcgcacctctgcactccagcccaggcaacagagtgagactccatcttaaaaaaaaaaaaaaaaaaaaaaacccactggaaatccattatattccagtattcagccaccatatcctgcttctagtctaacactgtatgtatgatagttcatgtgtatttgacttacatgtttgaccatttgaccatgtttaacaaatctcttgctacactgcaatgtctattctccccgtttgtgttcactcaaagccaaagaaatggtggtggggaagaagcaagcactttggaatccagacagacctgagtttgaatcctgactcagctactatttatttgctatcactttgctcaaattatttgaccttttgagcccccgtctatagtttagttttaagatcgtatgtaaagctcttggagtcaaaggaactcaaatgttaatttcatcatatgtatacaccataatgccttatttaaataaacaatccagtcagtcgttactaccaccatgtactacggtatctactgaaatgtggcatgaaggaaaccaaaactcatgccattcctactccctcttcaaatttgcaatttaccttctgagactctgacaaaacagtgtatgggaaaatagaaaaataaaaaccagaaacaatagtatatagggtataataggaaaagcagaatgaaaggtacatatggatggaataagggatctatgcaaggaacatgcaacttagggtggggcacagtggctcatggctgtaatcccagcactttgggaggtggaggtaggaggatcacttgaacccaggagtttgggaccagcctgggcaatgtgatgaaaccccatctctacaaaaaagtaaaaaattttagctgggcatggtttcacgtgcctgtggtcccagcagctcgggagactgaggtgggaggatcactggagcccgtggggtagactacagtgagccatgatcacaccactgcactgcagcctgggtgacagagcaataccgtatctcaaaagaaaagaaaaaagcaacctattaagatttatatactactaaaaaa

SEQ ID NO: 5166 - DNA, 5233 bp, Homo sapiens
ctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtga

SEQ ID NO: 5167 - DNA, 2948 bp, Homo sapiens
gtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaa

SEQ ID NO: 5168 - DNA, 4157 bp, Homo sapiens
tcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactg

SEQ ID NO: 5169 - DNA, 1345 bp, Homo sapiens
gaacaacgatcatattaatttgaaggtggcggggcaggatggttctatggtgcagtttaagattaagaggcatacaccactcagtaaactaatgaaagcctattgtgaacaacagggattgtcaatgaggtagatcagattcccattcgacgggcaaccagtcaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctgttctttcatttcccccttccccattcctttattgtacgtaaagtaactggtatatgtgcacaagcatattgcattttttttttttaactaaacagccaatggtatgttttgactgacatcaaggggagacgggatggggaaaaatactgattctgtgaaaataccccctttctccattagtggcatgctcattcagctcctatctttatattccagtaagttattttgctctcactgttttaacaacaacaacaaaacaacaacaacaacataaaaatccttgcataccttgttcaattggagaattttaatgtttttcatttatcattgtaaaaccaaggacaattttataacttttttgtacgtagctgttacatgtagggtaatctgtctttaagtaaggataaattactctaaaacaaaaaagaatcctacatagttttcccttcaagtcaagcgtcttgttgtttaaataaacttcttgtttaaaatgaaaaaaaaaaaaagaagctagatctcacattgtgttcttaccacaataaaaacaaagttatgacagataagtaggtagtcagcagaaaaacaaacaaacaaaaaaaaaaaacaaagaaaaaagaaaacaaagttaactcagaaaaaaataaaaggagattatacacggcagatgtggaacacaacaaaaataatactgttgttcactatgtgttaacagggactgaagctggctacagaaagaatgtcccagcaacaaagagtgggaagccctgagcaaattgttaaaagctccttctcagtttcttcccaagagaagttttcatctcaggggtggtcatttctggaggcaggggcctgcaggagacaccttggtaacaggcaggtctgtttggcttcctgaatccatgacagttgataagcaaggccccttcagatgctctgttgggcattgcctggagtgtgtaaccagatggagtgcct

SEQ ID NO: 5170 - DNA, 438 bp, Homo sapiens
aatggtaatttctccatttcaaaatgagtaagcaggccgggcatggcggctcacacctgtaatcccagcactttgggaggctgaggtgggcagatcacctgaagttaggagttcaagaccagcctggccaacatggtgaaaccccatctctactaaaaatacaaaattagctggacgtgatggtgcatgcctgtaatcccagctactcgggaggctgaggcaggagaattgcctgagctcgggaggtggaggttgcagtgagccgaggttataccactgcactccagccagggctacagagcaagactcaaacctcaaaaaacaaaaacaaaaagagtaagcagatgttttggcttagactaaaagattcttcagcttttcagacagctataagtatactaagaatttgagttatgagttaattctaagtggaaacgc

SEQ ID NO: 5171 - DNA, 911 bp, Homo sapiens
cggcaagagaaaagaaagatggggttgggagcatgtccctctgaggacccaagagagagctggccatggcaggctccagtgctctcagaggacgggtgctgcatcaacgtggactcaggacatggccagcccttcactggacagatgagcagaaaagcacagcctggacatcacagtgggaccccatctctacaaaaaaagtaaaaaagccagtgggcatggtggcacatgcctgtagtcccagctacttgggaggctgaggtgggaggatcacttgagctgggaggttgagtcttcagtgaactgtgatcaggcccctgcactccagcctgggagacacagcgagaccccatctcaaacaaacaaataaaacaaaaatatgacaaaaaagcagctcccccagggttccccagacacaggatcaggctccgtgatcctgactttgggtccagtgttcttcccctccaccgcgtctctaccctgcctgtcactgagcacaaggactccaatgttcagccaagggccacccagtggcagaagagaatgaggaacttcctctgggtgcaaaatttaatggggtgcccccaaaattcagaaaccaggggaaataatattcgaatgcaatatttttaaaagtccaaatcaaggcacaaaatctatgatgaccaaaatatgaaacttttaactaatggcaggatgagtagctgtgtggtgacaagccgtatgtatcagggcccagggcaacagggaaaatcagtcggcccaagcctgtcttcctttatggtcgtgttattttcttcaccagggactgcctgtattcattttgatattgtatttgttacctttcctgtggtgctgataattttgatattttaagtgttatgttaaaatataatttatcccactgctga

SEQ ID NO: 5172 - DNA, 1210 bp, Homo sapiens
cagccaggatcgtcaggtttcctgaggtttccagctgggcacattcctgatggcctctgcgtgtgcacatgtgtgtccttttttcttagagattctgcatttgtaacaacttcccaggtgattttgatggacgctgactttcagagctcattgccctaaagactcctggcctaagagtgaggaagtctgaggaatctggtttcagctccactgatatctaaccgcacgtacaccaggtcctgcagatgacaacctctggtggaacggagtgatgctggattcagtactcaacacacaagtgtcagctcctgggaagggcaaaagcagcttcacagcgacaccagggatggcagagatgttcttcctcagcgttcccatggagaacactagtgtcctgagagagaatgcacctgctttggtgaacactgactgtctcagctgtggcatgacgacaaggtctttctacaggcaaaagtcaagcctgcctgacatgcaaagcaccttgacctctgaccccagagctccccagggccacatgcctgcccagagccaaggaccatcttatgactctggcttggaggaaatgccaactgactccagcagcacaacctggagaacgcggctcagagaagacttgagaacgtggctcagagaagacttgcagtgggtgggcccggcctcttccaggtgggggactcccaggtgaggccactgctctgccctgggccatcacactttgagaaggggactgggtgtaggtaatgcccacacttggccatgattctgcttccacagaggtcccagctaaatagtcttaattaacaatgtgatgttacctttaagggatgaaggtttagtgattgagagaaatgaggaattcaggaatgtgcttagcactgagcggtttcttaacacatatggttggcaaatcaaggcacaacttaaaaccactcaattaaggtaataaattaagcagtgaaactaatttctaaatatcccaaatttgacacacattattccaaagatctcagacctcctcctgccatggccttcctttcctttgagctgctcaagccatgtaagttgcctcccctctttctgtgatatcttctacccattggcaacaaatcctctccaaagtgtgcagcatctagccatgtctgagctactgtcaaggctcagctgtgtggccaccacatgacctcctgac

SEQ ID NO: 5173 - DNA, 322 bp, Homo sapiens
gccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttct

SEQ ID NO: 5174 - DNA, 888 bp, Homo sapiens
aaaaagccgcgctggcaacctccgcagcggtcgcgcgcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgcctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaa

SEQ ID NO: 5175 - DNA, 3719 bp, Homo sapiens
ggcagcccccccagccctcggcgcctctgcaaccctgcgacgggctggggaggccggtatgcgtggttcccggagcacccgtcccccgaggctccacgtactcaagcgtttctggggcggaattctgtgggcagcaacgggggccccctctccaacaagcgcacctcatttctcacgtgggagccgcggcccagagagctgaggtgacagagcttgggccgcagagctgctccctccctgcagccgcacagcaggccggaggcacagccggcgagagacggccactcgctttggagcggcggcgaggccggcgccttcccgggcaccagggactgcgtggcttggccggaaatcaggctagaagcagctccgggaagcacagcccttagcccagcgccttcccacactgtggcaggaatagcactggcggcccacgcgcttgtcagggaacagaacagctctcgcccgacgcctggcaggggagcagggaggctgcagcttccccagcgaccagctgtttcccaggctggcggactccacggaccggctccgcgtctcctctccagccttctgttctctctagaggaagatctgcgttttgtctgcactgtgggccgactctctagtggggagcgtcagaccctctaaagtggctgcctctcgggaaagcttccacacctgtcatcagattctccaaaggggctgtttgatgcaagaaacgggaagccccgggggtactaggagcagggcttgctgccattgggcatggtgaggccccggcaccctgcccaggacgggcctgtgggctgagctgcagatgggcattgaggatgccccaacagcaaggtgcagaaggcatccagaagcaaaggaaactgatgaccagcgtcaaaaacaaacaaaaaaagggaacttggctcggcggtggctcacgcctgtagtcccagcactttgggaggcagagacaggtggatcacgaggtcagaagtccaagaccagcctggccaacatggtgaaatcccgtctctactaaaaatacaaaaattatccaggcgtggtggtgtgtgcctgtaatcctagctactcgggaggctgaggcagaagaatcgcttgaacccgggaggtggagcctacagtgagtcaacatgaagccagtgcacgccagcctgggcgacagactctgtgtttgtgtgtgtgtgggggggggagggcggggcgaggcgaagggaacttgaggtttaaagcagggggaggagggccggaaatgctccccgccgcccccgacactcactcgccccaggccccatcctagcccagggtcagtgtcattcccttcaccttagcctctcactgcccaaagaggcttacttttcttctttaaactgctgttaaaatttgggaggaaacggaaagcaagggcacctgatggttcagtgcagcttcaggttagaggggcatttgaggtgcctgagctgggggagggccttccccctgagggactgggagaagggtaagccatgtgccctggaagcactgcagggagcctcagatttgcaccccctggctcacactcgctggcgccagccagcatggcagggatgggcggggctggttcttaggtttcctgctctttgggtgctagcacccagggtaaggagacacccatgtccggttgcaagacaaacccttctacctcctttcctgccaaaggccaccagcatcctctgcctcaatctcaatctttggaactttttagctccaaagtggtttgatgaccacaggctaaaattcatagtcttaaaattttagatagttaagagacagatctgttacaggttttcaaataaactggtctatctagtgtaagaggtcactgctgagcttcagtgagcacccatgggcctgctcttggatggtgggacagctctcacctggggcagcacggccatccctgcaagcacacacaccaggaagcagcctgtagcccctgagctgacgcagacacaatgccattctccagcagcgtctctgaaaattttaatttgttctgacaacgaaactaacacagcataaggacttaagccctcaagctaggcaagacactgatggcccttggagaaagcaccagggcagctggcaggaggcgctaagatggattcttggtgggaaaggaatgaggcacacacataaaccgtgggaaagacttaggtgtcagggcccaagccagaagagggataaggatggactgttccagccttagtctgtgcttaaaaagacagaaatgcccttctctggaattatgagggagaggtctgagggaagggaggcaggcagcttactacttgccctttcactgacctatagcatctgaggcatctgagagcaaagttaaatagaatgaggctggtcgcaagcactgggaagaggtggcggtcctcgggtttaaggagccaaaccctgggcttggaattcagctcccagggccagagcagcatctctcttctgcggaggaggtcacctgagctcacaggactgggaatgtcggctttggaccctcctgatccctggttgttgagattcccttgtgtctcaaaagccttggagcagtgaagtgtctctccaggattttctttcccaatcagtcagcagtcaactttcctggaagaatgtcctttctacccaatctgcccaggagggcgggaatgtggccggccctcaggaagggcctctgggtggcctctgcatccctggctggagaatgcgcacagtttgcagaggctcagaactcccaatcgtccacctccagctcttccaggtttgttaccaggccaaagattccactgtggtcctgagactggctgccctcaaaattggtgatgggggtgacaggacgaagcaattcgggcaaagcctctgaggcacgtcgcttgatctgggggagaagagagaggtgggtgacagatcctgttgctctgggtcccaggacaccatggggcaaggaaccatggcctggtggcagacgggctgtcggagccaactccatgagaggaaggagcagtgtctttcaggggcttcggaagcggggtagtttctctcattcaaagggaggggagagaaagctaaagggattgtgagttgttagaaccagaactagaaccagaaccagaacgaaggggctacgatacctgcttgaagaaagagtggttcaggagggtgctggcactgggcctggagggaaaggggaggagagaccgcagcatcactgccgtgtccccagcttcccgaaatcctgccacttatgcctcagcctcgggtcccctctccctctccctcagctcatgggaagcagtggccagagctccccaggctggcctctgacacacccaggagctgatccctcctgtgtgtagctccagattcccctgcagaacctttgggaggtaagtcccttcacaccctggccttaccctcctgagcaccctctgctctcccgaagcccaggcccaggccagcagggatacctggcatccgggttgcgctgaaggcactgctccacaaagtggtggaagtggggggagaaggttcggtggtaggggtgggagggcgagtcaccgttggagggccggggggtgctggtggtcaggctgtcactcaggccagagttggccactgagcgcgaagggctcatggtcagctcctcagcggggatggtgctggta

SEQ ID NO: 5176 - DNA, 2987 bp, Homo sapiens
aaacggacatgcgtcccccagaggaaggaagggtgtggaggggaaaacgaaggtgccctgatggggagataacggggctagaattccaaggccccctctctctgataccaggttctccagggagacagatctgggcttctcagcagaggccgcagctgctcagacttggtctctggaacctactgcgccactccctgcctcacttcccatgaaccagaaggtggctcctgcccgctggccagaaacagagacctttcacaaagaccaggctctcctcctctccacggatgaagacagctttcccagctggggtgcagccctgcactggcaaatttggcagcacagccctctcagggtcactggggaggtgagcccagtgcaatgactcacaaatgatggggtggcctctcggcctggcctgggaggtccatgagtcctgggtggacagtgatatgcccttttgctgtggttttatagatgggaaaagttctctggctgtgcctcagacctgaagccccacatggttagttatagaaagctgcaggtgccggcagccaggaaggctttgggggtgaggtcagctctttggggagcagaagatgaagatgctggctttgggaggggaggaggggttggcctacttctcactgctctatggttcaaggtctgaacacaggtcgtttgtaccaggtcacaccctgctccgatatagctcaaagtacaactgacgcctgctcaccacaccctccaactacaagggtcacacctgtgctagacccttccttctctagaaagcacccaacactcatggtgaccacaagcttggatatcctttctcttataaccatgacactggccagatccaacagcctagctggagggatgggctccgaggggctccggggtggggccaggccagtgtgtggtccctggggccggctgcttgcatctcagtccctgctcccaccatgtccctgactaggaggctgtgggcaagtggcctgtatgtgtctctgcaccttggccttctcatgagtaaaccagagggctctgggacaaggactgaagcagggacagtgggaggagccggagggcctcacctcctcaatgttgcgaatccagttccggatgttgtcgaaggacttctcgttggtgatgtcgtagaccagcatgatgccctgcgcggggagagaagacacaggtgcctgatcggctgcaggctctggaagggaggcctcagcggcaccagagaacagtggtggggagcccagcacccactgcacagccaggcccattagctgccgccctccccacctctgtggagccccggaagccagccccctcctctccatccctgtggcccttctttctgctgggttctggcaccagccttgtcctgccccccgggccgctgaggtgacccttctgcctcacaggccagcccctgccacgcactcgctgacaagcccggctggctcccctcatggcccacggggtggtgcagcctgacggtgggagccggtccacaggcccactgccagcagcactcccctcacgctgaccctcccctgcaatcggcctcctcttcaccccttgctcaccccacgctctgcctgagccacctaccaggcacaactgagcccaggaagtcctgacccgacatccacacaacttccagtgaccccaccacagagggaaccggctgtgtgaagatggagccgagagtgccaaggcccttccagttccctaacctagacgtgagcaactgggagacggctcgtgggtcctggaagagcttcggggcagccccgcctcagcctgggtccacagcctcgctactgctgtggacaagcgcaaacatgcccatgcgatgcaaggggaaactgaggcacagagacgtgacctttaagattcaagcacggggggcgggggggggctaactccaaaagcactgatgacacctatcctctcagcaatatccctgggcctttttcagccccagaacccacatgtgggggccaccctctgacggtctgtgtggttctcgatgtccttgtggagtgcccacagcgggccagcctgcagtgccatcacaagtccccctttgttgccgggcatcctgggctccaaggcacgtggcctgctcatggccaggcctggatttcttccttcctcctcgctacctgctccccaggcccagccctgcatctgtggcacctgagggcactgatgacttctgctgctggccaagttgtctggggccatccaagtttgcagaataaggacacgggccatgtggtaatggtgagacagatgtgggtgcaagagtgtgggacaaaaacgacacagatggggcaagaaagtcactgcaaccccaaatcctcctgggaattcagggacatgaataatggcctcacagtcagccgcaaccatggcgaagaacctcaaggctgcagtggcccatgatgtctgccatgccccatccacggtgggcacaccctgtgactgtgacatggtcagggacagggggcgtggggccctttatccggggactggaccctctgaaagcccaggattcctgccttcaccactaagttggtgacatgtgcctaagactcaaattcctggattatacctatttcagggagctgaggggagaacctggacgttagtggggcagtgggtagagctctctcttagaatcaagcagaagcacctggaaaacactgagccagccatcctattccaggttttcctggaaacacccctcagggctccaagtgactattttccagggccccgtctgggcaaacctcaccatgggtctctaggcatccaatgcttcccaaacttgggattttgaggcccaagggtctatgagcatgctgacagagatgaggacacagctgcaatggtggtgctgtcccatatgactgatactggctacacaaggctctagggcatcagaaacatagctgctttgaccc

SEQ ID NO: 5177 - DNA, 14425 bp, Homo sapiens
ctctgtctcaaataataataataataataataataataataataatgatacagattaataataggtcgagactttttagaattggaatcttagacttttgggaacatcacatctggaagagaccttaatgtctcattttcagggatccagggaccttcatgcaaggtctatcctggagtgcctgggtttctgggaggggcctctagaggatggggtagggggtgcaagaagcagggtgcaggtctccaccttgaggcctgctgagcagctgcacttgggtctgttttatatattcagcttctcttcttagagtaatacaagggttctgttactcccaaagctgagtgagggccctcttttttgttgttggtttttgttttgttttgttttgtttgagacagagtcttgctctgttgcccaggctggagtgcagtggcatgatctgggctcactgcaacctccgcctccggggtttaagctgttcgcctgcctcagcgtcccaagtagcagggactacaggcgtgcaccaccatgcccggctaatttttgtatttttagtagagacagggtttcaccaccttggccaggctggtcttgaactcttgacctcaagtgatccacctgccaaagtgctgggattataggcgtgcaccaccgtgtccggccgggccctggtttttgtacacacgtgcattgcagagctagagaaggtcatgacttgcccaagcacatatagcacatcagggcagaccctgggctcgaacccaggctttctgccaggactgggttaggcccagagttggggtgctgcacgatcaacaagctgggggatgctgggagttctgctgagtctctgggtgggggccagctctcccagcagctgagctggcgggagcagaagctggaggaggcccagggggttggcccagtggcaggtggaggcgctggagccagcagcccgcggggtatccggttccacaactacgcgccgcgcccccgcgcccgtgtgcgggattcacccagctgacactctcccggtcccagaaggtgcagcagccggcgggttttgagagtcccaggtgccctgcactgtgcaggagtgtggacgctgcccctccagggctgtgaccccgcctcagggccttttccctggcgcccgccatcagggctcttggctttgacaggcgatccacccttcggctcctcccaggagccataggaccctccctgcctgcccttcactcaagtcgaggggcctgatcagcaggctctttcctctcaggccctccactcagggtgtcaacagaggtggatcagatgagaaacctggatttctacacacacctggctacaatgagatggcaccactcccctcccctgcagaagcagactcagaaaaaggtagttaaaacagaaggtttcaataaaatcgacagtctgataacataatacccaaaagtccaagtttccattgaaaatcattcatcataccaagaaccaggaaaatctcatactgaatgaaaataggcagcaagcacacactggcaataaaatgagagaagcgctgggattgtctgacaaacattttaaagcaagcaagcctgatgaaaatgatttagcgagtaattatgagcacacttgaaataaatggacaagtagaaagtcttagcaaataaatacaagacttaagggagaaccaaatgaagtattagaagtggaaaaatacaaccaccaaaataaaaagtctggcacataggctcaacagcagaatggatggtgcagagcaaggaaatccatccactgccaatgaaaaagtagaaattacacaatcttagcagggaaaaaatagactcggggagaaagtgaatagaacctcaggcacctgtgaaactacctcaaaaggtctcactttcatgttgtcatctatgtctggaaggggaagaggaagaggacaagcctgaaaacataaagaagtaaatggctaaaagcttcccagagttggcaagagacataaacctatatgcttaagaagctgtgaggaccccaaataggataaaacccaaagaggtctatggcaagacacgtgaaaaaataaaatgttggaaactaaagacaaagaaaatatattgaaagcaacagagaaaggtgacaccttacctagaaaggaaaaacaattccgacgatgatggctttctcatcagaaaccacggaggcagaaagaagttgtgcagtgcttttcaagccgcagaagaaaattgtcagcccagactcctctctccagcagaaacatctttcagggattaaggagaagatcaaaacagtttcagattaagaaaagctaaggacatctctgaccagcagttctaccctaaaagaagggctaaggggagttctctagacggaaaggaaatgattaaagaaggaaccttgggacatcggaaagaaagaaaacagcaaaataggccttccttctcctcttgagttttctaaactatgcttgacggtttcagaaaaaaatcatagcaccattcaatgtggttctaactctccataaagaaaatgtttgaaatggttataaactgggagggtaaagagacctacaagggaggtaactcgtctatcattcactcaaattggtaaaacaatgacaccagtataccgtgtggttaagatatagatgcacagatatacgaatgtctggaaaaaccaagagggctatacaaacagacatactcaaaagcactatggataaggcaaaacaccattctcaaagatgttcaagtcatgacaggaaggtaagaaaaagaaagcatatccagaaaacgaaaccagggagaacaaacagaaaaggaaaaataaaatggcagatttaagccctaccatgtcaatatcattaaatatcaatggcctaagtataccagttgcaagacacaggctggcagagtaggtcaatggacacgaaccaactacatactggctacaaagagactaacttcaaatatgatgatacaggcaagttgaaatgaaaagggtgggaaaagatatatcatgcaaaccttagccaaaggaaagcaagactggctatattaatgccagatatagtatatttcagaacaaataaactaatcagagacagagagggagactatataatgtgcaaaggaccaatccaccaactcctcgcctgacaaattcataaatgtctacgcaagaacaactgaaagtacttaacagagaactagacaaatccacaaatacagctgtatgcttcaatgtccccctttctcaacaatttatacaacaaccagatagaaaatcagcaagaatacagaagaacccaacaacacgatcaaccagcgggacttaaattggcaattttagaacacccaaccacaccagaatacacattgttatgggatgcattgtgcccagcccccccaaattcatatgttgaaatcagaacattattagccactagtgatttactaattaaaacaatgagaaattgctacgtacctatcagaatggccaacataaaagtgtgaccacatcaagtgctgtcaaggattcagagaaagctggatcactcatacattgctggtggggatgtaaaagattacagcccactctggagaatatctgtataatttttacttttaaaactctatgtgcaactaccataccacctcggaattacattccctgcatttatcacagagaaatagaatcttatgttcacacaaaacccatgtacttcaagtttatagcagccttgtttttaatagccaaaactggggaaacaatgtatacacgacttttgtgagatgaatggttaaactgtggtatatatccacagcatcaaatagtcctcagtaattttttttaaaaaaacaacaaatgattgatacccacaataacctggacgaatctccacagaattatggtgagtggacgaagggtaatcccaaaggttacatgtagaattccatttaagtaacattcttgaaatgaataaattataagagtggggaatagattagtagttgccaggggttaaggagggaaggaggagcagcactgaatagaaggggtcataactataaaaaggcaacatgatgaatcccggtgttgacggaaatgttctgtaccttgcttgtataaatgtcaatctcctggtactgtggcatttgcaatatttgcaaattttatttatttattcattcattcatttttctgagacggagtcttcctctgtcgcccagactggagtgcagtggcgcgatcttggctcactgcaacctccgtctcctgggttcgcaccattctcctgcctcagcctcctgagtagctgggactagaggtgcccaccaccatacccagctaattttttatatttttagtagagacggggtttcactgtgttagccaggatggtctcgatctcctgacctcatgatccacccacttcagcttcccaaagtgctgggattacaggtgtgagccaccacgcccggccactatttgcaaatattaccattttggaaatattaccaagatgttaccattggaggaaacggagtaaggcgtacaagggacctctctttttctgagttaagattgtatgtgaattattaaaacgtaaaaattaactttaagaaagctaagtgtatttctccttgagtgatcatgcctttgcttagaaaacattaaggcaacaataattttccaaaaccctttattttcttgaagatagttttaacaaaagctgtgcttaggggttttcctagaagtttaaaacttctactaatccttactgttcttctttgagaaccctccaggattttatttatttattttacacctttcaaaagcatagagacaaaacccggcaactggcatataatactgtattagtctgagttatccagaggacaagatacacacacacacacacacacacacacacacacacacacgcatgcacgcacgcagagaagcccaagttctactctgagtaagctctatacctaggagagtcgaatatagttcaagaccaagtccaaggcttaaggcagaagactgatgtcccagctcaaagacagtggagcagaaacctttcttaacccatcatcttattcaagccgtccatgggttggatgaggcccacccacactcgggagggcaatctgcttcactcagtttactgattcaaatgtcaatctcttccagaaacaccctcaaagacacagtgagaaataatgtctaaccaaatgtctgggcacccccgacccaggcaaattgacacaaaaattaattttcacaaatactatcaatagaagtgactaataaatgtggcatcatgtcctgcctgtttatcccatgacaattagtatagtcgagcgtaacattggcttccgttcccttatagtagcaacatgtaggagtttcatttaaagtgaggataattttgaccttacagagtttctccctacccctatctaccattgccacttgtggattgtcattttgccatgactttcttttaaaaaatatcaataagctctatacttcagtaatgtaagtttgaatttcatcctggctgcataagtcactttccattttgacaaagtctagaaatatttttctccatctccttgaatatgggtaatggatacctattgtggggcccactctcaatctcatggttttattttaatttagttctcaatagatatgcctcagctgcttaaaaaccattgaaaatggcccatggccttgtccatctaacagagtccagtaaaatcctgacaatggaatggggagagagaaagtgagaaccaccaaactcagcacaaaacgactgagtttaaacctctgtgctaagagatgatcagagtctatcatggcttctagtagcatgagaccatgtctcacgaatgaccctaggctcccatgacaatgcctacctaagaaagctcaaggctgccaggggaacttactttagtctagccaatacttgatgatggcagtttcaggatctttctttcttatagcacttactaagaagggaatccttcctccatccctttgatatatgtgtgtatctcctagggacttcaatgtatctttgcccaggatctgaaaggcaatacttttgaggtgtagttctcaggaaggactgagcctctgtcttccagtctctgtgggaggttagaatcctaacttctaatattgccagctggcagacacagctgtcctgatgaggcagacatttaaaatgaccaatcttttgtaatgtttcacttgtgccctgccccctgccctctcccctgcctctctctcccattagaatgccatcacctctgcacaaatgcgaacagaaccagccccttcctctacggtcagtagttactgaataaaattggttttcatcgatttgactaatgtctgatatatctttgacaaaataagtgtgaatgattgtttttagagacacggcagctgcaaagagaggcacagacatggcaggagagggaggggtcacctgacccttctcatttcataggcatctattcctgcctggtgtttatgagcctgagacttggcagggctgtcctggtatataactccatggctctgcagcaagactcgaataggctggtggtgacacttggtgtgaccagtcaccttcaaagatgccattaagggttcacaagaaaatgaagggaaacagaaaaactgattatgaaagttgttgcctctcctgcttcttcatacagagtgtgtatgatattgctgtgtgatgttagactgcaacttagcccaacagctgttctagtaattggcagtttctcatcgagttaagcctacctgataaagaagcacgcttacatttattgattacccccgtaaaatgaacaatacatccaacaaggcttctagcaaaaatgttcttattaacctcctttttatactaaggaaaaactgggtacaacacaaatcttcatcaacagaagaataccaactgttatacagtcataaaacgatcccagaagttcactccataccatcaaaaccaggaacccacactgatgcccctgatggcagaaaatcatgatacaaaaatgagagaaacgagagagagaaaatgtactagagtcatggtagtgggtaaaagccaaagagctcagtttctactcatgatattcattagaagaaccaaaggaacatgagccaacagctgtaagggtccaggtctgcacaaggtgcctgttgggtgcagggttctgttggctccagtgatatatctcaggtgggctaatttttacggacatagccgctgcaaaaatctatcaaacaataataaagggatagctacttgcatgctaatttaccattgtatagaagggagaacaggcatcagattgttttcgtcaaataaaagcaaaaccaagatttatgaagaaaagaggaaagaggaaaaaaaatcgcctgggacctttgtgattttgctccccttggataagagacttgacagaaagctttcaaagaggtcactgtggcctgtcttcttgagacacacgacacttgttcaccacggaaaacaattacagatgttggaggactttaaaatatcctagtttagcagttcatcctatgccacagaatctgtgtgtgatgtccaccatgtccttctgtggtacaccccttcagttaagccaggagggtgcctctcccctcagtggaatatcatacatcaatgtgtagaaagtttgttgtgctggcaagtaaatgacaaaagggacattgatagaattaggaaacaaattggaatatgatctgttaccgttcccatggaagataaatttgcagaatatactcaaattagaagcattaaataaatgctgtaatttaaaatggcacatcccattctctacactacagaaatatctgcaggagtgaccaaagatatgtgtacaactatggtagagattgcagcatcagttataatcctaaaaccatgaaacccaccttatttcaaaaacatcttgaaaagggttaaataaatcacgcacaaactgaggaagaaatgctgttttcacaaacaatggtgaggctcaccatgaggatgactgattccacactgttcacatttgatagagcaatcagttcacctcctgagttcaagcgctcctcctacctcagcctttcaaagagctggaactacaggcgggtgtcaacacgttcggataacttttgcatttttttggtagagatggggtttcgccatgttggccaggctggtcttgaacccctgggctcaagcaatccgcccaccccagcctcccaaagtgctggaatcacaggtgtgagccactatgcccagccagattttatttttctctgaaaagatggtacatttacatggttcaaaattcagatagggccaggcgtgagccctggagttcgagaccagcctgggcaaaagagagccctgtctctactttaaaaaaaaaaaaaaaaaaaaaaattcaaatagtacagaaaattataaagttaaaataggcatctcttatattcctgtctcccaatctcaccctgtaggcaatctgtgggatgctgttcccgtgactccttccagggatattttagatcaagtcttcctcttgtcgcccaggctggagtgcaatggcatgatcttggcttactgcaacctccacctctcaagttcaagtaattctcctgcctcagcctcccagatagctatgattacaggtgcccaccatcatgcctggctaatttttgtatttttagtagagatggggtttcaccatgttggccagactggtctagaactcctgacctcaggtcatctgcctgcctcagcctcccaaagtgctgggattacaggtgtgacctccatactcggcctttttatttatttattttttgagatggaatcttgctctgtcacccttgcgggagtgcagtggcacaatctcagctcactgcaacctcagcctcccaagttcaagcgattctcctgcctcagcctctctagtagctaggactacaggcgtgtgccaccacacccggcctcccttcccatttttttaatgccaaagagaacatattatatatacactttgttctgtaccttgctacctgtccttgatagtttggggaccatcccttatcccttatcaatatataaagagcttctttttcattgttttccccagagatctagtattccaccagatatgcctaaatttatataatccatcccttactgatgggccttgtagcaggtagacatagtgggtgaactgtgtctcccaaaaaagtatgttcaagtcctaacccccgacacctgtgaatgtgatcttatttggaaatagggcatttgcagataatatcctcctggatttagggtggggcctaaatccaatgatgggcatcctaataaggaaaggagaggacacacatggaaacacagggaggaggcagagattggcgtgatgctgccacacaccaaggaatgctcggggccaccagaagcctgaagtggcaaggattctggcctagaccctctggaaggagcatggccctactggcatcttgatttcagatgtccagcctctagaactgggagagaataaatacattcaggtggtttaaagcacccagtgtgtggtcacttgttacagcagccctagcaagctaatacacaggtagacttgttttgagacgaagtcttgctttgttgccaggctggagtgcagtggcacaatctcggctcactgcaacctctgcctcctgggttcaagtgattctcctgcctcagccccccgagtagctgggactacaggcgcattccaccacgcccagctaatttttagaagaggcggggtttcaccttgttggcccggatggtcttcatctgttggcctcgtgatcggcccacctcagcctctcagagtgctgggattacaggcgtgagccactgcaccccggccaggtagacttctaagatggctctcaatgatccttgcctcctggtatccacaccctccacttagtgcggacaggacttgtgacttctactctgaagacccagccaagggatgggatcatttctggaattaaaactatgactgctatcttgccacaatcacgtttgctggcttcaatgaagcaactgcaaagatgtgaactatgcagaggcctacgtggaaagaaaatgagagtgacctctgtccaacagccacgaggaacagaatcatgcccaaaaccacgtgagcgagcttggaagcaaacgctttccctgctgggccttaagatgacagtgcggcctcgactgacaccttgactgcagcctgtgagaggcctgtgacccagctgagctgcaccagattcctgaccacagaagcggagatgacaaatgcaggtcattttgggcgggtgtggtggctcatgcctgtaatcccagcactttgggaggctgaggtaggcggatcacctgaggtcaggagtttgagaccagcctggccaacaggatgaaaccttgtctctactaaaaatacaaaaattagccaggcatggtggcggaagcctgtaatcccagctacttgggaggctgaggcaggagaatcgcttaaacctgggaggtggaggttgcagtgagctaagattgcaccattgcactctagcctgggcaacaagagtgaaaatctgtctcaaaaaaaaataaaaatacaaataaataaagtacctacttacaggctttgtatggttggctaaaaaaaaaaaaaaaaaaaaaagaaaaaaaaaaaaaaacagtatctgtctacattcaagctgcggtgaggaaaaattggtcttttccctactccagtccactcagtccacagagcatggtatctttctcactcccagctcatagaaatcgacaactattaagcacctactgtgtgcccatgatgcatttcagtagctttcaatcaccaatggaataaagccccacccttcgcctgtcattcctacttgccacggctttcgtaagccatgtggagggaatgggacttttcatatattaagggggtcttatgtgccaggctttgcagggagcactgctccaaagaagtagccaccctgactaaaagcatggatgctggagccagactgcctgggttcaaatcccagctctgccacttaccaaccatgtgactttgaacaaattatataatttctctgcatttctcattttcgaaacagggatgagtactgctataaacatttgtgtccacccccacctccaaattcatactgaaacctaacccctagtatgatggtatttggaggtgagttctttggaaggtaattatgtcataagcgtagagccctcacaaacagtattgcccttataaggaagccccagccaggtgtggtggctcacgcctataatcccagcactttgggaggctgaggcaggtggatcatgaggtcaggagtttgagaccagcctggccaataaggcaaaacaccatcttgactaaaaatacaaaaattagctgggcgtggtggcatgtgcctgtagtcccagctacttgggaggctaaggcaggagaattgcttgaacccaacaggcagaggttatagtgagccaagatcacactccagcctgggcaataagagcaaaactatctttaaaaaaaaaaaaggcagtgccattcccatgtggtggctcatgcctttaagcccagcactttgggcggccaaagcaggaggatcacttgaggccaggagtttgagatcagcctggtcaatatagcaagactccatctcttaaaaaaaaaaaaaaaaaaaaaaaaaagtccccagagtactctattgccccttctaccatgtgaggttacagcaaaaagacggcctcaccagacaccgaatctgctggtgccttggacttcccagcctccagaactgtgagcaaaaaatttcttttgtttataaactacccaggctatgttattctgtcatagtcccaaatagactaaaacaagtacttactggccaggtgcggtggctcacacttgtaatcccagcattttaggaggccaaggcaggctgatcacttgaggtcaggaatttgagaccagcctggccaacatgatgaaaccccgtctctactaaaaatcaaaaaaattagccggaagtactggcacacgtctgtaatcacaactactcggaggctgaggcagaagaactgcttgaacgcaggaggcagaggttgcagtgagctgagatcatgccactgcattccagcctgggccacagagcgagactgtctcaaaacacaaaaaaaacaagtccttacctcatggggttgtagagatgatgcaatgagttttataagtgcatagaatagtgcctagcagagagttaagcattactttagcaataaacaataagcattacttaaaggcaacaggaaggcccaaaggagcatcataagggacctcccaaggccctacagctattaagtctatccagattctctcttttccacactgattcccacctcaaacacactttgctaacctttgtgttggttatctattgctgcataaccttaccagaaacttagcgacttaacacaatacatttaccatctgttcctatgggacagtctgggcacagcttagctggtcctctgcaaggctgcagtcagtgttggtcaggcctggggtctcacctgaaggcttacctgggagtgatcagcctccaagcttgtgtggttgctggcagcatttgctttcttgcagactgctggactgagcttcagtttcttgttggctgtcagaggctacctcagttcctagccacctgaccctctcccaagggcagctcacacaacatgacagcttccttcttcaaagccagcaagagaatttctcagcaaggcagatgttgcagtcttacataaggcaaccatgaaaataacatcttgtcacctttgtggcactctactggttagcagtcacaggtctaggccatctcaaggggcagggagtacataaggctgtgaacagcaggtggggatcacagtgaccacctgggagtctatctgccacacctcccagtgcatccaaattctgttgtgcagagggcaagtgaggtctagcataccccccaagaaagcagccatcttctaccatccacccaccagtttgtaaactccagtcaggggtgtaattgaagtgatgcctggtttgggattgagttttcctggagattctggtcctgtaatgagttttttccagctgggattccagttagtgatggacagcatcaagctgtcccttgctcctggccccagaccccacaaggtgcttttcaggctagattcctgagggctgtgtcatcagctgtgccacctcctcctccctaccatgatgaactgttctgggtacttacctgactccagagaaaggtcattaaggtcaaacaatgcaatgtgcatctgctagtgcctcatccgagtgacgctcaggtgaaggaacagcctgtggccacacgtctaaccaggggatagcctagatcctaaggccaggtctgtctccacaatccaagtgctgatcttcaatggtacatactttttttttttttccttttgagacagtcttgctctgttgcccaggctagagtacagtggcatgatctcagctcactgcaacctccacttcctggaggcaattctcatgcctcagcttctcaagtagctgggattacaggcgtgcgccaccatgcctggctaattgttgtatttttagtagacggggtttcaccatgttcgccaggctggtctcgaactcctaacctcaagtaagccacccacttcggcctcccaaagtgctgggattgtgggcatgagccaccacacccagccatggtacacacttctaataaagcttcctctacatctaagctttctgatttccaccctccaagtacttaaaactgactcgatgtgaagtaatgctatgtgaaatcgacataaaaaagttactgctcccgaagatcctttaatgcaatctccttacccttaattcaatgggcaagagaatcttcaattttcattttctttctcctctctacagtttcttaatcagagtggctatttccataacaataaaaactgcttcttacagaatcctcaggcaaaagaagtgttgtggctttttttcatttttaattcttttagagaattctctagggtctcactgctgcctagactggagtgcgaggccgtgatcatagctcactgcagcctcaaactcctgggctcaagcaattctcccacctcagcctcgcaagtagttaggattccaagcatgcaccaccaccacactaatttttttttttt

SEQ ID NO: 5178 - DNA, 2132 bp, Homo sapiens
agacacagtctcgctctgtctcttaggcatgatcttggctcactgcaacctccacctcctgggttcaagtgattcttctgcctcagtctcccaagtcaaacaggatttatgcatcatccatcattttttacgtctgagccaccaagtatttatcagtgggtgagttcttgtctgaagggcgaaggaatgccgccttatccttacctccctggaatctgtgaaagaagcagacttgtagtcttgagtattgcactgtacatacttggtgatgagagctcagtttctgatgaatcctcacagtatttaaccagaataactgtagccccccagaagttgcaagcagaacaagaggaaaacaggtttagtttcaggcattctacgtctgtttctagtctagctgaaagattggttggctggatgactaatgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaacgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaataatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcct

SEQ ID NO: 5179 - DNA, 3010 bp, Homo sapiens
agtgtccgcaggcctcggcccgcaaacggacatgcgtcccccagaggaaggaagggtgtggaggggaaaacgaaggtgccctgatggggagataacggggctagaattccaaggccccctctctctgataccaggttctccagggagacagatctgggcttctcagcagaggccgcagctgctcagacttggtctctggaacctactgcgccactccctgcctcacttcccatgaaccagaaggtggctcctgcccgctggccagaaacagagacctttcacaaagaccaggctctcctcctctccacggatgaagacagctttcccagctggggtgcagccctgcactggcaaatttggcagcacagccctctcagggtcactggggaggtgagcccagtgcaatgactcacaaatgatggggtggcctctcggcctggcctgggaggtccatgagtcctgggtggacagtgatatgcccttttgctgtggttttatagatgggaaaagttctctggctgtgcctcagacctgaagccccacatggttagttatagaaagctgcaggtgccggcagccaggaaggctttgggggtgaggtcagctctttggggagcagaagatgaagatgctggctttgggaggggaggaggggttggcctacttctcactgctctatggttcaaggtctgaacacaggtcgtttgtaccaggtcacaccctgctccgatatagctcaaagtacaactgacgcctgctcaccacaccctccaactacaagggtcacacctgtgctagacccttccttctctagaaagcacccaacactcatggtgaccacaagcttggatatcctttctcttataaccatgacactggccagatccaacagcctagctggagggatgggctccgaggggctccggggtggggccaggccagtgtgtggtccctggggccggctgcttgcatctcagtccctgctcccaccatgtccctgactaggaggctgtgggcaagtggcctgtatgtgtctctgcaccttggccttctcatgagtaaaccagagggctctgggacaaggactgaagcagggacagtgggaggagccggagggcctcacctcctcaatgttgcgaatccagttccggatgttgtcgaaggacttctcgttggtgatgtcgtagaccagcatgatgccctgcgcggggagagaagacacaggtgcctgatcggctgcaggctctggaagggaggcctcagcggcaccagagaacagtggtggggagcccagcacccactgcacagccaggcccattagctgccgccctccccacctctgtggagccccggaagccagccccctcctctccatccctgtggcccttctttctgctgggttctggcaccagccttgtcctgccccccgggccgctgaggtgacccttctgcctcacaggccagcccctgccacgcactcgctgacaagcccggctggctcccctcatggcccacggggtggtgcagcctgacggtgggagccggtccacaggcccactgccagcagcactcccctcacgctgaccctcccctgcaatcggcctcctcttcaccccttgctcaccccacgctctgcctgagccacctaccaggcacaactgagcccaggaagtcctgacccgacatccacacaacttccagtgaccccaccacagagggaaccggctgtgtgaagatggagccgagagtgccaaggcccttccagttccctaacctagacgtgagcaactgggagacggctcgtgggtcctggaagagcttcggggcagccccgcctcagcctgggtccacagcctcgctactgctgtggacaagcgcaaacatgcccatgcgatgcaaggggaaactgaggcacagagacgtgacctttaagattcaagcacggggggcgggggggggctaactccaaaagcactgatgacacctatcctctcagcaatatccctgggcctttttcagccccagaacccacatgtgggggccaccctctgacggtctgtgtggttctcgatgtccttgtggagtgcccacagcgggccagcctgcagtgccatcacaagtccccctttgttgccgggcatcctgggctccaaggcacgtggcctgctcatggccaggcctggatttcttccttcctcctcgctacctgctccccaggcccagccctgcatctgtggcacctgagggcactgatgacttctgctgctggccaagttgtctggggccatccaagtttgcagaataaggacacgggccatgtggtaatggtgagacagatgtgggtgcaagagtgtgggacaaaaacgacacagatggggcaagaaagtcactgcaaccccaaatcctcctgggaattcagggacatgaataatggcctcacagtcagccgcaaccatggcgaagaacctcaaggctgcagtggcccatgatgtctgccatgccccatccacggtgggcacaccctgtgactgtgacatggtcagggacagggggcgtggggccctttatccggggactggaccctctgaaagcccaggattcctgccttcaccactaagttggtgacatgtgcctaagactcaaattcctggattatacctatttcagggagctgaggggagaacctggacgttagtggggcagtgggtagagctctctcttagaatcaagcagaagcacctggaaaacactgagccagccatcctattccaggttttcctggaaacacccctcagggctccaagtgactattttccagggccccgtctgggcaaacctcaccatgggtctctaggcatccaatgcttcccaaacttgggattttgaggcccaagggtctatgagcatgctgacagagatgaggacacagctgcaatggtggtgctgtcccatatgactgatactggctacacaaggctctagggcatcagaaacatagctgctttgaccc

SEQ ID NO: 5180 - DNA, 10985 bp, Homo sapiens
cccccgcgccgcagccggcatcgcggcgggacccggagcccggagttcgggggaggagagaggaggacgcgaatcacacccgctgctgcgcgccagcccgccccgtctgtacaatgggatgctcgggactcggacgggaggatccagtgactgcgagccccgcattcgcccgatcccagcctcacacccccagccagcccccagagaccctcccacacttacgaaggaaatgcatgcggccaggaggagaatccgcaccaggagggagctctacccaggaaaaagaagaaaaggacagattcatttggggttcagcctcatgccccccacacccaagactttgtggctaagagaatcaggccaccttgaggttcatcaagttcatcccattaaaacctcccaaaactctggatctcgggactctgttttctcagtatcttcttccccctgcgagcattggacaacggcccagctcttccttaagaaaccctgaagggagaaacgcgtgcatgcgtgtgcgtgtgttttgggggtgcaggagggcattaattaccagccgctcttccaagggacacttaccattgaggccgtatttctccagattccgcttaacttggtccggggtgaggcccgtggtctcactcaccccaaaataggccaaacattcctccgtggttttagcatgagcggcctccattgtgctcccttcctgggggccggggccggtgtgttccttccagggggttcccactcgtggggggtcttcctcagtgtgtccaactgcctgtctgcctgggtttcttctttttactctcctgccccctccaggtttttcttccctccacaaagctctgacccccgtcccacttgagcagccggccaccccccggcccccagctggtccttatgagggagcagggggaggccgggctcccccctccaccagatcagggattggctggctgagactccagcaggaggtggtcagaaaagagagatatttctgctgacagagggggaacagtggggctgcagcctgagatgtcactcatgagggacgcaaaggtagccccagccccagggaagtggggtagggagagacttcactttctgtcatctgctactgaccctgcccccccattgcctcgacttccccagctgcattgaatttcccattccaaactcatccccccagttcttcccggagccctcttccatccccggcctcacctgtccctttcctcacaccccccttcctgcctcatctgcccggagcctgtttccattgccgcagtctccttcctcctcaccccatttgctgaagcagtggcagagataccccaagcctttgggggactgatgaagggagaacatcttttgggggctagaggaagtgagtggctcctagagggacaaggggaagtgaggggagagagtcaaggggacagggccgaagatggtaaccctaccctagggaggggttgccacagccatcaacaagggatttagtgtccaggccctggtgagcaaagccagcactgcctgtctctccccaaaactgcccccccccttccccatcgctctaactcagcctctgggaacagagccctgagggcccccccatcctggatagggaatccccaccccacccccaagaaaatgggacaccaaggcagccaagtaacccaagaggctacagaatgtgctgatggcagagggggaggggtaactgtctcaggatgggggcaggggtcaccccaagtcgtgcactgagggtcacctcatcccacactgtgctctaaccaacggggtttctgtggccagccccagaggcctgtggtctgcgctgcactctgccctgctgcatctgtccacgaggggaacaggatcaggcccatgctgtgtgcgtgcaggagctaggcagaccccacagaaaggtgtcggggcctggggaagctggaccaagcaggggctccagaccaaaggaatggggaagggtggacttctggggacaggtctgggggaaataaggacagatgtctagacctagggggaaagggagcagagacacagagccaccagggtcagagggaagtccgagcagcagtggggaagagggacagcagggagccaggtgggcggggaccccggcgctgggtgcaaagccacaagttgttgctgaatgctggccttggtgtcagcttcctcagagaagcagctgctctgagctgcccctccccacccctgctccaggatgggggcgtctcttggttaccaccagggcagctgctggaggagccgagggagggtaccaggggtgcaggaaggggaggacaggcaggcagaaaggctggatgagagtcagggtgaaaggtcagtgaggggaaggggcctggtgccctgggctcaagtccgtcctctgtctaggcctgtttcctgaaatgagcagaggcatgtggacttcctaagtgtggcttcttaaggctgctttccattctggggctcaaactccgaagcagaggacagaataggagacagcagagcaaagaaaagggaggcccccacttttggggagggggatggcagcaggggtggatggaacttgagggttcagcctcccagatgcatcccttctgcctggacttgggtgaggcgcggcctcctgggtgagttgaggacaaggtgctccttcctgcctccttttcacagttccaacaaacccctcccctgaagcagaatcctgctgtgacctgaggggagtgggggacagtgggctgaattgggggtgcaggagagcattagcagcctctcttccaagagacacagcccccggcacctccacccggcccagcacccaccgtctccgctggactcaggctcacacccgccaaggcttttggcgctggccggcgtctccccaccggcacctggaggagtgacaggggctactgtcttacagcagtgggaatgcccaaacatggagaggggcagacggagagatgggcagcttcgagggagtcgagagcctgagacagagggcagggggcaggcttggcagcacattcctgccaacaggcctttaaggttattcatttctacctcccccggcttcccagagggggaaacaagccagggagggaaagccacccgccaggagctgcagaagggctgctctagggaaggctgtgggtgtgaactgccatggagggaggctgagccagaggcgccctcggggatcccttcccacaggggtctccacgcccagggatggaaagtgatcctcctgtcacacctgagggctggagctaaaagcatgggacacagagacaccctggccagtccctgatgagtgcagaacttcggtttaaccatctgtaaagaaaggcttagagggaaagtctctcaggccccaacagccaagacatgctggtctgaggagtgggtgggtgtcctcgtccccctcccctgcccatctttggaaggcaggtccctgaaggctggcagggctgggggagggggagcctcagagcaccagttgctgctggaagattaggaggggatcaggccctgcttacctcggggcaccacagccttcactggccatctcactaagaacccagcacccggctctccaaagcttcccccactttcaaggccggtcctatccccagtctcctgaggccaaggtttggggagccccagaaattagagcaagcaggagagccagcaggcttccctcggctagccccccgcctgggtggcctggaagcccagctgtctcctgtccatctccctacaggacacaaggcccagaatagcaaggtcatgagcgtgggtagggcctcctggaggtgggggctgaagctgaggggcatgagggtgtgggctccttgctgcctgggcggggagtgaggcaggatgctgaaaggcggagctggacagtggggaagggagaaggccgagctcagcgggtgggattcttcagccccaggcccctccttgttggcacccactacccccagagctgggaagcccaggggtgccctctgttggagggcacagccacagatcaggaagactgattccaagagcagagcctgtgttttacggggtggaggggtgtgccacaatgggggtggtgttataaactcaaatgcccacagggccaggccctcccagggagcaaagtgagctggtggggatggggcagatgtggaagtggacccacatcactggatcttctgatttttaagagaagccagtgatttttttttttttttttttttttttagacagagtctcgctctgttgcccaggttggagtgcaatggtgcgatcttggctcacagcaacctccacctcctgggctcaagcaattctcctaccttagcctcctgagtagctggtattacaggcgcgcaccaccacacccggctaattttttgtatttttagtagagacggggtttctccacattggtcagcctggtctcaaactcctgacctcaggtgatccacccacgtcggcctcccaaagtgctgggattacaggcgtgagccaccacacctggcctgtgatctgaatttttaatgtgaaactcaaatggacaccatgtccaggccaagcaaaccatgtcagcagctctgactcaagatgaaacttcacatgtcacagatgaggatgctcaggcccggcgtggctacaccttgcccaggccagtgagtggcaaggccaggacagaagctagtgccctctgccatccctccagcctggctttgagaagggggccattgggcccctctgcggctaccctgtgactgccacgttcaatctcttccagcacagccaccgtgcctcccatctctcactgccagctctctctagggtacaaagccataactcaggaagggccgctggagatcaccatgcctgccattcacagcactgtcccatgacaaaaactcgcaggagaccccaagagcatcatttagtgctccacgaacaaggctgtcagacacagggatggctccgaaagcacagcactgcagaatgatggggactggcctgggccagccctctggcctgtgggcactgagtgggctgccttcccaacccaactgtccccagtccccacagcaaacaatggccatagccatcacgatagaaccgagataaacctttttatttatttatgcttctccattttgtttaaaacaacaacaacaaccaccttaatgtaactgacagcccttccccctcaccctgcctcgggctgggggtagttaatggggaaatggcccccagggtggggctgaccagaagagcccctcaaggagctcatggagcccaaatcccctgccctggggaggggacctgtagtgtgtgacgggagcctctcccgagcctctgcttgtaccatcaaagatgcccttggccaacaagggtcaggaagcatgggggagggatttcggcctcctctgtccctacccagcccaatctcacgagcagggctggggggtttaaaaagggtggagcgggtggggttggctcacacgaaggagtactggttgttaatggccctggggtggcccccttcctctccatcaccccctagtggtgactgctgcagctgcaccattgggggcacccccgcgtccccaccagacccagcgccctgggcctctgagcctggggctatggcctcttccaattcaaccacggggaccagctcaaccacggggaccagctcttccgggacccctccaccgcccgctttctctttctcttgcctctctttggctgctgcggctgctgctgccgccacttctggcgccctcgacgcctcttctgccccaggctgtgggggatctgtccatgaagggggttcagggggctggggtgggtcatgggaggtggtcggttctggataggaatggtaagaaaacagactgattgtggaggcaggtgagctcctgccgtggcctccccttcactcagccccccaggagcgtggctgtctccccacatcccatctcctgagcaaccccccatccatggaagatggatcatgggcggtggtgagaggaggaccacacttacacacagtcactcgctccgaagggcatgagggtgcaggaggcatcggggtggcatccatctccctcgcacacccccgcatggctcccagcctgctcccggcctggggggaggggcaacgtggggacagatgggacggtggggcaggggaaagggagagatcagacagggacatgagacattgagggaggagggaaggggatcagaccgagtgtccccgggaagggcaggcccaaggccaggctgcgacggagggcaaagacgaggccaggatgggtccaggagacagacagacaatggaacagaggatccgatggaatggggatgcgcccgcccacctctcagctgccgccccggctccggccaggagccttctgccttcctgtgtcctatcagcgcatttctttcccttccaaaccccgaggcacaacagcctcctctaccctgctctcccaagcaaagcttctccttgtgatagtcccccctccccgccccatctttctggcacacacacctcacttcttgggtgcacgggcacctcctcccctgcagacctgctctgctcaccctgctgtcgctgggaggatgggacatagctgacaaggacaacatcactggagcctcccgactccaaagggatggggtgcacccggaagtgctcgagcatatcgaaaatggactggaaccacaggtgctggacccggcactgaccctcctcgttcagcgacaaacgcaggtgctgagggcgggatgggggaggtgaggtaggaggcaaaggccctgccaggtacaaaccccctcccccggcagtgctcccccaccccactgccaactatgcacagaacagagcctttcccacagggtggctcaccttggccttgccctggaagttgaaggtgaggacgtattcaccccgccttgtctcactctggcgcaccaggaagacaccgtgggagccagtgccgccagtcagcaccaactgtgcagccttgagccgagagagcatcccgtggaaccaaggataccctgagaggggctggtccccctcaccgccctctggctccccctggaacaggaaggacccttcaggaaggagagagggagggaaaccggggtgtcagggcagcctcccccatcctgggagaaaaaagccttgccttcccctcaaggcgcctgctccccacatgcgtccccaactcccctgggccagctccctcgggatcccaggagaggtggtcaggaaggtaggcacccaggcctggagacatgcacactcacacctccggtacctgtggctgtttccggagtgtccaagggagggtagggggctgagaggggatgaactgtccctgttgggggtccctcttcaatggggatgcgggggggcaactctgggggaagcagttccatcgagtcaaaatgggaggcggcaatggaggcagagctgggggagatggatgccgaggggcggtctgagaggcccccatatgcccctggaaaaaaaaagggcaaagctgagaacccaagaaattcctcttctaaaggactgtcctgggcccatctcctcaccagcagtctaccctgtgtgcagtcgctggccaagatgccaaacagctctgtgggtagtgacccctgatgcttttaccaatggctcctaactgatgcttcctgcgctgctgagggactgcagagttattgcaaggaggttctaaagtcccaatgtgtctccatctttttctgaatcaacagctgaaagactgttgcagaaacggagagcagaatgccttaaatatatatatacatgtttttgtagagaaggggtctcgctatataatagcccaggttggccctgagttcctggactcaagtgatctgcccacctcagctctgggattacaggcgtgagccaccgtgcccagctgcctcaaatattttgacattcaaaaggagtcctgggccaggcgcagtggctcacacctgtaatacccgcactttgggaggttgaggcaggaggatcacttgagcttaggagttcgagagcagcctgggcaacatggtgaaacaccatctctactaaaaatacaaaaattagctggacgtagtggtgcacacctgtaatcctagctacctgggaggctgaggcagaagaattgcttgaacccgggaggcagaggttgcagtgagccgagattgtttcactgcactgcagcctgggcgacagagcaagcctctgtctcaaaacacacacacacacacacacacacacacacacacacacggaattctggctgcacacagtggctcacgcctgtaatcccagccttttgggaggctgaggtgtgagaatgacttgagcccaggagttcaagaccaacttgggcaacatggtgagaccccatctcttacaaaaaataaaaaattagctaggtgtggtggtggcacacgcctgtggtcccagcaccttaagccgctgacgcaggaagatggcttgagccagggaggtcaaggctgcaggaagctgtgactgcaccactgcactccagcctgggagacataacaagaccctatctcaaaaacaaaaacacaaacaataattttttaaaaataaaaaaattaaacacacaaacaaaaaaaaaaaggtgtcctttgttgaactataggacaaagcccctaactcttaagaggcatcaaagatgctccttctattactcccccaacccacaccaacttgagctttaccttaccttgtattcatgtctcttccactttaacccaatttcccatccaatttgtccccatatcctgggccctccccgcaggtctctgctcttgcccttcacgtccccaggcatgtcctctcctctcctcggcgtcgcagtccctgtctctcccaccttcccctgctctcttcctcctgagctcccaacgtgattcctgcttgtgctgctcaggggacactaagctttctatagggagtgatgtcaacccagctgaaagcctctagagaacaaggagctcatctcaggcatcctagctaccccatcctggcccgggacacagagcagggccaggtatgcactagggccatcctccaagtctgtccaacagcaggccactgcctacacaaatgtcataggcaggcagtgctcagaagacaggcgtgtggtgcacagacagcatggcttgggaaacagggtggcgcagcccctgtcttcctcagtgaccctcaggtgtcctctccctggtcttagctactaagatctgatgagatgcaaggtccactctagatctaagattccatgattcatgtgttcattcactgaatacagcctgtgtgctaggcactgtgcagctggaactcagaacagagggtcaggagaaaaggctatagtggaggccgaatctagaaatatgagttgggactgggtgacacatctttgtgtgtttgtgtgtgtgggtcgggtatgtgtgtttggtcagaccaaaaagtacagagtcaagagaaaacgtgattgcccctgacagacacagagatgcagagtaagaacaaaacaaagatttctacaaagtgttccagaagcttggagaaaaccaccattatttccagccagagcggtggctggcaggacgctgactgaaaaagtggcgaggctgggtgcagaagcctggctaaggtttgcttggggcctgcgtggggtcatgattattctaaacagcaaactgtggctgtgttcagggatcaaagaccaacatttggtggggttggggtagggcatctggaaaacagggatgggggcacagtggcgtctggagagggcatggcgcctgacagcaggggccccgcatggcaggttccgaggctccgagctctctaaggctccacccttaccctgcgacaggcggtcattgctctcgctgggtccaagcagcaggtcctggctgggtagactctccgagtgattcaggcaggacagctccaggctgtctgtgttctcccttgtaaggaatgaggtcccaggggccagagggagggtcatggggcggggactggtagcagggcagggtctgcagagacagggaagatggtgctgggaggaaagtcaccaggtgagaggcgcaaggctgctccccaaccccactctatgtcccttagcgacagaagtcaggcttctcaccctgggctcaggcattcttggatgtcagacacccaggccttcacatgctgggcatccactgtctccatgatatactcggatggaccttccacctacagagatgagacgacgcctcagctggggcaggggcagggaggaggcttaatccatgcctaatgagaacaatgtatgcaggctgtctacaaacaagatgcattcgaattctctctggaggccgggtacagaggctcacacctgtaatcccagcacctctggaggatcacttgagcccaggagttggaccagtctgggcaacatagtgagaacctgtctctaaaaaaattgaaaaataaaataaggcgaggccgggtacgatggctcacacctgtaatcccagcactttgagaggccaaggagggtggatcacaaggtcaagagttcgagaccaacatgaccaatgtggtgaaaccctgtctctactaaaaacaaaaattagccaggcgtggtggcaggcgcctgtagtcccagctactcgagaggctgagacaggagaatcgcttgaacccgggaggcggaggttgcagtgagccaagatcatgccacttcaactccagcctgggagacagagtaaaatgccgtctcaaaaatataaaaaataaaaataaaataaaataaaataggccaggcgcagtggctcacgcctataatcccagcactttgggaggctgaggcggg

SEQ ID NO: 5181 - DNA, 2713 bp, Homo sapiens
ctagtgttcctttgtttgccagggaatgtttcgggaaggctgtggagtgggacggtggggatgaagcggggagtcccacactctctgggtccaggcacaaagctatcctccgttgttctgatctgcagagccagcgccctcagcaggtacctagtggtggcagagccgtggcctacacgttcccaaggaggccgccagccgggctgtacccttaccttgggggtgtgtgcagatggaaggtgggaagagacagaccaacaggaagtgttctcttcaggggttgccagccccaccctgaatctcagagcatcctcctccccggcaaaggccagggcactgtcccgaccatgggctctgtacaagcagagggaggcacccggaggctggtgtgagcagctacgtggggtggtggtccagggaacagagggagggcactggagccattgcctgcctagttcagtcctcaaatgggtccaagccagctcaggtctgcagcgccagcagaagcagggtcgagaaagacacactgaagtttgctagcaatttgttgaccttgctgtattaagctatgcagagtctctccactggtgtctcctctcttgttaaccaaaattaatgtaagggggagatggactaaatgattatcccgccggcccagcgtggactctctactcttctctatactttccactacataggatagcgattcctttgaattgtaaaggcagagacagccgtggggctgaaatgttggcgtctggaaagagttcacaggaagcctgacattcccctctattggcctcagggaaagctcatacattttaccatctatcacatacttgtcatcatttgtacaaagagctcgaatctcattggccaactctcgggcaaggccgtctttgcccaatataaccaagttgattctatcaatgttagggtcagagagtgaatttttctgattccggtcagacggccggataaaccgagaactaatcaagtgctcaatcttagcgtccacacaagctgggcagctggggcatgtctcctttgttgggtggtacacaaaatgaatgtgtttcagaataagggcatcacgctctgcttggagcttttgtaatgctttaaatcgctgttcctctcccagaacatcctgaataacacccatcttctccttgctgggcttagcatccagctccagttcataaaacaattctgaatattccaaaagcaactcctgaaattcttcctttgctttatctataatttgcttttggtgtttgccataaatatccatgtatacagattcctccagccactggtagaaatcctcattcataataaaactacgggcctcttcccaaggctttccgggagttatgaaaggagaagtctccaggttttctttaaacgcccttcgcatctcaactcttttcctttcgttcctcagcttctctaagtgggcctcgtatagctgctctgcagggacggtatccattaaatcaaagggaatccgttcgttttccatgttgtcaatgtgactggtggcatcccatggggtctcttcaagcacaacaaaccacttcaagaattctggcttggtttctaagagctttttggcttttatgcagcttaggtggtctatttcatctagattaggtataagagcttcaaaagctaatggcagggctgccaggtacagctttctcctacgctcgatatgctcatgcttgaggcggtggatgtgctgtagaaacagcttcttggctttctgagtcccttccaggtagacatagtcctggtattctggagaggcctgcatctttcggctgacactcagccagttctcattgtggtttttcacaatgcgactcaccagccactcatacttgtcttttgctgtagctatctgctgactctgctgcttgagagcttcaaaataaggaatgatttttgtctttccccgacttttatcaatgagttgcactaaggtgctgaaagccaagtccacgtttacattggatctcgctgaggtctccacaacctggaggttctttttgcttaaggcaaaagtatgtgcatctctaatgtaccgctcaacaccttcgtcacacttagtcaggaccaccactatgggcttttttgtttttgcaagctgattgtagagattggagacaaacttgagctggtcatcaaagttcctattcatgcccctgctaacatcaataccaagaagaaaaccatcaaccagcagctttccgtctggcatttgtttctgctcaaagtcctgctccagccccagctggtcagtgcaaaagtacatgagtttttcagctgatgcaagcttggtcgcagcagctctcttgatatagggctgcagggccgtgcttcgatgaggttgaaaagtctgatcatcaataaattcagtctgctccacaatgtgcatcttacattccacacaatcctccagggagcggctaacttctccccagtagagaaagtggtcattattgaccactcgccctccaaagtcactggtgctgaggacggaggtatggtccaagtgaaactcgtcagcactcgggcgcacgaagcggttgcacaaacaagactttccaatcccacactggcccttttccttctcggtcccagataatcccaccacactgatgttgtaggtgggaattcggacatcttgctttcttgccatcatcat

SEQ ID NO: 5182 - DNA, 3384 bp, Homo sapiens
gtttattttaaaaagttcacacaccttccccatctttgtcccagcactggttttggtgactccacccctactcccctatgagtcagcccagaatgtgaagccagtggccccagggcaggagatggccacccctcagccccaccgcagggtgaagctgggcccgaagctcctcctgtcctagggccacgctggctgcagtgaggcggcggggacggaatgtgagtgggtggagagctcctggcaggaaggccaggtagcacctctgccctcatggcactgataaggagccaggaagcagggcaggtggggcataggccgtggcagggtacctacatgtcaatcacacgtgatgggtgggcctgggtagctgcatgccagactgggcaccagactgtggcacacagctcaagggtaaccttgcatccaggcccttctgtgagagtaggatgggagggagttgcacccatctcctgtccgcccccccccaaaaatatatatgtatgtcgatatataatatagaggtatatacacctgtacataaaattgttgccaccaaccactaaatggttacactacaccaagacactaaaatggcagggagccctgggatcctggggttggcagacacagggaatagggggtagaggcccaggctaatttctcccttcacagcaaagcagggagagaaaggaaggagattcaccccttaacctgtctcagccctgggtcagaagagaagcctcccgcctggccaggcttcacctaccttagccaaattgtagccagacagacagtgccccctgacctcaaaaaaggaggtcaagctgaaatggccctgaccctgaccgtgtgtccaaaaccccagcgtgagagccagggctgcttcttgacagctgctctcctctgccctgcgtggcactgaaccaggagtaagggcttctctgttctagcctcccagggaagggaaaaagcaggggctgtgattgtcaagactcacaaccatgtggagaggccgaatcacgcaggagagccacgcattggagtaccctggctcccagccccttccccaccccgtcttgagccagagagctacaagcaggaatcccagtgcagctgcaaatcatggccatcgaggaagtctgtggagaagaggctgggggctgtggtgctgaggggggctaggctcagcacgggaccacctgacgacagctccagccagtccatgctgtccaggtggccatcagccaggtccaggcccatggtgctgctgggctcaggaacaaagtgcaattccgaggtgtccatgggtgacggggggtggtccaggatggcagtgctgctcagcatctggctatggaggtcgtcaatgagggaaaggggctctggcccgtcatgcccactggtcagcaggggcagccccgtgctgctctccaggaagtcctccaggcgtccagggagggagggtgagcctggaggaggtggggcagcctgggggagctcagcagaaggtgatggctgtgctgccaggggggacccacagactgtcttcggggatggcttctccttccctggcagggatggcggctccttgaaatctgctgaaatttctgccaatcaatcaagagagtaaatggatatcagaagccaagcctgtatatctacatgcaaaagaatgaaggtggaccccccaacgtcacaccatttacaaaaataaaacggatcaaagacttacttaaatgtaagagctaagactataaaactctttaaaaatatttgcaaatcacatatttgataaagaagtgatatccggaatacacagagaacttctaaaactcaacaacaaaaaaccaaacttgactcaagaataggtaaaagaaagatttgaacagacatttttccaaagatgatatacaaatggccaacagcacatgaaaagagctcaatatcactagtcatgagggagaccacagtgagatacacctcaaacccactggagtggctactgtaaaattaaatttttaagaaagtattggtgaggatacagagaaactggagcccttgtgccctgtggtagaaatgcaaaatggtgcagctgctatgaaaaacagtatggaggttcctccaacacttacttacttaaaaatagaattaccatatgatctagcaattccactgctgggcatatacccaaaagaattggaagcagggtctcaggtatttgtacacaggtgttgataagtgcattcacaacagtagaatgtggaagcaacctatgtccatcaatggatgaaggaagtgatactatgcttagtgcaacagcctgtcacaaaagacaattcatgattgcacttagtcaaaatcatagagacagaaagtagaatggcagttgctacaggctggcggaagggccaaatgggaagttactgtttaatggggatagtttcagttttacgagatcaaaagaaagggagatggatggcagtgatggctgtacacattatgaatgtatttaataccactgaaccatacacttaaaaatggttagttacaatgggctgggtgcagtggctcacgtctgtaatcccagccgatttatcacaatttttaaaaaatcaaaaaaaatgtgcaaaggacttggccattctccaatagaagatacacaaatggtcaggcagcacatgaaaagatgttccacgtcactaaatgacagaaatgcaaactaagataccacttcacacccattaggatggcttgtatcaaaaaattgaaaataagaagtgctggtgaggaggtgaagaaactggaacccttgtgcattgctagtgtgaatgtaaaacgttacagctgcagtggacacagtttagtgattcctcaaaaagttaaacacagaagttaccatatgaggcggggtgcgttggctcatgcgtgtaatcctatcactttgggactacaggcgcctgccaccatgcccggctaatttttttgtatttttagtaaagacgggcgtggtggcgggtgcctgtagtcccagctactcgggaggctgaggcaggataatggcgtgaacccaggaggcggagcttgcagtgagccgagatagcgccactgcactccagcctgggcaacaaagcgagactccgtctcaaaaaaaaaaattaaagatagaattaccatatgatccagcaaatttacttctgggtatgtatccaaaagaattaaaaggagagagctacacatccattttcatagcactattcacaacagccaaaagatggaagcaacttaagtgcctattaacagatgaatggataaacagaatgtgatatatacatataatggaatattattcagtcataaaaaagtaaggaagtcatgtcacatgct

SEQ ID NO: 5183 - DNA, 9358 bp, Homo sapiens
gacacacaaggaatggagaggaaagaatgccatcagaagaatatcttcagagaattgcacaataaagagtaatgttatgaagaagacttgagcaggcagtccagagctgatacagctgctccaatcaccagagatgcaatctcctgctagatgtcttcacatctacctttctatgtcacatgtgcaagatggttgctctgccttcagacatcacatttacattccaggcagaaaggagaaggaaagagcaaaagatgtgttccgaacaaatccatcttaaaaacaaacaaggggaggggtagcaggagaaaatttaaaaagaagaagaagaaaaacaaaaacaggaaagccgttgtttccctaaaagccccatcaagccgacttctaccggtgactcattacccagtcatgtggccacccctggattcaaggcagtctgaggaggtgagtgtttcaaagaggcacatggatgccacagacaaaatcaagtttccatggttgaaggagaagaggacgatagagtttggggaggcagcaggctacgtctgccacagaagatataaagatatggagccacacgagaagatgggggaggctgccaaaaaagtccactgggtacaggtgaggagcaggtgacattggagttgctccatctgaggagcccgcacctgcaatggcttgtgctcctgctcctgtgggtataggcacaaggctgatgccgagagagtgagttgtttctgttggggttcagaacacaataccccaaagtatggcgatgagtacttaactaaaggacattggaaggcctcagaagcagcctcagatccaaggtccctctgacctgctcctgccctcctgtctctctcgtccctcgttctcccctgaagtgagtcatagaaaccagaatcctcttccccacggtaggtcctagaaactagaaccctttttccccgaagcaaaagccataaaaactggaattattactctaaactctccttgactttttgtccagaagatggccataaagaaattctcagctaggtgtggtggctcgtatctgtaatcccagcactttgagaggccaaggtgggaggatcacttgaggccaggagtttgagatcggcctgggcaacatagtaagacccccatctctacaaaacttttttttttaaacttacctaagcgtggtggtacacctgtagtctcagctacttaggaggctgaggtgggagggaccctgctctggctgtgactgctttatcacagggagtgcctatctgtgggctgctttctacacattaaagcattttcagaaagggccaacatcagccttggaaaaaaggaggaagagccacggagagtctccctttatcttccccttatgtgatgtgagagtgcacatgactgtgtgcacatacacacacacacacacaccacacacacacaccccacaggcacacagggtcaagaacatgctgggcagagcttaagccactgaatgtttcagtaggaatcatgatatctaaaaataggacagctgataagggggttcttactactcacagttcctggaattatatgcaattgcatcttggaaactcaacaaataaacagttagtatggaattaaggaattaagtttggtgaagttcaaagaagctgatgttactcacaagagtaaatagagaggaaaccgggcgtggtggcttcacgcctgtaattctagcactttgggaggccaagacgagcagatcacttgaggtagagagtttgagaccagcctggccaacatgatgaaaccctgttctctactaaaaatacaaaaattagctgggtgtggtggcaggcacctgcaatcccagctacatgggaggctgaggcaggagaatcgcttgaacccaggagacaggggttgcagtgagccaagatcacaccactgcactccagcctgggcgacagagcaagactccctctcaggaaagaaaaaaaaaaaaaaagtaaatagagaggaaagcacaggccagggtaaagagctccatgtagggctgggcgcggtggctcacgcctgcggtcccagcactttgggaggccgaggcgggcggatcacaaggtcatgagatcgagaccatcctagctaacatggtgaaaccccgtctctactaaaaatacaaaaattagccgggggtggtgggcgcctgtagtcccagctactcgggaggctgaggcaggagaatggtgtgaatccaggaggtggagcttgcagtgagccgagatcacaccactgcactccaacttgggcaacagagtaagactccacctcaaaaaaaaaaaaaaaaagagctccatgtatgattcgtgtataatgctgcgggcatttggagtgcagccaacagcccccttgcagagacccagtgttcattgtcccttccttcttctagcagaaccccaattttattttgtttagcaaagttctatgctttaaatttttttttgcctcaaactgccatgcaggtaggagtggtggtgtggcatagggctggccaatgagatgttagcctaagtcatgtaaaggggactttcagaaaagttcttttctaggactgactcaactggcatgggccccctttgccttttactctcccacttcctccagcctgaaacaaaaccatgatggtctgaactccagccatcaactggagagcacttaatcactttttcagtaaatacatgccaggccctgttttcagttctaggaacttaccataaagaaaacagataaaaatctctggcttcaaggagcttacagtctagtgagaggaaacaaattataagcaaacaaatatatagtatttcagaatatggtaagtgttaaggaaaataaattaagaaatgagattcttattatctttagggacactctcactccatctccttctgttgcccacactagagtgcagtggtgcgatcatagctcactgtaacctcaaacacctgggctcaagtgatcctcctgccacagcctcctgagtagctgggactacaggtgtataccactacatctggctaattttttttttattttttatttttgtagagacggagtcttgctacattccccaggctggtctcaagctcctggcctcaagtgatcttcctatcctaacctcacaaggggctgggattataggtgtgagccaccacaccacccagaaatgagattctttttatttttgtttgtttgtttgtttgttttgagacagagtctcactctgtcacccaggctggagtgcaggggcacattctcggctcactgcagcctccacctccaggttcaagtgattttcgtgcctcagcctcccaagtagctggagttacaggaatatgccactacacccagctatttttttttttttttttttttttagtagagacaggatttcactatgttggccgggctagtctcaaactcctgacctcaagtgatctgccagccttggcttcccaaagtgtagggattataggcgtgagccactgcaccccgcccagaaatgagattcctgatgctcgatcaagtcagggtggtggctcagaaggctggatggacctgggggttgtaaaggtagccagggtttgttttaatcaggtgtggcaagacgtgcagacacaggaatcactttcatggaggaagacatttactcacagttccctagaaacatgcatgaggcatggcatggcgtgcaggggtgccccatggggaagcacctgagtcagtcaggaggcagtgggagtgaaaggaaaatgtgggcaagagcctttattgtggtttcacaggcaggagtgtgcaggcaggtaagcaagttcaggctcggctagtttgaataatttcagcagcctctggggcataggggctgtccctagctctctagtactggtcctgggctgactaggggaattgcagctaggagtggcagagcctgatgaaggtggtggttgggaggatggggtctagcttggttgatctacatatgacaggcgagttctttgcttctaggaattagctcaacctgggagaggcagtcactccagggtcagcaagaccccacgatgtggaagtatcagaatatagaaactagaaaacatggttaattacactaggttcttgccaatattgctatgctattaggatccctgctctcacctctagatttattctaaatgcagaaaaattaaactctcaattttttatgccactgtttttcaggtttctattactggttaggtgaatgccaggcctgtactgataatgatcctaaagaagactcctctttcatacggcctagtaaccgattctcagatcttatccatataaataggctgttagtcaaacaagaaaaatagcaagataagtaacagatccttcacagagtaactactctcatctatgtgcgtgcacacacacacaaacacacacactagtgcgaaaataaaatgatttttcacagactttttctgaagattgaagatttcaaaacagtctgaaaaaaagtttcaaaagtggtcctgaagttagctttacatcaatgcattaaatattaacttttttttttttttgagatggagtctcactccgtcacccaggctggagtgcagtgatgccatctcggctcactgcaactcctgtctcccgggttcaagtgattctgctgcctcagcctcccaagtagctaggattacaggcatgcaccaccatgcctggctaatatttttgtatttttagtagagatggtgtttcaccatgttggccaggctggtctcgaactcctgacctcaagtgatccacccgctttggcctcccaaagtgctgggattacaggcgtgagccactgtgcccggcctaaatattaaccttatatgaacaaaaagagaaacgaggatatatggagagagtaaaagagaagtgaggcacggtgagaaattgggaagggagacctgagcctttgtctatagcgaaggttgaaaattcagccacctgcaggggcaaagcagaaaatgcaaatgaggtagcaggcttgggataagaaagacctggctcttgttctctgttttcccttttttcagtaaagatataggtagaaactaaaatttgtctgctagaggaaaaaataactactcaagctaaataataaatgccaattggcactttccctcagtgttaaggaggccaggaggcatggagtgggcactggtgaacagagtggggcagccaccgcccagctccatcaactgttactagcaatcggtgtaggtcgcatgatgccagatagcctgatttttttttaagctgtaaaactgggatttctgtttagagaccgggtctcaccccagtctggagtgcaatggcactatcataaaacactgcagcctggaactcctgggctgaaacaatcctccctcctcagcctctcaaattaaattgtaggtgtgaaccaccacacccagctgatttttattattttttgtaaagacagggtctcactgtgttgcccatgttgcccaggataaaatctggatttttatgtgaaatctccaattcttaattgttgagattgaagactttttttcttctttttttttggagccagggtcttgctctgtcacccaagctggagtgcagtagcacaatcaaagttttctacagccttgacctcctgggctcaagcagtcctcccagctcagcctccccagaagctgactacagactacaggtgtgtagcatcatgcctggctaatttttgtattttttataaagacggggtcctactgtgttgcccaggctggtcccaaactcctgggctcaagcaatcctcccaactcggcctcccaaagtgctggagttacacgcatgagccactgctcccagttcctgaagacaatattttggataaacgttctcttagcaaattatatgtttctgcagagcagatactcaggcagtaggccatcggtttgcacttctattatgctgaacaaatgagataggaagctgttgcaaagaaaggaaggggaaaagcaaggggctagctgacagtaagaaagactgggagacggacaaggagagacccaaggtgatgggatgaaaaaagaagaaaaaaaaatattgatgaatgcgattgagaagagattgggggccggatgcagtggctcacgcctataatcccagcaggcgtgaggccaaggcaggcggatcacctggggtcaggaattcgagaccagcctggccaacatggcaaaaccccatctctactaaaaatagaaaaaaaaagccaggcatggtggcatgtgcctgtagtcccagctacttgggaggctgaggcacgagaatcacttgaacccggacggcggcggaggttgcagtgagcggagattacgccactgcactccagcctgggtgatagagtgagactccatctcaattaaaaaaagaagaagagattgagaaagaatgaagaagagaggaagaaaacactggggctcagaaaacaataccccaaagtgtggcactttggcatgctgaatactttgaactaaaggacattgggaagactcagaagcagcctcgaaaccaagatccctctgaccttctgcccctcctgtctctcgcccctcattctctcctgaagtgagccacagaagccagaattagtcctccctaaggtcatagaaaccagaacccctgttccccaaagccagccataaaaactagaattatttcttctactgcttcctaagacatgaccataaataaatagtctgacctacgcttgtctaatggtgggccataatgagaggtgacagcgtgctggcagtcctcagagccctcgcttgctcttgccacctcctctacctgggctcccactttggcggcatttgacgagcccttcagcccaccactgcactgtgggaacccctttctgggctggccaaggctggagcccactccctcagcttgcagggaggtgtggagggagaggtgcgagcgggaaccggggctgcgagcggcgcttgggcgccagcgggagttccgggtgggcgtgggcttggagggccccgcactcagagcagccggccagccctgccggccccgggcaatgagggacttagcacccgggccagtggctgcagagggtgtactgggtcgcccagcagtgccagcccaccggcggtgcgctcgatttctcaccgagccttagctgccttcccgcggggcagggctcgggacctgcagcccgccatgcctgagcctcccacccactcaaagggctcctgtgcggcccgagcctccccgacgagcaccaccccctgctccacgacgcccagtcccatcgaccacccaagggctgaggagtgcaagcacacggcacaggactggcaggcagctccacctgcagccccagtgtggggtccactaggtgaagccagctgggctcctgagtctggtgaggatgtggagagtctttatgtctagctcagggattgtaaatacaccaatcagcaccctgtgtttagctcaaggcttgtgagtgcaccagtccacactctgtatctagttgctctggtggagccttggagaacctgtgtgtccaaactctgtatctaactaatctgatggggacgtggagaacctttgtatctagcgcaaggattgtaaacgcaccaatcagcaccctgacaaaacaggccactcggctctaccaatcagcaggatgtgggtggggccagataagagaataaaagcaggctgcccgaaccagcattggcaacccgcttgggtccctttccagactgtggaaggtttgttcttttgctctttgcaataagtcttgctgctgttcacttttttgggtccatgctgcttttataagttgtaacacttactgcgaagatctgcagcttcactcctgagccagcaagaccatgaacctaccagaaggaagaaactccgaacacatctgaacatcagaaaggacagactccagaagcgccaccttaagggctataacactcaccgcgagggtctgtggcttcgttcttgaagtcagtgaaaccaagaacccaccatttctggacacaataagatcctcattccagaggggtccagtcccatacctggctggcagaaatgctacaacatagaggccgagaagaatccggacagacaggcattgctggattcctccaggagatcataccctttctgtcccataatgcttccacatgaccatccattcttcatcaactctaagcataaaaaatgagaattttccctgtgggtcttaattcttttctttttcctttttttttttttttttttttgagacggagtcttgctctgtcgcccaggctgcagtgtggcagtgtgatctcagctcactgcaacctctgcctcctgtgttcaagcaattctcctgcctcagcctcatgagtagctgggactacaggtgcatgccaccacacccagctaaattttttttttttttagtagagacaggatcttaccatattggacaggctggtcttgaactcctgacctcaagtgatctgcccacctcggcctcccaaactgctgggattacaggcatgagccgccacatccggcccctgtgggtcttcattctaaaggccaccgtgacacataaaacttggattcaataaatgtttttctctcattaacctgtcttttgttagaggaccgtggccgagactttcatgatggagagaaaaggtatcacagaaaaggtatgcccttttctgcttctaaaagggcaaggaagatggagaagaaagtgagaaaaaggagatttgaagagagaggaggaagtgggctgctataggtagagggtggagatttaaagtcattctacagaaagagacaggaatatgcaggcactgtggagagaacagtggctctatatggtgaaagggaagcccacaagttttccagcctttgggattctgtgctattataatttatatataggttttagtccatggttcctggcttataattcccattgcccttgttaccatctgttgttgtaatgttgggtgctttaagcctcagaagcaggtctcaataaacggaatctctctgaccttctcctgccctcatttcatctgctcctttatctctccaaggcaggaatctttgcccatctttctgtctttgacctaccttgtctgactataggtcataagactcccatttcagaaaggatgccccatatcctggaggaagaaaggctgcacagagaggccaagaagaatctggacaggactcactgggtttccccagtctgtct

SEQ ID NO: 5184 - DNA, 19914 bp, Homo sapiens
ggatcaggcggaagccggggcccggggctgggcttcgtgtcctgcgttccgggagcgccaacccctccagagtctcactctttgcccaggctggagtgcagtggcgagatctcggctcactgcagcctcaacctcccaaggctcaaacgatcctctcgcctcagccttctgagtagctgggatcacaggtacgtgccaccacgcctggcttattgtttaatttgttgtagagatggggtttcgccatgttactcaggctggtctcaaagtcctgggctcaagtaatcctcccgccttggcctcccaaactgttgggattacagacatcaacctccacacctggcctataacttttaatataaagagtagcagtggctgttgtgtgttggtacatgttatgtgcccatccagtcctcatgtccaaaactcatgtttgaaaaacattcaaaactcatgtccaaggtcacatctggcagtctggctctgaagctacagtgtcttggagccctgctggtgcctggcatgtagtaggcactgaccattgttgatgatgaataaagtgattctgctttgaggggcccttgccaatatcaggacatgttgtttgggggagcactggggctgtagtttcttttgcctttacccctatggtcctagaccccatgaggcaggggaactcagatttttccccccattttttctccttctttaccttctcccttcttttccatcctgttcatcatccatctatccatccatctaaatacctgcattcacctatctaccaatccactgagttttcttttcctttcctacacacacacacacacacacacacacacacacacacacacacacaagactgtgagccctagggttgtagagatgagcaaatcagacaagcatggagggatggttgcaaacactggcttcttgcagtgaccccagcttcagggcaggcaatcctttgtagtttttccctgagcaccccctaattttcttctctactcccagtcctggggccctcacctgccagctgctggggtgtcttgcctgtcaagctgccccaggagaaagaaagaggttggaaaggtctttgcatctgttgcatagaaatgccagggctagccaggctttaccccaaacccagcacccgaggcctggcctccggtccctgccttcacctctgagacccagcatctggacctgactcggctggatgggcagcttcacaaggccctgggtttctcttgccctcctcatggtgtgtgcagcctttgtggccatggctgctgctggctccatctgggtcagccaggcagtatgcagctgcagcctccctttctgcatcctgccagcctgctcctttgctggatctcatgtgagcagcctttgagggtgctgtggaggcctcagaggcaggaaggagagagggcagagggacccagcccactcaggtactcagactccaggggacctgggaccaggcctgtgggtatacagttccacctcctcccaggatcctccataggaagctgtaccacagccctctatgcaggggattctggggaaaggggtagggcagtgattccccccaccctgggtgagggaaaaggaccctcctccagccctggtcacctgtttgttttctgtgatgactcggatctcttggtcttctgccctctgcaaattactcctaaaactcaacagtaaggccaggcatggtgctcaggactgtaatcccggcactttggatggccgaggagggaggattgcttgagcctagaagttcaaggctgcagtgagccatgatggcaccattgtactccagcctgggtgatggagaaagaacttgtctcaaaaaaacaaaaaaataaaacccctcaacagtaagaaaatgaacagcccgatttaaaaaaaaatgggcaaagccaagtgtggtggcttacatctttaatcccagcactttgggaagctgaggtgggaggatcacttgaggccaggagtttgagatcagcctgggcaacatagaaagatcccatctctacaaaaaataaaaagcttagccaggcatggtggtgcacacctttagtcccagctttttgggaagctgagacaggaggatcacttgagcccaggagttcaaggctgcaattagccatgatcgagccactgcactctgcctgggtgatagaatgaagccttgtctaaaaaaaaaaaaaaaaaaaaaaaatctaatctaaacaagcacctcaccaaagaatatatacaaatgaaagtaagcatatgaaaaaatgttcaacatcatatcttatcagcaaattgcaaattaaaacaatgagatactattatgcagctattcagataccaaaatccaaaacactaccaccaccaccaaatgctggtgaggatgtggaacaataggaactgattaatcgctggtgggaatgcaaaatggtgcagccaatctggaagagagtttggcagtttcttacaaaactaaacgcacccttatcacatgatccagcaatcgtgctccttggtatttatccaaatgttttgaaaactcatatccacacaaaaacctgcacatggatgtttatggcagctttattcataattgccaaaacttggcggcaacccggatgtccttccgtaggtgaatggataaataaacagtgatacacccagacaatgcaatagtattcaccactaaaaataaatgcgctatcaagccaggaaaagacaggaggaaccttaaacatgtattaccaggtgaaagaagccaacccaaacaaactgcataccgtatgattccaaatcattctggaaaaagcaaaacagtggcaacagtaaaaggaccagttgttgacaggagttggaggggccaggtagagcacagaatttttagggcaatgaaacgactctgtatcatactacaatcaaaacccatagaacgggccgggtgtggtggctcgcgtctgtaatcccagcactttgggaggccaaggcgggtggatcacctagagtcaggagttcaagaccagcctggccaacatggtgaaaccccgtctctacaaaaatacaaaaattagatgggcatggtggcgggtgcctgtagtcccagctacttgggaggctgaggcaggagaattgctcgaacccaggaggtgaacagaggttgcagtgagctgagaccacgccattgcactccagcctgggtgacagggcacaactccgtctcaaaaacagcaacaaacccccatagaatgtagaacaccaatagtgaaccccattgtgaactgtggccttttggtgatgatgatgagtcagtgtaggtttatcagttgtaacaaatgtaccactgcaggatgtccatggcgggggaggttgtatgtgggtggggacaggggtacatgggaactctttgtactttccactcagttttgctgcaaacctaaaactgctctaaaaaataaagtctattaatttaaaaaaacctaaggaaagatgagtcctgagagtccagtgatgcttctggctcagtcccccaccgcccccaagacacctacctctgcagctcctccttgtccctccttccagtctccttcccgcttctcctgctggccctggcccattctgaactgctcaccccttcctaatcccaccctccaggccctgggcatctctctccttggcccgttcgaaagctgggcaggctcttgaagatccacaaggctgggcttttgcttagcagggaacctgaggccaggccatggcgcggcctcccattctccctcccccaggcttccctgtccacatccctgtccatccgcatactccgaatccccttccttcctttgctgccgtctctactctcccagaagccagtctatactgcctgccttctgggcctccaaggccaaaccctgggtgggaggagtgtgcatttgtgtgcatgtgtgttttttttttcttctttgagagtcttgctctgttgcccaggctggagtgcagtggtgcaatctcagctcactataacctctgcctcccggaccccagagatcctcctgcctcagcctccccagtagctgggactacagatgcatgtcaccacgcccaactaatttttgtatttttagtagagacggagtttcaccatgttagccagactggtctcgaactcctgacctcaagtgatctgctggcctctgcctcccaaagtgctgggattacaggcgtgagacaccacacccggctttgtgtgcatgtttggtacatgcgactgtcacaggcacatgtgtacatgggcatgtgtggcatgtgctgcttcctctgtgtgtgggtgctgtatgtgtgatgtgccgggcagctggtggtgtctgtgtgcacatgtctgggtgatctatggctctcctgcatttggaggtacgtctagctccagcctgtgaccctctggaggaccagttcttcggcctcattttcctccccttcaagctcctggacaccatcccttccccatgccagctcttccccatgaagagcgcaggaagaaccccctcagacccactttctcacctgcccagtccacgcccagaaggccatctcctcagatgatcccaacacatccctggcctcaggccaagaggaagcctcatttcacagtctaagaaatggaagcctcacaggacaccgaggtctccccaagaccagccacaagtctttctgctggcctagagggctggccaggagggagtgaagggaattgaccctggggagtgggcagcagaggggacgtggctggtggctggagaagctggatttgccctttgatggtggccctcttgatccccggcttgctgaagtcaaatggtcaggaggggctctgtggaaggctccagagcctcctggggtggagctttcatcatgtgttccaaactgggcaggtccatcctgctggaggaggccatggccagggaagatgcaaaggctgtgctctgaggcctggatgagcttgtttgcccagaagaggtgcttggaggtctgcgcactgatggagtgatggcaggcagacacgtggttctcctccgtgaaactccggcagtttgaattcagactccacggtctgaaggtctgtggcgtgggcagccccatgttggagtggacggactctatcttgcataccagctgcatgggttcttcaaagtcagactcctcgttcgagttggcttccgtgtccagctcagcttcaagcttgagggctgggtatagctctgactccagtaaagccggcacctgtccgatctccagttctgggtctgggtctgggtctgggtccaggtccaggtccacttggagttggggcttctgctctagcatgtctgcctccagctgaaatgtttcaactcaaagctgaggaggcaggagcgggaggtcctgcccctgaggccctccctggcaccgagtccctgccccacccctgccctgggtcctgctgtcttccccccgccccctaaccccatgcctgcctcctctcagagacctgcccggtgagggggtgtgtgtgtgggtgtacccacaccggcctggtactagggtcccaggattgtcaagggtaggggctggtggggacttagggaagagccctgccgcttgcctaccacctccccgtaagaggacactcccatttttacctcctgttcctcttgtatctggtgttgacttaagtcatctctaagacagaagaagacagagtgggtgatggggatctgtggggcttcagcgggaagggggtttctggggccctcaaagccctctgccttgtaacagaagctggcacgatgcacctcccgccgaccaccccgccaccagctcatccactcccctgctgtcccactccactgccaccaggaagtctgcggttgtattctgaaactttagtgagtttaggaagctgcttgccaactcatgccccacccccaaagaggaatccagttggttggaggtaaggcccaggaatctcatttttatcaagcactgcaggtgagctggggcaactcacttcgaggattagtgcccagaacactagtccccagcaggggagccccagagcaatgtcctcccacccacctgcccactctttcttcaagtgcctgcccacccccgccttgagcagctctgtcctcagcaagccaggcagctctgaggggtcaggtcctatcctgtccctgggtgtgccccaccacccctcagtcttcctctcatgccaggggctgagggcataaacagaagtgggaggataggcgccccacgccctccccagccttttggcctggacactggccccggggaggttttggaaatggcagaagggagggagatcctaggctgggggatcctaggctgggggtgaggtcggaggtcctggagggctcgggggaggccctacgttgattgaggatggttctcaccgcatctctgcaacctccactgaccctttgccgcagcatggaaatccatgggcacctgacaggggaaaggaggtgagggcagggagctgcagggtagaggacagtcccagagggattccggagccagcccccttttcctgcccttcttttctctcttcccggctgctattccccctcaccgtcctgccccgctctccttgttcccgagccggtcgccattcctatcctccagtcctgctccctccactctccgtctgtgccttgcctcctcggaggctcccggttccatctccatcccccaaaaccgtgactgctaacagtaccctgaacatgacagagcgcttccatagcctggtcactttacctgctttatctcactgattcaacacaaaaaattaggacaggtccatttgcccaaggtcccccagctgaacatagctgaagtgatgacttgaatgcaggcttgactcaggaaactcttaactccctgcccccaccggctactcccaggaccctgtaactgcgtggagtcccaataacgccccatgtgaacctcccccatctccccattcctgctcctctgccggcttcctctcctctctctgggtcatccatcactgactccaggccaaggcctgcaccccaggtgtgtaatctgaggtggtgctagcacctatccgacgatttatgagctcagatcaccctctgcaggggagactgactccttgggaacgtccgcaaccccaaacccctccctggaggcttgtatcttttactgcagaagctgtttcttcaccctgtgggagtgggaagcaccaggctgccctgttctctgctacccagggccatgcataggggttgatggtggggccatcatgacaaccctgccatcatgcaaggtgggtccccatcagcctggggtatggcaggaagtgacagccctggctctggctgggaagaatcgctcccaggatcatattggaaggatgagaatgtactgcggtctcttcctagagatgtagtggctggagggaggggtccttgcatggctggtcttgggattgggaccatctgcttcagcctggtcttgggggatgtatcagcagagtggccggctcaatgatctcttcagaaccctccacctccttgaccactatgcttccctggcttcctcacgtgtctctcttctccctctccaactccccctgtcccaggtcctgctgttcccccaggcttctgacctcagggcctttgctccctttacagaatttccctgggcagtttaatcaacacccacagcctcaacccctccataaacggcagctgggtatggacaggagaagaaattactgttgtgtgagcctcttaacagcactgggggctgggagaaaaagtcagacattgactcagcttgggacctcgttgcctgacttgagaatgttctattagggattcaagtgatattctgcagtatatgaaataattgaaataattttttttgaggcagggtctcactctgtcacccacgctggagtgtagtggtgtgatctcggctcactgtaacctccgcctcctgagatcaagcgattctcctgactcagcctcctgagcagctgggattataggcatgcgccacgacgcccagctcactttttgtatttttagtagagatggggtttcaccattttggccaggctgatctcaaactcctggcctcaaatgatctgcctgcctcggcctcccaaagtgctgggattacaggcatgagccaccgtgcctggccgaaataatttcaatttccagtggtttgttgctagtatacagaaatatatccatcttttgtatcctgcaactatactaaaatcttatttgttctcatagctttttttttcttttagattctatcggattttctacatagacaataatgtgtgtgagtcaagacacttttacttcttccctcccaatctggttcctcttattttctttacttgcctaattgcactggggacaatctccatacaatgttgagtaggagtgcgtgtgtacatcctcgcttcgttctgagcttaggggaaagtgtttagcctttcaccattaaggatgatgctagctgtaggtttcttcatgatgcctttcattagcttgggcatctttgtgaagtttcgtctcttagattgcttagttttaattaggaatggatgctggattttgcctaatgctttttctgcatttattgagatgatcatatggtttttctttaatatgatattatatatgttatacataacatacgttataatacattaacatatgagtaatgttatattatttgagtgataattcttttatatttttatattctgtttatggtaaaatacattgttttttttgagacagggtctcactctgttgcccaggctggagttcagtggcgcaatttcagcaacctcaacctccctgtctcaagtgatccttccacctcacctctggagtagctgggactacacgtgttcaccaccacccccagctaatttttgtattttttgtagagatgggtcttgttatattgcccaggctggtcttgaactcctgggctcaagctatccacctgccgtggcctcccaaagtgctagattataggtgtgagctaccatgcccagctataaatttattttttaaaatgttaaatcagccttgcgttactgggataaacctcatttggttgtgatatattaccctttttctatgttgttgaatctgattggctttttttcagaattttcacatgcatattcatgagggatatcggtgtataattttcttttcttgtaatgtctttgttaggttttgatagggaggatggcttcggcccgggaggcagacgttgcagtgagccgagatggtgccattgcactccagcctgggtgacagagcaagactctgtctcaaaaaaaaaaaaaaaaggagatgaggtctcagtatgttgcccaggctggtctcaaactcctgagctcaagcgatcttcccatcttggcctcccagagtgttgggattacaggcgtgagccaccatgcctggcctaatttcttacctcaaattcatatcttgtatgtccagactcttaagtgtggctgccacggttctgcctgtctgacccctgtctccctttctagtctgtcatctctccataccccactctcctcgccctattcatccttcatcctttcacccaaatgagaaacctgggtcatttgtgactcctcctccctccgcagctactgccctcctacccctgatgctgtcctcatctcccagtaccagagccagcacacacccatgacttcctaccctttggcaattcagtcttcatacctaccctatgcccagttggccacggctctcctctcacagatgaggaaacgtgtatgaggtcatgcagctattaagagcagcacacgacccaaaggcaggtctggctggctccaaactctgggatgctactcactgcactgtcttaaatctctttagtcttccagtgggaccactgcaactatgtccccctccaacctggattttcaatgacctcagagtgagcctgctacatctcacttgtctccggttacccccagactccatgtggcctcttggtctgatctctaccttcatttttcatctcttggcatccagcttcctgtccctcaccctaagccgaagctacccccagagtaccgcaggcctttctgcacccagtgcctttgcaaatgctatttcttatacctggaaagccttcttctggcaaagtcctactcatgcctgaaagcccaattcaaataatcagtgtaatcctctccatgacagacctggctgtctaatctacgttttaccttacaggcgtgagccactgcacccgacctctggtttttttttttttttttttgacagggtcttgctctgtggcccaggctggagtggcagcatcatagctcactgcaactcctgggctccagtgagcctcccagctcagcctcccaagtagctgggactacaggctcatgccgccacacctgtctaattttaaacatttcctgtagaggacaaagtctcgctatgttgcctaggctgatcttgaactcctggcctcatgtgatcctcccacctctgcctcccgaagtgttgggattgcaggcgttgagccatcatgcccacctaatttttgaccgtttttaatgctggcccatgcccttctgggagagaggatccccaaaagaaagccaccatttcagtgggggatctgacgcccctatgggaaggggagacacagggcactgggggcaaacatctttgctcattggttcagagaagagtacaaggcatcaacgaagcgctccgtaaaaatgtgctgaagactgccgctcctccctgcaaagcctcaagcatcaaggagggacaactggatgtgattttttggatctgcagttcaggataattcatgagtcgtttcctgtgcacaaggccattgctccttctgtggtctcagaaccccttcaagaaccactgactctgcagtccctactccaaggcgcgcatgcgtgtccgtgagagcacatgggtgtgcaccgcgcaggggctgaggctgggagccgtagtcaggggcaccgggtgggctttggcggcgggtcgacctgcctttcaggtgccgggggtttgggagcaggggaacgggccctgggcggattcctgaccgcccccttcgcgcccctccccctctcactttcgctttccccgcctgccccaaccctcgcccccgggcgctcggccgctcccacctgtcacccccatgcagaccgaggctctgtcctggaggcggggagcgggctggtggatgctgcctctccgcctccagtgtgctctttggctgagggactggtgggcgctggaaatattagaggcgccggtgcctgtgatgtcgccgcctctgtgacgtccccgccgcgaccccacaggcagggagccgcatttaggtttcgggcgggcggacgggggacggcccgagtgaggcgtcctccgaaggctgcgggcccgaagccagaactccttcctctccgaagacctcgggggtggggctcgcgcttccgcagcgggcctagagcgagaggcaggcggcaggtaagcctggctgtgctggacaggacttgcacccgctctgcacgccagcggctcagggctgccgcccttttcgtggtcccagggcccttccaagaaccggctaaaccaacccaagccgcgcgcacacacacttgtgcacacagggagtgtggagccagattcgataaggcaccccgtgtgccccagctccatgaccaaggaactcagcaccccgtgtgccccagctccatgaccaaggaactcagcaccccgtgtgccccagctccatgaccaaggaactcagcccacaaaggcatccctggccccatgcagggctcaggaggcagcggaaagggttaagagtccaggcctcaaggacaggaggggagggtggagggcctgtggtgtgcatccggcatccctggatggtcagggcccagaacccatccctatttcccttctggtggtagggggctgcctaacttgggcagtggcacaaagcatgcaggctttgttgtcctcctcctccacccctcagcctggcatattttggcgagggacttccctgatgccaccgggcaaggtatcttgcctaactggtctgaatgactagcccagcgttgggactagaagcagccactgggaggagtggtgggaaagcagccccactcaagggctgaaacagtccttgtccaaaacaagggggacttgaaaagatctcagcaagaaggcaaagagaggcagctgttagggtcgtgaggttcagcaggccggcaggcaagagagaggacaccgatggcctggaaacatttgtcatcaccccaaactttattgcttacaaagagttctctacaacccagactctgcagtaccaaggctgcagttctttatgtgctgggggccggggctctctccccgggagcagtctgactcaatgtggacagctggacaaaggctgtcttggcaagatgtgggaatgagcttctcccacggagtctcggcgtcccctgccccaggaggttgaggctagcagacaccccctgacgattcacagctgatttaatgctacgtgagtcctgagtagctcccctgggagaagaggctaagctggggcaatggggaagggggtgctattcttagagaaatctggaagaggtttgaggagtcacatgcatgtggacagctcaagactgtgtcccttcaccccatctcctggcttgctatgctcctacagtgtcactgccctgccctgccctgccagagggcagccatgaaagtgctttgaggtcatcagagtgcaaagtgccgtcggcagtaccctctggccaggggcagggcagggtgagtgtcagtgtgatgctgagctgtgctctggggaaccagcacgctggacactgatagtggggctggggcgccggagcgtctctctctgctgctttccttagcactgatcatgtccatccacagactgttcctgtcaggcatatcctgcatcacccttcacctttacagatgagggaactgagtgccagcgagtctggggcagtgctgggcctgaaggggctcggggcctgctgctctggggaagagtggtagccagcagcaaaggggcacatgtctggggactgagaaccacttcacttacacaccttctttggtccttggctgaaccagaggtcaactcaggacctgtgttgcaacaacctgaaaagtgtggtgtattctaccagggagccttcccagggtcaggcattcttttcccctacacccaaaaggggtgagctggccaggtgaggccaggcaaggggtttagagggcccccttaacctacgggcgggcatacctgctgacctggttctgcactgaacctgagtttgggcccttacacacttgacactctcacagcagcctggagggtgaggggccgaggggctcgcccaccccttctgacccaggctggaagctgctctcccctgtctgccagcaaatggtcactgatccaagcgggtcaggccaactcgactggagcagggcagagaagatcctgtttgtttcccgaggtaactcctgccatcctcctctgtctcttcacgtggcggagtgttttctcagcagggtggggcagggctcaggtgtgaaatcctgggaggcattctgcttgcccccaccttgctgctgcgaggccctggtcccactgctgagccgggggctggcagatccctgggaacggctgagcctgtgtttcagggcagcatcgtgcaccgagcaggaaggctgcttccggcagtgtggagccggcggtggagggcagggttagggcctgttctccagctggccatgcttgaccctccagctccaggcgaagctgccatcaggggccagtgtgcactgcaggtcgatgcccgagtctggcacctccatgtcgtagcgaacaggctgcccgtctttggtgaccaagctgaaggctgcagctgggatctaagggtggagcaaaccagtgggctgagatcatggcatagggctcaagccatgtagaaaggtaaagacatctccttccagccagaccggcagccctaagggcactgcctgtctgtcattccacgggactcagagaatcccacccggctcaagtgtaggtctggaggacctctttgtcaccactgccagccttgctttgaggccctgggaaatgctttgaggtcctgggggacgttgaaggccaattccaagtattccctagagtgccattctacttctttgaaagctttcctcctggagggtggggccagctgcattggcttctgggactctgcccgtcagagtgtacctgccccccttacctggctgctgatgccagtggcgatgtctcccactttgacccggtggaactcccggatgtgcaggtgttcaccattaagagactgtatttggactttcacacctagaaggcggacaaggtgatagtcaggagagcggctgctggctccccaaggaccagggtcctggcaggggctgggggaacgtttttgttaaaagtcactctgccctatgtagggggagcaggtctggctgtgatggagcagcagagataaaatttaggctggtctaagcacagctgcatttttttgtttttgagacagagtctcactgtgtcgccctggctggagtgcagtggcgtgatctcagttcactgcaacctttacctcccgggttcaagtgattctcctgcctcagcctctcaagtagctgggattacaggcatgcgccactatacccagctaatttttgtatttttagtagagacggggtttcaccatgttggccaggctggtctcgaacccctgacctcatgtaatccacctgccttggcctcccaaagtgctgggattacaggtgtgggccaccacacctggtcacaaagctgcatttttataagaaaaaaaaaattcaggctggaacagccctcatattatatacacctgctagttcttcctggccgtcagcacctgggatttggcctgtgcattgctaagagctggggctggctcctatggggaagtagtatttcaacttggatgcaaagcagaaaggaactgaacacaaggattcttaaattagattatgggcaatttagattgttgcctgagttgaagtggcctttggccagccatggggccctgatgccatgagtcacacttgccctggagagggccagggaactccaagctgatgatgcccttgttgtagcaaagccacatcataacctatgcaatcaagcttgaaaacgaaggaattttatgttgtctttctcatctgacctcaaatcccagagggggattccttttgctgagtttttgattaaaatgctcatgggtcctgttccttttccctttagaagagattaattgctcattttcctgactccaggtcaagagactgctctcctccccaagctaggggaaccttctgggactccatcaactgacaatgaggggataatggtccctcactgccccatcaggaaaggctcatgggtgattgggacctttgcttgaaacccaacttactggccaggaacctcaagttctgggaccaggcgccttcctccctcccactgtgccagaggaggggagacaaaatccctcaatggctgtctagctccaggcagatcagctgccacggggactgctgagcaggtgggaattggactgtaccattgaaatagcttggggtgtcggtgggccgcccccgggccagcaccatgttccagctggagcttcgagcctcggcctggctgctccaggagtgtacgcctgagctcagggtgtcccgcgagctttgagaggcctttgatgggttctgaaacaacaggattgggtacgggctcagggccctgggctccaggatccatctccggcttgggtctcatttggggaaaaggggcactgctcatgccctcagctggaggagggtaagggttgcctccatgggggacgaaggcctgcctccccattatctctggtggcaaaacacattccctaatcccagaagggtagattcccatggtttctctgactctgaaccatgaccacctcccccaacctagtgaggacccccaccagaaggaaggggtgacccccatcaccctccctttacccactacttgcacagtgtccattcactagctggacgcaaagctacttgctctgtgccagggccgggaaaaccacacccctggagccatggctccggggccacaaccgactcaccttctcactgtcatccgacagggagaggctgtcgatgctgaggcacgagagaatttgctcctgctcctccagagaaaatggctgggacaggctgttgaggaataattctgcagggaaaagtggaagatggctgtgaaagactgggaggaggctggctgtgttttcaggggttcttcctgcacagtcggtagaagctgagctgctggggaaggggctggaagaaagcccacaccgcaggtaaagagaaacaccggcctccgcgggtggcccagggccagtgctcagggccccactgcagccacggctgcccgtacctatttccagctgctgcagttcctgctccgggacggttgctttccgctctggtgagctggggtttctggcaggggctggctccagggaggacagaggtaagggttcccacatcccagactcctccttgctcaaagtcaagggaggagacttgtttggctctgggggctctggtgggagaggaggctggagcttaggggctctgcctgttgtctcctcagctggccggggccctggggcccttggcgaaagctctctcggctgggcatggagggtctggtggtaattggcttgatttggcggtggatgtcttggttctttatattctcccctccaagggctcttcagacctcccactagaaaacagagagtacaatggtgaggggaagcgtgctgtgcacagacagcggtccaggcaggagcggcctctcctgagtgcagaagggctagaggcaaacaaaggggaggacactgccccgggccaccatgggaggtggctccagagggcagcatggtggtctccacaggagacttcctcaataaaatggtcccaatatgacagggataggactggatttctgtctttgattctgtttttcttctaggtatcagtagcaaattcaaaaactacagaatcagctccagaggactttgttaacaagaaagagaagattgaaaacagccctggggctacaccaactcaagagctcccaggcaaagtggcatcctggacccaccatctctcctaccccatcctcagtcggtacttccccaggcaccgtttgttctggcatggggctagttcagccctgggaccaccctcatccttataactaccagctgtctttggtgaggtgcaagatctctctggttttctttatttcattttcattcctataatcacagccttttttgtgcccatccctcaggtgacattctattatgtttgatgtgtcatttttgatttggttgtgtccttgcaaaatgtgcgttgttttatttatcaatttatttttatttttatttttttaaagagatgaggtctcatcatgttgcccaggctggactccaactcctgggctcaagcgatccttccacctcaatcttctgagtggctgggactacagatgtgcgccaccatacctggctattgatcaatttttagtttaccaaacaggcattatgttctgggtcccattctgtgtcgggttctcttttcactcggcaccatggctttaggatccatccatgctgctctgtgaacgccgagttgctttaactgcttggtgctccatgaggcatccccttttgtgtctctgtcctcccagtgagggaccccatcgtaccctactcccctcccacaaaggaagctgtagtgcgcgtcctcaggcgtgtccccatatggatctgctggcattcgtttgtcagtgcacccaggggtagaagtccttggtctcagtctgcagacgtctgcctgagtgcagccaggtgcccccccagagtgggtagccttgtccacatgcccatcagcagcacctgaggggtcccaacagccctacatcccaccaactttctgcttttttccagtcaaatggctcttgagtgttacctggctttatttatttatttattttttgagtcgggtctctgttgcgcaggctggagtgcagtggtgcaatcatggctcactgcagcctcgaccttccaggctcaaacaatcctctcacctcctgagtagctaggactacacgcatgtgccaccatgcctggctaatttttaaatttttttgcagagaaagggtcttgctatgttgcccaggctgatcttgaactcctggcctcaagcgatcctcctgccccagcctcccaaagtgctgggattacaggtgtgagccactgctcccggcctgtctttattttgtattcttggattcctagtgagtttgagccccctctatacatcataacccttatgatactagtaaacatatattttatctttaaccccatttctggcacagaactcctaaaagccttactctccaaaatgatctctttctgtgtactaatggattgactgaaggctggcagcccctaggtagcttcaagatgggggctggtcatcagagagacataggcaggattagagggttgggactttcatcccaccatcccacgtactgggagggaagggggctaaaggttaagcggttcgccaatggccagtgatttattcaatcatgcctacgtaatgaagcctacacaaaaacccaagaagaccgggttcagagaacttctggtagctgggcacatggaggttcctggagggtgccaagccctggaagctctgtgctccctcccacatgccttgccctatgcatctcttcatttgtatcctttgtaatatcctttctaataaactggtaaatgtaaggaagtgtttctctgagttctgtgagccactccagcaaattaatcaatcccaaggagggggtcatggggtccctgacttatagccagttggtcagaagcacaggtaaacacgtgggcctgagactggcatggctagggggtgcagtcttggggatcgagccctcctgctgtgggatctgatgctacctccaggtagatagtgttggaacagaactgaattagaggacaccaagctagtgtctgctgcagaactgattgctggcttggtggggtggaaatccccacacatgtggtcacaggagtcttctgggttgattgtagttgagtgggagaatggaaaaagcacttcgagtttgcgtgtgagttttctctttcccatctcctgagcgctgcctctgggtccaggcgtggcactgtcgcaatctcccaacaaccctgaggctgctgcacccccataatccagagggggaaactaaggctctgaggggtgccttgctctggacctgcgcccacctgcctcctctgtccacctctgtcttctgccccccgggtcagccagcgtggggctcttcctaccttgctgtagtgcccggttcaccttccctcccagctccgctgcagacacgcggtggatgggctctttcctcagcccctcttggatggcctgggctgtgagaggggcgcaggagggtgggatctccctcacaggcggaggctcgctggcaatctggggggcaaaagacaacaggtgaggcctgccttccctcatttcctgatacccg

SEQ ID NO: 5185 - DNA, 759 bp, Homo sapiens
ttgggttccagagaggggagtggcggtcgggtgatggaggcagggaatctggcagcacacaggcccagtactcagcctggaaggagaggcgtctcctgcctagcccagaagcatcacccccagagaacacaggctgtggtgaccactggggccgaggtcctagccccaccacagaggaaggttcctgggggacgaccggctccagggaggaggagaccttggccagagaaccaccacgaggctccgccctctcctggtgaccctggagactgctgcctgtggaggaagcagagatgctgcagctggaaggctgagctgcggaacctgggctcagcacggacttccactgtgacaggcaagagagacctgagctgtgaggctgctggctgaggtccagtgcctggggcaaatctgctagggatggatcatcttcggtatcagcatcatgtcctgagcaaatagttgttgttctgggaaggctcagagtctgagggaactcctcggaggaagaaagcttggtcttctccactggctttccccggagagcagaaggtctccagaccccatggtggcaggaggcaggccactgagtgcaggctcagacctctcagctacgggctctctgttggcatcactggcctgtggctggtgggctctagaggggccgccagggtcagtcccaatccagcaagtaggggcaggtatcccttctgccccccatacaggggagatgagccctccctcagcttccaggcgtgg

SEQ ID NO: 5186 - DNA, 2984 bp, Homo sapiens
cacagcgcctggccaaaaacaattctttaaaaatatcaggaaaaactgagaatctgctccagattaaaggagacttaaacaaacaacaaactgaccactggacacagcatgtgatctggggggtttctcttacaagagaggttgtaacgattggtaaaatttaagtaagcctaggttagctggtataataatgctgtatccacattaacttcctgattttgatggctcctttgtggttattgacatggtagagatgagggtctcgctatgttgcctaggctgatctcaaactcctgacctcaagtgatcctcccactttggcctcccaaagtgctgggattatggcatgagccaataagcagttggtgctgagaaccaccaaactcgttgaaccagagggaccagtccctggaaacactcttggcaagttgaagcatggtcctgcctgtgccggtggtggctgtgggggtgggagcatttaggtgaggtgagcttagggatgaagtgctctggcacccacccaggtcctcctccacatccggcttcccccagacctcgggcaaagacccagcggggagcaacaccccccacatggaggcggcagcatctggaaggtgacggggaggagcttcccaggcttcccgggttggacacggagccccggtttctggctcctagccagggtgtttagactgctttggcccacttgccagtacagccctaagacacacgccgctccaaccacacaaccccagagctcagccctaagctgcaaactcgctgtacaaagtaagtgggaccacgttttagttttgcaatcttttgggaacactgaaaaacaaaaaacaaacaaacaaaaaaactggtccttccccagatttagtctgagaaaaacttaactttggaaggcaatcccctcactttacccagaaagctgaagtccaaagacagtaagtgacctccccatggctaatgacagaacccaggagtaggagtagagtagaaaacagagtggaaggaaactaacaactgcacttctcaccctcctcctctcagtcagtgggtctcactgaagccccctgaagcagtaagggctgcggggcccacactctaaatgagtctaaggcaatttcaggttcatggtagatggcttcctaatgtatctccttctctgaagctgtagagacgctgagaacaagggggagtcctcagctaactgccagatgcccgggtgtgagaggaaatgaggccgaaagcccaagaggtcatgcaaatgacagcagacaaggccaccatgggatttgtccaccctgggtgtggcaactgtctgtgcagtgcctatgccctgcacagacataggcagaggcccacagcaactctaaagggccctcccagaaatagccagccaggttgagcagggctaaaaaagaagatgaaggggtctctttcctttccaatacctcctctcttcctgagcatcgtcccctcattccaaaaaggagctgtaacggagtgaaggggaatggagtgggaaattagtgacaactcctgagaccctggacctggtcttccggcccgcccagtcaccacactgccttttccagaacaagaaaacccacaacagagaggacaactctggcaggacccaggagataaggttggagctggaagtcaacatgaacacagctcagtggggctgctgaccaagactgtaggtggggaggagtcattttccccactagggacccacagagagcctctggtaaaaagaatatgaaatcaaacaacctcctctaaagtcttcctggaactaggaaggaagaccacagctactaccaacctgccccaacctcacattaggacccagagaagtagtcaccgcctcctagggcaggaaggcccatccctgggggacctgtctctagccctaaaatgctgaacttcttttctgagggattcccctgcacccttctccccaccgacaaagcccagagaaaaagagtgaggagcagggaaagaagatggaaaacccaagataatctcctccttacaggatgatataaagtaactgcaagcagacaattcaaaggaagccccaaagtcagctacgagagatggagacagaagggaagtaaggaagagtgcccagaggagcacagcactctcacagagaggaggaagtaccacacagcaggaatgcaggtaaatggtctgatgtccgagaggatcctaggatactgcgtcccgccccacctgaacagtcacagccaaaacagcctccccaatcccgggacatgttccctctgccacacggctgctaagatctaatggttatggtcccagcagtccccagcatctgctaaatgctgggctggtcttggggtctcatccaccctggcagtctctcaggaacatctcagcttttcaattaattatgccacagatatgcccgttaaatgtggtataccctagacagtgactctctggcattcagccttcatggaccaaaaaaaaaaaaaaacaaaaaaaagcggccgcccccttcgggttggccaccctcgccctccggcggggctgcagccggggccggcgaggcggggtggggcacgcggaccttccagcctaggccctcggccgagcctcgctcggtgtccccacttcctgccactccctgcgggccagatctgtccgggacagccccggcgcccccgggaggcctgagcgccgggcccgactgacccccctgtcccagctgccgctggctcattccgaggcaggacaatgggggacatcgcgcgtttgcgtaccgagtcagcctggccggcaagaaggggttgctcgggggcagaggctaagggcaccctcgcaggggtcacggccgaatgccctgtccaggtggaccccacggccctgccatcaccagcctcccccgcgccgcgctcgattctttcgcgtcgaaaacaaagactaatccgatacccccg

SEQ ID NO: 5187 - DNA, 1923 bp, Homo sapiens
actatgagatcacatgcaaataaaagtgactcgatttgcccaatactagtttcctcaaagcactagccaaaccactcaggcccatggacaccagcacctccgcaaagggaagcacatcactgtgattatgcagaattcaccagcatcagccacaggattctctgcctctgaggctaatggcaattagctgagggcttgccagccagtcctctccaacagctcaactccagccgcagacccagcagcacaccttccatcccacggcttcctccccaggtcagaacccacagaggggtcttgcctgtgcaaatacagaattcagggcagttttatttctcatcaaaaaacccaaaaccacagaccacccaaatgtgtctgaactgggaaacaatttaaagttggacaatgtatgttagatagtactatttgaaaaattaaactgagtgtgataactgtattgcgcttatgtaggagactgtcccagttcttaggaggtaaactaccatgatgtctacagtcagccctcagatgattcagaaaaaggtacagacataaaaccagttagcaagaagctaacaattgatgaatccatataaatgtatacaatattcattttagcattcttgctatttgttgtaggtttcttattttccaaataaatggatagaagacaactattaaattgaacacatgtaccctacagcctaacgcttcaattcataggtttatacgcaaccaaagacacgtacaaggacttttgtagcattattacttgcaacaccgcagagctgaaaatacaaatgttcatgacttgtaaaaagaataaactatactacagttaattgagtaaagtacacagcaatgaaaaggaacttatgatatactcagcagcgtggatgaatctcagaaacctaacactgaacaaaacaactaaacacaacaagctcctgctgtgctacacactccattatagtctatctctactacacaacctaggactgtgctacacactccattatagtctctctctactacacaacctaggactatgctacacactccattatagtctatctctactacacaacctaggactgtgctacacactccattatagtctctctctactacacaacctaggactgtgctacacactccattatagtctctctctactacacaacctaggactgtgctacacactccattatagtctctctctactacacaacctaggactgtgctacacactccattatagtctatctctactacacaacctaggactgtgctacacactccattatggtctatctctactacacaacctaggatgctcccctgcacgggtttaccaatcaccagggaagacacattttacaggccttatggagccaacacagctaagagacagcttctccaacattattcaagcagccaaccaacaagacaactggcgctaaatacagaaaacagctgtctctgacatactgataaaacctcaatcttatgtctggtatagtcacacaccacatagcaatgtttcagtgaatgacaggctgcatgtacaatggcggtcccagaagattatagtatcatatttttactgtaaccttctctatgtttagctatagaaacacaaatgcttacaaccgtctttcaactgcctacagtgttcagtacggtacgtgctgtacaggtttgctgcctaggagcaacaggctccatctcacacagcctgggtgtgcagcaggctgtaccatctagctttgtgttaagtcactccatgatgttcacacaaagacaaaatcgcctaacaatgcatttctcagaatgtatcctgttgttaaacaatgccaacactgcattattatttttccccaatctacactgtggaacagcacgtccattgataatactgta

SEQ ID NO: 5188 - DNA, 4093 bp, Homo sapiens
gcaggggagcgggctggcacctgggcacaggtgtagacatggctgaaacgccggcctgaggaggtcaggtaccagtgctggatggcgggctgggggtcgtactccgtgacggccacgccgttcacagctgtcatcatgagcatgttgagcacctcgttggagagcttggtcctctcatcggtcctgattcggttcatggccttgaacccccgctcacagcaagaggtggagatgggcacacagaccaccacggccatgagcttgcttagcagggggaagcggcagtgctgggccagggcgtttttgcagagcatggagaacgggaggtgctgggcaatggttttcaggcccagccactcctccagcagagcttcctcactgtatcctgttgggagggagcactcgaaatacctggccaggttgagaatgtcatcattcccaaaactggcaagttcaatcccacttggccaggccatggtgtcaaacacctccatgttcttcagctgtgggggtcggtctgcgtcaaacctctgctggaggtactcaatccccgtcaggactgtcctctccctatccgcctggaaccgctgttccgctacctccagtttgtccaagcagatgccgtggagccgcccatccttgaagctggcgttgaattcttcctctttgggccctgcctggtgacggaggctctccagtgccacgtaggcgcggcccagcgtggcgttcacctctgtaatcagcacgatctccttctggcacacctcggacagaggcctgtagatgctcaggaagtccaacaggaagtggcagaacttgacaaagtggaagccgcgcatgagcttcagcatccctttggcccggtgcccaatctggcccccagcctctgccaccctctggaggtgcctggccagggcgggccagctcacgagcagcgcgtgcagcgtgcgcctcctgctggccacccagcggaccgcattcagatccttcaggcggatgatctcctgctccagaggcgccgcaccttcctgcagctcgttcagcctcttgtttgaggactgataaaacttgaagacggtgcggatgtgccggtcacacttcttcaccagatcgatgctcccgcaggcgtccaccacagccaggtgcagccggtgggccacgcagtggacaggcagcagctgcgggatgacctcctggaacttttccacaaggcctcctctgcagctcaacatggctgagccatccgtccccagccccaccacccagccaggcttccggaaggggatgtccagctcatccagggcagaaacgatggtctcgaagtacccatctgctgtctcactgtagagaggggccagagtgatgtaggactctttcacctccatctgcttgaagtagcggatgtaaatccccacgcaggcctgctcggaggcgtcggtggagctgtccagcagcacgctcacacagggcgagttccgcacgtcctccaggatctccctcttcagggtctctgagatgtacttgatgaactgagtgcacgccgtgcgattgcggtacttgcctaatatcacggtccccgtgctttggaggagctgcaggatcttctcaaagtcattcaggggccttgagtggtatgcaatggagtaggcggcattgaaaaagtgctccatgttggccatgaggtcgctggagatctctggaacgagggcagtgtgaggggtgtcttccttgatttcaaccgtgttgacacagagcctgtgcgctttgctgacttcatggtattttaaagtctccactttaaaaggccccgtgtaacctctgactaaccgagatgatttatcatggagattaggtctttctatgcaggctgagcagaagagtttggtctctttggggtcaattactaaccatgggaactgcccaaaccatgacctctgaatggaacggggcctgtatgtcctcttgattctcctaggtccatctccttcctcacaaatgctggaactgcagcaggaggcacgggcctccacgggagagcctggaagcaacgcggagtctgcagccgaggcctgtgtgtctgcctctctcactgccaccatcttcttgttccctttggagaaaattgaatcatgcttggttctgctacccagaactctgccatcttctatcagctaagacacccccaaatttaataagtatcccttaagcaaggcagagaagatgaatgcaatccttctttctagagaaagtggcgtccacttaaaccctcacccattctcatctgtgaaagttcatctggctcccccagagttgttgctaatccttgtgggttctttcaccagcgccccaaccaccctatccacacagctaccctgggatcatgtgacaccagataccaataagttcaattaacccccttggccacagagactgttggataagcaggtggctttcactctcgtgtgaggctccacaatagaataggttaaacacctgccaaggcttttacaagcctcagaaggaagtaggtacagaagtaagtgtagcaactacaagccaagaaattactgattgagataggcaagacaacgaattctcacaaaccaatagtgctgtcaccgagcactggagaaggagggagaagggatgagaggctcacagatctctgggtcccctggctcctcgagaccagtgtccccacgtacctgctcccaccagctctgccacagcctccatcagtacttctgcttacaaaaggacctgttttttccctgtttcccagactactctacactctgtgggcagggttagttgcttattcatcttgtctacccagggcctcctgccaggcttggtgcccaatcggcccccatcagatgagcacagctgagctcatgctgtttgactcatcatagccgcctgggccctggcacatgtccttcagaatgctgtaggtttacactcacctggaggacgacctttcccccactttggcccatttgggtccttgatccagggtgcagccctccgctccagtttggagatcaagtctggcttggcagcggcaggtcctgttgtaaggatgaagaatcatgctgatgtcactgctgtggccaaatcgagtagccccctcaagctagacccagtccctgaagtacacagaggtgtctctgggttctgtccttataaagtctagtcggccaggggcaggctgagcgcaaacccagagtgccaaagaggcagtaaggggaggggcagccctcagctaggatagggcttcctcagatccatgggccagccatacacaccagagggggaagggtggaaacaggaagaaacatagggactaagcaggagagagaggcagggggaaacagcagccatatgagaagtggaaggtgccacccacagctggcccacgcgtgtgcccctctgcccccacagctggcccacgcgtgtgcccctctgcccccacagctggcccacgcgtgtgcccctctgcccccacagctggcccacgcgtgtgcccctctgcccccacagctggcccacgcgtgtgcccctctgcccccacagctggcccatgcgtgtgcccctctgcccccacagctggcccatgcgtgtgcccctctgcccccacagctggcctttgtgaaggtgaccaactacatgggtttttgaaaggggcacttggagggccccctgaaatacctaccacctgcaatggagcctgaaatctgactaaaggagatttgtgtctttggattaagcactaacctttacttaaaataggaatattgttcaggggtatgcagataaaccatttcctctattgaaaataaaatccatcactatctacatcatgcttttgtgtgtgtctatgtgaatgtgtgcataaactttctgtggagagccacacaagcaactgggcctgtgggtgctcctggggaggaagtgaaggacaaaggaaaagggagattggtttccactactcatctttggatcgcttgaatatacttatatatataatgatacatatatgtgtgtgtcaatatctacatatttactactaataaaaatataaataagtaaa

SEQ ID NO: 5189 - DNA, 564 bp, Homo sapiens
agtttgatcattccaattaatcttaggcattttaggaattctcctcaactacccaacccaactctatcactttatggcagtctgtaaacagaacaaggcagtgtgggggaaaagaagaggtgggatggagggacttgagaaatggtctcagaggccagtagggaatggggggaaagcatccaggccctcggcagggaaccaatgtcaaaaactagtcaagctgtgctcgagcttcaactaggttgtgcagtctgcctactatggaagcaattttctctcctatcccaagtgtcagagcagctggaagttcatggcaacagtgcacagcaccatgaccctgtggcacacttaactgtcccataagaactaggaaccatctaactatgcgaaactagcgccctatgcaggcaatccagaattctatcccgagcaagcatgcctgggacaaagtaagctgtcaaactagcaccacgagtgtttcgagtctttctgtcaatgctattttgctactccttcattcatgttgttgtctgctctgtgccttagcaaaaggtgccaaaatta

SEQ ID NO: 5190 - DNA, 2355 bp, Homo sapiens
gtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagtcacgctctgtcgccaggctgaagtcagtggcaccatctcggctcactacaacctctgcctcccaggttcaagcaattcttctgcctcagcctcccgagtagctgggactacaggcgcgtgccaccacaccagctaattttttgtatttttaatagagccaaggggcttcaccatgttagccatggtggtctcgatctcctgacctcatgatctgcctgcctcggcctcgtaaagtggtgggattacgggcatgagccacgtgcccagccttcatgtgtattttagacaatgaaaatgatgttagacaaaaaagcaaattcgagcagttttcgtttttgagttaaaaatgggttgtaaaacaacagagacaccatatcagcaatgcatatggttcaggaactgttaacttacagtgcagtggtgattcaagaagtttttttgttgttgttgtttgagatggaatcttgctctttcaggctagagtgcagtggcatgatcttggctcactgcaacctctgcctcctgggttcaagccattctgcctcagcctccccagtagctgggattacaggcacgcaccaccatgctcagctaatttttgtatttttagtagagatggagtttcaccatcttggcccaggctggtctcgaactcctgacctcgtgatccgcccgccttggcctcccaaagtgctgggattacaggcttgagccgctgtgcctggcagtttcaagaaattttgcaaagggaaggaaagtcttgaaaatcaggagcgtagtggctggtcgccagaagttgataactaccggttaagagcaatcagcaaagctgatcctcttaaggctacttgagatgttgccgaagaactcaatgtggaccattctacagtccttcagcatttgaagcaaattaaaaagtgaaaaagctcgataagtgggtgcctcatgaactgaccgaaaaaaaaagtcattgttttgaagtgtccttatcccttattttttgcaacaacaaaccatttcttggtcagattgtgatgtgcgagaaaaagtggattttatacaacaactggtgatggccagctcagtagatggactgagaagattctccaaagcacttaccaaagccaaacttgcaccaaaaaaaggtcatggtcactgttttgtggtctgctgctggtctgatccactatagcattctgaatcctggcgaaaccattacatctgagaagtatggtcagcaaatcgatgagatgcaccaaaaactgcaacgcttgcagtcagcattggtcaacagaaagaggcccaattcttcacaatgcccttccacatgttgcacaaccaatgcttcaaaagttgaacaaattgggctgtgacattttgcctcatccgccatattcacctgacctctctccattgactacgacttcttcaagcattgcgacacctttttgcagggaaaacacttccacaactagcaggatgcagaaaatgctttccaagagttcgtcgaatcctaaagcatggatttctacactacaggaataaacaacttaaaaatgtgttgattgtaatggtttctattttgattaataaagatgtgtttgagcctagttataatgatataaaattcatggtctgaaaccgcagttatttttgcatgaacgtaaatgatgaattttagatgctgaaatttctgggcatctaaatcttctttcacatccctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatgattgtgccactgaactccagcctgggtgacagacttcatctcaaatatatagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaagt

SEQ ID NO: 5191 - DNA, 1680 bp, Homo sapiens
cctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccgcggcggccggcgaggagagcgcggagtcgagctgtgcgagccgagagggagggagcgccgagaaagtgcggggaggagggggtgagcgaggtggaggcgaggatgcagccggcgcggcggcgggggacggggaggggcgctggggctggggagggggcgggatctcggactcccacccggggcccgctcgggagcgcacgcgagcgcgcacacacacgtgtgctcgcgcgcgcacactcacgcaggggcacgcggaccggcacacactcgtgtgcacacatccaaccgggcacccccgcgcgcacacgcccgtgcccacgtgtgcacgctcacacccttgcacacacccaggcgcgcgctggcacacttacccggagaacttcgcacacacacgcactcgcaaacacgcgggctccctgcgccaccaggaagcagccgccagaatcgccgggtgttccccaactactcctgggagacctggccccccgcccccgcccgcgcgcgcggccacggcgcctccctccctcccgggtccccaaggccggaccaccggcctcgttgtcatggcgacgccggctcatctccccccacccccgcgcgtcttcacgcccctcccccgcagggagctggggcctccctcctcccttccccacgtccgtagggacccacaggttgacaggagcagggggtcgcctgctgtcaccggccg

SEQ ID NO: 5192 - DNA, 13249 bp, Homo sapiens
ggagcctggggagtcccgggaccgacggcggcggggatgcgggtctgcctgtccctgggatgcgggcgggcgggcagggcgaggcctggagcccgcggggcgcagggggctggaccgcgcgctgtgatttttctgtttagcagcggggcctcgcccaaggtcgcgcggggcctgtcctggatatgctctgggaagccagtggcgcagggcagccgccacccttctggaaccagtgccggagagggccgggcagctgggcctggggaggggaccgcatggatggagctgggggtagctgggcggcctccggagccgggagagtcggcagctgcacttccgccagaggtgggtgtgtccttcacatttcaggaagggagacttggggcctggagaagcgatgtgatttttcttttctagttcagtgctggttttgatggctttttatcatgaccttgttatgtcttattttagtttcggcccatttagtggatacgacaacagtggcccagggaggtatggcagagctgaggcttaacccagggcctgcgccctccacggcctgcactgccccacctccagctccttgccctgttcctccctctgcaccggatcagcccccggactctgggtcacctccacaccagttgacagggccccccagtccccaccgccaaccacctggccggctacttgtcagacagacatgggggcgtgggcatgggtccccacccctagcctttgcctctgtcactctacctgcctggaatgtctactttttctttatattttattttattgtatttttgagacagtctcattgtcgcccaggctggagcgcagtggcgcgatcttggctcgctgcaacctctgtctccggggttcaagcgattctcgggccttagcctcccgagtagctgagactacaggcgtgcaccaccatgcctggctaatttttgcatttttggtggagacagggtttcaccatgttggccaggctggcctgaactcctgaccttaagtgatccactcgcctaggccttccaaagtgctgggattacaggcgtgagccacctcacccagcctggagtgtctcatcttccaccactaaatgaaacgatggaccctgaacagaaaaaggaacagtggtggaagaactagcaaagcccacagccttgagtttggccgtaagtatcaaggttaatctctcagttatggcagttgtcccatgaccgtgtaagatgccaggttaggggacactgggaatagagcattgggaaaccttcccactgtctttgcaacttttctgtaagtttaaagttctcccataataaaaagctaacttgaatccaaggcaagcaaagcttccctactctcagcccacctccctcttctcccacacccttttggacagatgaaatgcaaggtgatggccctgtttcctgaagctctttccagggcctggctggctcccttgggcaggtctggagtgggctctgcctcttcaggaacagtggtcccaaggctggtcccggtgggcaaggctggtttcctgcaactcggcctggctgcctctgagttttggctcaagggacaaggccagggtcccacacttctgtctcctggctggtgcccagcttggggcttggttctcctgccccactgcgcagactgaagctcagaaggctcagctggctgccccccaccccacccctgcggagtcactgggcagctggctgtgagtggccaggtgctgcttgtttggtcccaggaccaggtctctgcatgtgttgtccaattctcacctggtccccagaccaggtctctgcatgttttgtccaattctcacctggtccccagaccaggtctctgcatgttttgtccaattctcaccactggaggagagtcccagactgtggagttttcacagggagggaaactgaggcagtctcctgggtcagggtaattagccagaaacaaggtcacattctgggaggtcagaaggttctggagggcggtgtgggcactctacacgagggttaggggcttgaatgcacacagacactcaggccgagagtccctcaaccccactcccctgccccgccccacccccgctgctccaggccttctggagacaggatccctgttgcagtttacctgaggctccccatccccgctgtgagcaggaaccaaggaggcccctggaagagccctgagctgggagtcggacacctgggttctgggcccggctcagccctgtgcctgccacgtgacctctctgtaccccagttcctgtcaaaaaagaggagagggctctgcgatgtgagatgtgtggcccatcaggggctctgaggctgcttgccctcccgtgtggacaggaagtctggggacaggaggccgtcaggtggcccagcaaaccccccaggcgtcttgcctgacacccaggggctcagttttcggtgatgagtaagacgtgctcagtgcctctgtgtgtcgtgtgtgagacctgagaccagggtgcctgctcctccctctgttcccaagggcatagccccaggcccgtttgtgaccctccactgggcccgagaagaaggctcctttccccaggcctcattcccctgtggcctcccagagccgcacggagtggggagggtctgctctccacctggccattgtggaccccaccccaggagctccggccgccccccccccctccagtcccactccttcctccccagaggcagcgaggcctgaagtttgtgtttcccctcagggtggttcttagctgcggtcacagattgcaggggaggagccagaaacggagatgaaaccgaggagcccccaccctcttcacagggctaaagccagaaaccaccgtcccaggccacagcctgcctcatgtggccatgcctgctccctggcagtgcgcgtcctgcaacccttcccaccccagggcctcggcttccgcaatgaatccccatgtttcaaatccccgctgctcccaaggctacctgctgcctcggggtagaatctaagccccttcccctggtgctggaggcccacagagtgggcgctgcctgtccctccactccttcagcgccctgaccaccgtctggctgttcctttgcccccaaagctgtcccactggctgcctcctcctggcatgcccccatgccacccacgacctcccatcaactcctattgattattagcttctttcacccactctctgccctagagcattggttcttggggcacagcatccttgtcctccacagtgaagctggtgcccctgtacctggcatagcccctgtacctggcatagcccctgtacctggcatagcacctgcccagcagctgctcgtgcaggaagcccaagtaggggtggaatagagagggaggagttcccagccctggaggagggagcgcagaggaaggctaggccgattcgcagctgcctcctatctcaaaaacgtggaaggggctataactctagggctgggagggaggggagtcgttttcgctgactctccgcacggaccctctcctgcccgctagctggtcagctcctccagctctccccgcggcagcaggccggggagcagatgtcttgtccagtgtgcgcggggcaccgaggtagggaaagcctgtttaacccgtcccgcccctcctgctctggccagcagctcgcccaagcagctctgcagagcgactaggtcagggcctctccaggtgtctccactcgagggacggctggcgccacgcggaaaaggggaagcgggtcagggcgggacaagggcaagaggttactgctctgggcgctgtgtcctaagggctgcctcttgtctgcggagaatggagggtgccgggggtcaagcccggactctgtcagggtacccgagtcttagccacgccatccttccccagcgcgccgcgggggcgggcacagcagggcgggcgtggctgggagaccggctgtgcctcgccgccccgcccgtcccaggccgggaagctgggacttgagctggtctgcattcgggcaaggtgagccccgggatgtttctcaggcagggcccagggctgcacgccctaacttggtgcggggtcgcggcggtccagcccggctgcacgtggtcgcgcgctccttgcagctcccagcccgccggcccgcgctcctgcgccccctccccacgcagtcgacctctcctgaccgccaggtgcacgcagggcgcgggcctgggcctcagctccgcgcactccccccgggacgcggcaccggggcttcgggtgggcccaggacccgcactcagcacgcacttcccccgccgagcactgtctggcagcggggacgcacccccaggaccacgagctcggaggcctggggccgggagatggcgcccgtggagtgggtcccgcgagaaggccgggaatggcgggccgctgtcgttcccacctgggccgccaggtgggtgccgctatcgccgcgaggccgcacctgtcgcgctgccggagcccgcgcctgcccaggagcgccaggagggacccccgctcctccctccgccactgggcggggccggtcgctgagtcacggccgcacaccggacggtgacagaggcagggctgcctggggaggggccggtgacctcagtcagggctgacgcggaaaagtgggatggggtcacccgtggcagtggatgagggggtggcccgggcctccactcactgcccacgctagatgtccggggtccctcctgcgaccgaggacaggaggcacccacagaggaccccaacacgaggaccctggccctgggtgcggggcgtttttcccgcactctgctcccctagcagatggcccctgctaagcaccagctcccagaaaaggaaaggaaggggctgagaggctggatcgaggcaacccagcaggaaaaggtggctccagggctggaggggtgggactcagagatctcactacatacacctgctggggacagaggcttctccggccttcccagggctgggccaggccgtggcaggggccgccccagacctgtgtcccaaggggccaggttgtttgcggctgggctggctccgggaaagtcagagggggcactgccggacaggggatgtccagtgccacaccagggcggtcacacttcctcctggggccgtggggacacaggaaggcctaggggaggggtggggggagaacacactcaggaggtgaccctgaaggtggagaggcccgagctggggtcacaccatgcccagggaaggatcatggttggcccaacccatgtgtccacttggtctgtgggagggaatcaccctggggagccccctatgcctggcccccacccacacacaccttgggctctcttgaaggttaactgtgcccagcaccttgacaagccccatttcctccagtccttaggacaaggcatcctttgggggcgtcaccaagctgggaaggtgagcccccgagtcagtgttgagtttgcgtatcggcaagtgccttgagctcacacccctggaactggcagtttggtgagagatggaatttcaagttgagaactggcctgggattttgaacgcttagtccctgtctcttgctggcactgctgctgatgagaaatgaatgtcactggattcctgatccagagtccaggtgttgtgtttctctaagagccttcaggcttttccttgctgatctaaaactgcttcatgtccctggtgatgcttttgcattcattatcttggctacttcctaggccctgttcttgctaatttgcttgtattatttcttttacaatttctttcttttgttttctgttcttctgttttgggatttctgttaattgggcattataccttctggatttattctctaatattctagtttttttcttctgtctacttttttaaaccttctgggatatttccttgacttctaacccttcagcggagtttttcattttatttattatagtttttaaccttttggttttgaaatttttttttctttttttgagacagagtttcactcttgttgcccaggctggagtgcaatggtgcgatcttggcccaccgcaacctctccctcccaggttcaagcgattctcctgcctcagcctccctagtagctgggattacaggcatgtgccaccacgcctggctaatttttgtatctttagtagagacagggtttctccatgttggtcaggctggtctcaaactcccgacctcaggtgatccacccgccttggcctcccagagtcctgggattacaggcataagccaagcccagcttttttttttttttttttgagacaaggtcttattctgtcatccaggttagagtgcattggtgccatctcagttcactgtaacctcgacctcccaggctcaagcaaacttcccacctcagccctctccatcccccagcagccaggactacaggtgtatgccaccatgcctggctaatgtttgtatttgtagtagaaatagggttttgccatgttacccaagctggtcttgaactcctgggttccagcagtccacccgacttggcctcccaaaatgctgggattacaaatgtgagccaccacacccagcctttgttttgaaatttcaaacttacctcgttttaaacatcttgacacatttgcttatcattctccttctatttctgagccctttggaagcaggtttcaggcatgatgcccttactattttagggtgtgtttcctaagaacaaggatgttttcttctataaccacagaacagtgatcaaaatcaggcaacatcagtatcacactgtttatccaattgacaggcaatgatggcgtggatcatacaacttcggtaatgacacttgtcccagaaatgtcctccgtagtgtgttttcctcatctaatccaaaatcacgttataacgttttgttgtcataaacttttttttttgaaacggagtctcactctgcactctgttgcccaggctggagtagagtggcacgatctcggctcactgcaacctccgtctcctgggttcaagcaattctcctgcctcagtctcctgagtagctgggattacaggcgtggaccaccacacccagctatttgttgtatttttagtagaaatgcagtttcaccatgttgggcaggctggtctcgaactcctgacctcgtgatccgcctgcctcggcctccaaaagtgcttgaattacagcccggccaaactatcatacttttaattcccaaggcctctcttgttctctgcaccatttcattaactataggcaatgagacttttttagaaagcagaccaacttgaatgcatggagctgagtggcgtggcgttgtccccaagggagctgggtgacaccacgatggtgaccatgtgcagagcccttctcaccgtagagtgataaatggtccgtttctgttttgtcccagaagtcagaggtagagttaattcctttcctttccccagcacggttcctggcacacctggcactccctaagtgcctgtgatggttggttcttacgtgactgaacttgcgggtggacgtggcattacacgtgggcagggcgtatgtacacctgtgtgtgtgtgtagatgcaggttcgcaggggctgggcagaggccgccacctgcagacctgtgggctcgttcacgccaggtgtccatgtctgtggtgtgcccctgtgtgtaagtccagctgggctgtagacagccatctcttctctgaaagttgatctgttcgtcactctaagccccaagcagccaggggctcatgggattttcatgaacactctcctcctgtcccctgcatgtgcaaaggtcctggggctcaggggttggaggctccatcgccccagtggttgtgaggcatctgggcttgtccagacaccttcgcttctgccctcggggtccctttggggacttttgtccttgctggggtccagagttttctggcaaggcctagagccctcttcctcccctccccttccaggcacagccccccaccagcaccttatgatttcacagaagacaaaagccagcagactgtgtgggctgtctgccctgagagttccaaggcgaggctccggagcagccagccgtgaaccccaactgcagttcgggaagctgctttcggggaggggcagggaggggagggggattctcggagcaggcaggcagccacgctggagagcccctccccaagctcttcattccaaccctgccctgccccctgccttgccgatggagcctgtcaccctaaacctggcctcagtaaaccaacccaggccagagaaagagaagtgcggccccctcgcccgtgtaagtggaactgcagcggagccgatagctcagccatgaaaaaatcatgaggtcgccaggctgcaggtctgtgctcaggaataacacccggggctgggcccctgggagtaggtgctgggccaggagtgaggacatcaaggcccggtgtgcccagcagggtggccctcacctggctgcagggccaaggggacaacagagcctaggcaggggcttggcacggggacaagggggagggtggagtacctgggaatcactggagacagggatgccaacaggagtggcagcggtcagggcctggcactgaggtgggggctcctccgatgcctgcagggagggctgcaggcactgctggcctgtgaaaggcgtggtcctcagccgcggggtggccccagggctccatttcccagttttcagggctccagtccagcagggcgaggagccacctctcccccagctgcacacacgcaggcctgtgccagctcacaccaccagcatcagcgttgcagggcatccagcctggagcacgtgccggtcaccatggcagcagacagcgtgccagcaggagcccaggctgggctcaagcatccaggatcagtggtctaggcatggggggcttggggtccttccccttggagcaccagacgggccaactcggggaggggaagggggaccctggagcaccaggacagcccgtccaccagcacctcagaaagggaacgatttcctaagggctctcgggaaacctgagggtggacaccaggtgccggtgggggcgcatggcttcctggtcctgcccagctggccccgcactgagagggatggaggccgaggctcaggcctcgggaggctgccaggggattctgatggctgaggcattccttgccctctgggctcaggtgaggccaggaagtctgtcacagctggctgctccctggaccagggggctgggggtactgctaccccaaacagcctctcactgcccaccgggacaaggcaccccctcccaggtgcagacctcagcttgggcctcaggcacacactgggcaggggcttccaccagcctcagaggtgggcgagggtggggcgtggagccctcagtgtggcagcgcctttgaatgtcgccacagtgcagcctgcacaggtcagggtggcaggcacgtgtgtatcccatgtgagtggttggttggcacctccggaggtgtggccacagggcttggtgagggtcagtgggaggggtgcttcctgttgcctgagaacactgcagggggctagagtgccccagcccaccatatgctcttgtgagttgtgtatgtctggagtatgagtgggaccctggaaatagcctcccttgggcagtgtacaacctgggctccctgctgggcagccctgagtaggctctcaggctgggatccaggatgacagtcccagggtccagagttggcccagcaggcgactcttctggcaacctttgcccaccctcatccatgagcaccttcacacacacacacacacacacacacaccacactcacacacatgcacaacgctgcacccatgggcagaggctcagcccatcatacaagaacccggccctgtgctggggtcccagctgctcaggaggccaaggtgggaggatcgccggagcccaggagttcggggctgccactggccaagatagcgccactgcagttcagcctgggtgacagagcaaaaccctgtctctaagataaataaaaagaaccagacggccaggcacggtggctcacgcctgtaatcccagcactttgggaggccgaggcaggtggatcacctgaggtcaggtgtttgagaccatgctggccaacatggtgaaacctcatctctactaaaaatacaaaaactagcggggcgtggtggtgggcgcctgtagtcccagctacttgggaggctgaggcaggagaatcgcctgaacctgggaggtggaggttgcagtgagctgagatcacgccactgcaccccagcctgggcgacagagcaagactctgtctcaaaaaaaaaaaaaaaggctgtgcctggtggttcacggctgtaatcccagcactttgagaggctgaggaggccagatcacaaggtcaggagttcgagaccagtctgaccaacataatgaagccccgtgtctactaaaaaatacaaaaaaaattagctgggtatggtggcaggcgcctgtaatcccagcaactcgggaggccgaggcaggagaatcacatgaacctgggaggcagaggttgcagtgagccaagattgtgccattgcactccagcctgggtgacagtgtgagactctgtctgaaaaaaataaaataattaataataaccagactcccgacatccaacaatctcaggcacttattaagtacctgctgtgtgccagaaattttgctgagaatccagaggaagcgatcctagcaggtggctgggcaacagcctggggtcctgaggtggaggcaggaggggctggaatccctgtaaacggcctccctccaaggaagcctggcccaggcgcccacccttcagtcaccctcccctgtttagctcacacagctgggtcagtgccaggcagccccacccaacgtggagctgtggggccctagaactgaggagccgccatcatttctggctctgccaccaagaggctgcccagagccaggcccacttagtgccgggcggccaggcttccccctgctgagcacccgatgcctaagcgccctgccagcccagacagcgctaatgaggccgtcgtgccaatcagaggggcaggccgcctgggctcctcctcagcctggctgggcgttggggtgtggaggtgaagccagtgtctgtgcctggggtgggggggaccatgggcacagctgcccctccggcttcccccaccgctcacggaccaaccgagctgtaccctcaaaatccaacgggaggccgggcgcagtggccacgcctatcatcccagcactttcagaggccgcggcgggcagatcacttgaggtcaggagttcgagaccagcctgggcaacatggtgaaaccccatctctactaaaaatacaaacattagccgggcacggtagcaagtgcctgtaatcccagctacttgggaggctgaggcaggaggactgcttgagctcgaaggttccagtgagccaagattgcgccactggactccagtttgggtgaggagcgagaccctatttcaagaaaaaagttttttaaaaagaagagccaatgggaaagtgaggtgcaggcagcaccctagcttgtatccctaaaccagagacagttccctggcatcggtgctaggcctgtgtcctcagtcccctggaaactgtgggagagtgtgtgtgggcatcgtctctgggaagggggtgaaaccccagactgcgtctccccaggatggtgcctggcacgtgacctggtttcgcacacagttggtgcctcataaatgcgtgtgaatcatagaggcggatgaggccagcacacagggagaggcgagagcaggccctggcgtcgtggcgtacgctgtgccctggggggtatttgcatgtgggagtctctctgcccccaccctggcccctgagcgtggggacagtggggacaggtctcctctttttcctcccctgtgtctgcaggtgcctggcacggttgctgtccagggcttagaggacagaggaagagcccctgagtctgtgcacactctgccaccatggccctgcccacctctggagcccacaggtgcccagcccaggccccttgcttttggctagactcctgccctacggggacccccatgatggccactcaggagatgggcccaggaggacaggggagtgactccaggccatgaccggaaggggcctgtggcccctgttcccagtccccagggagacgggagggtcacacgctgttatgaggaagaggacaccgggctggccctggcccagggtggccagctctggtttcactacttggccccaagcccctgaggcaggtgcaggagccaggcacggtgagcagggcccagtgcccctcaggctctggggaaggggtacagccaggtggcccagagcaaggaggtgctgtagacaggtgtgaccacttccagtctctcccggcctgctggccttcatcctctcccagattccaagggccaccgctgggagcatggggtggacatcgtcccaccagcctcctggatccacatccgtaaagactccaaagtgaagtgaggctggcttcactccagctcacagcagaggagggggcagcctcagggcccagcaacttgctcagagcgcacaggagtgcgctggggccgggccagcctggcccagggcctctgactctgccccctgcctgcagggctgcacggccactgtgttccaccctccagcgtgggtggcagtccagtgcgtcattctggggcctgagcagtgtggccagaggccggtctggggtggaggcgacctgggctgcaggttgtggctggggtccttgctatgcttctggcagcaggaatcagagaagcagtaactggatccagctgagggcctggcggccaccgagggtacgggcggcgatcaggttgcggccgagccgtgagcgttccactggacggcttctacatccggaagggctgggccgggccgggccgggagcccacacggggttggaggaggggggcaggaacgagagaggccaaaaggtgcagggccgtgaagaggggcgctgggcccacgctatgaggaaaaggggatcaaccctgccctccagccccgtaggccctcaggccctcgggctctgggctctgtgcaatccgggagtggctgaaatccaagctgagggtaatgaaaggtgctgctcctaagccgcacgtctctgatccg

SEQ ID NO: 5193 - DNA, 508 bp, Homo sapiens
ggaacggagccggggagtcgaggattgaagaacccggggaacagggaacaccagcttgaatttcctcagcggattcccgaagtctccgcccgtggacattgtggaactagaggagcggccgccgcctcagcctagagacctcccggaccgatgctgctccagccagctgacgaaaaaggcgagcggaagggcgggcaccgagctctctcggcccctgcaaggcccggtggaggagcccggctggagggcagcaggactctccacagactggcagccgccgccgcctcccggcagagtagcctagcaccgagcgaggcccgcggctgggaagggaaggagggcggtgtcggcaggagccaggggtgtcctctggcttcccaaagctagggccgttccctccttccgcactcggctcccagacctggggaagagaagctgagggtggcggagccggaaccgcagacgtatctgggacctctcacgcgcagcgcctgagcttccacagctg

SEQ ID NO: 5194 - DNA, 7958 bp, Homo sapiens
acttggacgccgcgggctctgaggccggagctgcagccgctgcgcctcgagctccccgcgccctgacgcggtccacccaggctcagctcccttgcgcgccccgtcttcgcctatttcccgcaactttacaaaaaaaaaaaaaaaaggacgacctccccgctttggtgaggcggtctgggtttagagacgcacctccggggaaatctgctatctttctgccccctctagagcggggccagaagcttcgaggaccgggagggagaatttggccgcgccccccagctcaggtgcgcggcgggccagagattcctagtcgagggtcctgggaggtagacgcgtgttccaagaccccacccttccaagagctccttaatggattcagtgggcactagggccccgggagaaaaggggcggagattcccgttcccatttctcaggtgaggaaactgatccgagaaaggatattttatctctcaggcaggcatcagcctcaactcttgagtcccggggctaaaacgactacgtacatttggtgccctgagaccatggcctacgcactcaaaacccgaaacaatgcttggaacagcagcgctcaataggtactgattgaaagacagaaggaaaactcagccttgccagagtaggcgcccagtggggacagagttgggcccgcatatcccgctttcactccatcagtggcctccatatgcccatcttaggctaattaatcctgctgctgcagatgtcttcacctcacgtacccatggtgcaagccccgggctcatataatcccaactgcatataatcccaaagtggaagttttctccaattctttgggattcgtgggggcggatttgtgcaaggccgaccttcctctgcgaggcgaagaaaacgcagtccccagacccaagcaggggagggagagggggagggcggttggggaagtcagcctagggttaaacgttacagcctgagatcgattggggcccagataacagggagttaactgtggcgatccgggcgcctgcagccacaggcgcggcctcggtgggagaagcgaaactgtctcccacctcgctgcttcctctcctctgctctgcgcagcctggctgtctccgaggctggcgcgagggcttatggagcatggatctcctggcagcagcagctggtgcccaccttccacgccttctatatgtggccttggggccttgacccagccggggtggggtggggggaggtgtcaaagggcagagctcatctggaatgtgttgcctctctgccactcctgatatccaagaccacacgaagtgacccctccccagacatcgtggacacctgctcccaaccagttccttccgaatgctgagaagtggtctcccttaactactatgccaagaaatggctcccttggggaggcgtttagtctctctcctccttgccagcagtccttttaatgcccccctccaaacaaacatcccatgtgagtaaaagtaaggtgcttgctatggaaaccgttttaagacgcccatcacccccagaagatcacttccaaactgcttaaagataggtatgctgggcctcagtgtgaatgtcaggcactgtgttgggcactgaccgtgcaaggaaaaaggaagcaaaagcccaggtgtaggatctccaagcatttaactcacctccatctaccttttctggggaagctgaggcacagactgtgagggaggacctgctccctgggagtcagcagcaggtctcagagggttaggatccatgaagtcaaactctattccacagatctcctgaagcctaacgccagtacagagtcaggtcatgcacgccccacaaaaagctttatgctggggtccatggcagagggtgggtagtaattctactttagggaactgctgactattacccacttttttttcagacttatgcctccacccccacccccaactcaggcgggaggccagggatccacaggctgcaatggaggaaggccaggtggtcccagtggtgatggcttcctcagggaaggggtgttgacttgtctggcccagtttagggggtggatcttggagttttcccttgctggaaattaacaccttgggagggagacctagactgtcacctatccaacccatatgggagccacagaggaaaaggacagaattgtccacacagaaagtgttacagaaacagaaaatgtcatgtgcaagccatccacaaagaactctccaccacagatgccaatgagacaagcgggggacatccaggaaggatggggtgaggatctctgcccttgggtgagactgtccccaccacagcccccttccccaagaagaagggaagcttggttcactattctcccacctctgcctacctcaaaaaggagaattgaagtctcaccttgctattaaactttttgctgagttttttgaaccaatcagccttcaagtcaggaagaagctccttcagtctccagcaccgctgggggagatggcccctgcatcaccagccttgtcttctagggaggggtgcgtccacccgggaccctggagtgtgctctcctggatcctgctgataatacccatggctggtatttgtgcagcccttaccctgagcagggcattgtgctaaacagttaaggtacattatcttatttagcccttatagcagcccctgcaataatgtcatccccattattcagatgaggaaactgaaatgagattggcatcagagctgttctcaaacccctgaggccatgtgctattctagggaggctttccacagcctccagtgaggctcatctgcttcacatcctgcagtggttcctcacagactaccctactcagcctggcttccctaactgactctcttccctgccaggccctgctgaccaatgccatctaacactggcagttccctctgacaccccaagactcctctccagatttccagagctttgcatgtaccattccctctgccaagataggcctcatcaagctcacctcatgaactcctcatggaagaccaggagcacatatcacctgggaaccatctcagactgccacttccagcctgagtttgggccatacctacagggccaccactagcctttgtgcaaatcagaaaaaggtacccacttttggcagatacaggaaaccatgaaggaggtcacagactgcctttcagcttcctagctccctttgctaggtgcctttttgcagtgcatgcacaggacagatgtactctgtggcctggctttgggtccttcatctggctttgggacccctcctatggccacagtgaccacaatgcacagaaatagcttttatttgctcatctcactacttgtcccctcgccaccacctcccgccatgaaaattctttgaaggtaaggaggagtcccctacctgccttgggcccgaagcttggcctccaaagaggtaccagtaataacaattgtagccagaatctttctgagctcttgcttgtcagggaccatgctaattgctttttgaacataggcttattaaatccacaggcttggacacctgtgtgaggttacaaagtagcaaaaccaggatttcaatccatgccttgtctgaggcattttccatgactgccatttatctgctaatatctgtcattgattaaacatccagtgactggaaatggccacatggagaggagtgtgggagttaggatctccaataaagatggccaatttggaactcagtctaaggtttacccttctttgggccccagttctgtcacctgtatcacaaaggatgggagcaaaggcatttgaaaccctgcctgctggggcagggcacaggatagtgttcagtggggtcatgctggactgtgacctcagccaaaatcccagggcaggcctgggggtgcaaacacgggcagaggcagggaggagcctaaccgcaccagactgtggccccgggcctttgggtctgggccctcacgcactgaccactggactttaggtcctccccaccccacccccatgacgtctgaaggagcagagagctgtgaaatgaaaattcaaaaagccaagtctctcaagtaacccaggcttgcccattcctgagaagtcagtttggtggccaatgcctggccttgacctgtgtaaacagaggggaagggatgaggacagaaggaagactccagtcccagaacaaaatgactctggggacagaggctgagagaaagcaggaagcaagctatatttcccattgcccaggcacagctacatacacgccatagacaaccagatacagccctgttctcagtgaggcacagggaactcagcctgtatatgggatattgatggggagagggacagtttgggggctgttgtgcccctgacaataacccttggcttctctagacacaatcatggttcaactctgtcctatgggagtgggactgagtgctcccagaggccaaagctgtggctccagcctccctgccacacttcaggaagagggagggagagcattgctgagaggtggggaggtaactgaatggggccttaggggaggcagaggcacagtgtcccaatctggagccctgcacctggaggaggggtgccctgggcaggagaagccagcctgccctgaaagtgccctgcccgacccaaagcctgaaggctagggtgtggtggtgtgggggaggcctgctggaggaggcagggtggggctcagcctcctctctacaaatctggtcctggagggcagtgcagggtcagaaatggcccgcactgagacttccgaaaatggcccagcctctttctcttcagacctggggccccaagaccccagctaccaccccctactctgcccttcccttcagactccaaggaatggggtgctcagacagtgcttgggggtgggcccgggatgaactgctctttgaactggtgagactggttctgtgtctagccgcctgggcagtcacgggttgcctgccaggcctgggaggagggaggcctcaagaaagggcccctcgtaaatcgttaactcccagagcccagccgccgctgggtgccctgggccccacccccagtcatgactctggtcctgagaatgcccatcccagcccagaagtcaaaggttagaggtcagagccagacgtcccagcacctgggcaagtccttcccccagctagcaacagggaggggagcaggagggctttctgtggggacgctgcttccttcgaatccggaagcttttcatcctcgtctgccatccagccgtcttgcatccctgccctttgcctctcaggagaggcaggcctctgggtgggcttcctggggcaacccctgggcaagtcccaatcccaccagtcctttctcctcctggagataattatgccagacccactcactccacctcaaaggcgtcaccaggactagaaggtgaatgagatgaggaaaagaactagatactgttcagaattgggacaggaccctttgtagaggcactgtgttaagtgatcccttcaccagcatgctaggtcatctgtttagcaatctcattcccactttgcaaataagtaaactgaggctctgagaggggaatgactgattcacccaggctatggcggctgtacaggaaagagcttggatttggtccagttttgtgctatcaagctgagccttgaatggggttcagccctctcctcaaattcctaagctacaggtgtgaggacacaccctaaaggcagaatgggctggacaacccctctctcccacggaaacactgtcaggggcccctgagatgggggcagatgggggagtgtatgtgggcaggagacggtcaatgccccccccacctctccgagcccctccccgagggcaaccctcccccaggtcacaccccgctaggtgccacgacagaggagacttggttgctgtcccccaccccaccctcaagaaaaattctccagacagactaatgaggaggattgatggtgctaccacccttttcactagggaggcatctcagaagccgaggagacgagaaaaaacaacatcaacttttaatcgagattgcagattcagaaaagattcataagtgaaatgattccctaaggaaatataaaaagttacttacggcattgctaaattgggcatgcttcaatcaggggctgttgagaaatcattaagatctacaagacgatgttttagatatatgtgagctccgtcaggagggctggctattgctccagctagagagaggggatctggtcctgagctggctggcctcctgtgtcacccacctcaatccaggggaaggaggagaaagtgaagagaatccctacctgccaggctccaaaggccactgcccagagactgcaactgtgtccagaggcccagagactacagcaagggagagtgcagcagtggggctgtggttagatggaactgtttattgttggaagtaacttttttccctttcaaatggcctaatggggaatggtagggctgtaactatctacttcccttgaaatactaaagaggggacacccccttcatatcccctgatccctttccctgttccttgagttggcctgaggaagtgggcaccctacttggagacagaattaccagaatacactcttagacctatgcctgagatctttgctggaggggtgagggatgggggagatcactctgtttggtcactccctccagggaacactaggggagtggaccatcctagggaatgttctaggatgatcactagcttttgaggacatcttcccctccccactgcagccattttctcaggtggaaggcttacctgaggctccaccttccgctcttgctgcagcctgggaggggttttttttcctcaggcctagggactttcagagtcagtctgggacatcagtgaaacatgggagcgacaggatcacaatgcatactgatctctccctctgtgcactcctggggctcaggagagggataaggccttacccatctccatgctgtccagggcctggtcccagttggtgctaaatgtttagggaaggcatcgggatgtggctggaccaagtctgttccatgtcggggggaagggcacaggaaaaagagagatggaccagggcctgctgtgggggctctagtggccacacctggattcctttccttagatccatctgcctgggtgagccccctcctccaccgccaaatcatctgggaaggcaagaaacccgagccggatggtggtggccacactgccttgcgggtgacccgaacccgatcccgggcaggtcctagccaggccaaggcgctattttaaaccccagccccaagctgccgccttagcccgccaggccatctctgattacaaagccactgcccacctcccagtcacttcttcctccctgccctgggaccccctaggctggtgctgggttcagtgtgtcttggggcagtctgtcaactggcaccaatgctcctctccatcccccagccctgtccactgaggcaccctcattcctccccacacacagggatccatcgagctgtattctgactgagatttctcccatggatgagttatcttccccaggaatgagggcacaccctggccagaaagcctgcaatgctgggcccagtttctgctggggtcagagcttgcaggccattatagggctgatgctataggaagaaaagaagtaggttagacagatataggaacttcccggcagtgagactgtgcactagagtgctttccctcctgtcttcctgggcaggaagaggaagaaaatgtctccagagggagccccctccccaaccccctggtttaaaggctgtgagttaggggactctgtaccgtttagccaacccatagtgccttcctccctcccaccttcctggaggggacagttgctcagtgctcaggtggcccagctgtcagctggttgggccggca

SEQ ID NO: 5195 - DNA, 408 bp, Homo sapiens
agacaggcagctgatgtcctcatgaccttccccagtcctcccagccttaaagacgacaatcataacccacccagagctcttcatacttcctgcagccggttcatccacaataggtcacaagatgggcatcaccacccaggaggctggccgctcaggagacagtgtgcctcctttacagatggagaaactgaggtcctgactaggccaagcacttcccagggcagggatctaaatagtgggaagtcttctggcttctggatagggctcaagctgagagccaggttgcaggccaggtctgggccaatggaatctcggccagggcgggtgcaggggcctgaggccacaccccagaggtgtcactgggggcctgcatccgtcttgtccctttccctgagggatgaagcagcc

SEQ ID NO: 5196 - DNA, 4656 bp, Homo sapiens
acagaagtggctccaggagcatccacatctgcctctcggggcccacggggcccaggccagctacagaagcaccctgctttccatgggaaaatgctgcaaatgggggagaaaggagagaagggtttcagactgcaaagacccttcgacatcagctagcaccaagttccatcatgtaaataaactgaagggcttcagaccgggagtgaagccaagcaggtgatagaagtgtttgtaggaggatttttttgacataaacatgaaatggagcgagtggtaacgccatccgtctcctgcccagacctccccactgtcactgtccagcctgaagccgccctggtgaagcaggtggaggagcagctccaggcccggctccccggcctccctccctcagctccagggcactcacgtgcttgaaacagctgacgggagcagccttgtaactgtgatccttcaggaacttcccccagtcgaagcccaagaccagagctgcagagcagagaggacgagtcagactaggagcctgcgcagcagccactccaggagcctggaccccaagggccctgtgggacctgcagaggtaggtcccccacccccagcagcccctctcacagcgctgcccacgacaccctccttcactcccatacctgatccaccagtggccatgagggaccactgttgaggactgaattgaaaggtggcaagactctcaggagtagaggaacattcaaagggaaatttctcgcccttcttcccccaaaggggaaaactgaaatatccctgggcttaaattcctccctccgccctgaacctgattggccacacccaatctaaatgtgggggagggggtgcgcacacaccagggcccctccaactgagctccggcctgctgagctcaatttcagttagaaactcagaacaatgatagcagagttgctttatgcatacatttaacttgcttagcaattgctacacactcagagagaggctcctttccttatcccaccacccctctccaaacctgccttcaaaccatatctgggccttcgttgccccagggaaacagaaaccaaaaggataaaagcaaagagaaacaaaaacagccaattcttggcttttgaattatcatgggtaggagtcctgataatttaagggtgtttgaaggcatttttctgggtaatttccacaatacccaacaggtgaggaagatgcaatccgcagtgaccctgacttagggcactttctacctggccggtttgcccagtcttcattcctaggaaaggccaccccaaacccagtctcctccccagccacggcagcttcctaagcagggccctctgctatcttaccgtcttgtcctgttggtgtcccatctgccagctgtcctgtcccttgagagtggaggaaggctccaattttggcagaccaggcagccttgtgcaggactttggcttttttggtcggtggttttccctggagaggaggacagaggctatgtgtagcctggcggctgggatcatgagtctggatttgggccgccaagttgaagtcctgggcttgggccagtgacttaacctcttttgggcttcagtttcttcatgtgtgaaacagtgatgacaataacaatcctgagctcagggggtggttgtggggaagcgtcgggggtgctagggggtgctaggcagtgctgcagagcagggagagacccatgttctatcttttaagcctttctgtcctcccagattcaagtctcagtcatctccttcctccagtgtcgctactgatagatccaaagcaaagaatgggcctcacaggggcccagaaacgctcatgaactgggaggcaaccttctgtacatacgcgaatgtttgggagagggtccacataggcgaatgttcgggagagggtccacataggcgaatgttcgggagagggtccacataggcgaatgttcgggagagggtccacataggcgaatgtttgggagaggacccacagctttcattaggtactcaaagggggtcctccctttccaaagggaatggccactgatctggtctgtattttgtaacttaagtactgaacaggaaggccaggaatttactaaagagatcagtgaagcagaaatctgggtttaagtcccaaacaaacctacagggcaaatcccagttctacagtttttagttgtatacctttaagtaagttactaaaatttctgagcctttataaaaaggaatttttttaaaaatcaaattttttaagatcgttaattggactgagaatgtcaagcccttagcaagtactcccaaaccatagctattaatattaccaatattattcttagctctcggaagagagggatctttcggtgccttaagtaaaatctacaaaatggggaaacaatggtaattgtctcacaaaggcgacagtgtatgaagcagtaagcagaaggatctgggacacagcaatttctaataaacatcggtggtgctcaaacttcgctgcacattaggatcacctgggagctcttccaatctctgtccaggctacacaccatcccagttaaatcagaacctttcggagtaggacccaagcatcaatatattttacataatattttccccccaggctggagtgcagtggcacgatctcggctcactgcaacctccacctcccaagttcaagcgattctcctgcctcagcctcccgagtaactgggactacaggcgtacaacaccacgcctggctaatttttgtatttttagtagagacggggtttcatcatgttggctgggatggtctcgatctcctgacctcgtgatccgcccgcctcggtctcccaaagtgctgggattacaggcgtgagccaccgtgcccgaccagcatcaataatttttaaactttccaggtgatcccaacatgcaggcaaatttgggaagcagtgttgcagatgctggtcccagctactgggaaacaaggtaagatgaggcccctgagatgaggttccagcctcaattccgccattctcctcctacagagccacactaggtatgtcattctacctccttggacctcagtatacttatcaataaatgtgtgggttcaacaccacatccaagaatctttccatctctaaagattctataaatatcagtaatttagaaaattggcaagactttctaggtagctgcctgtgacatggagtccgaggaggcatggtcttcctgaagccaccgtggctggtgaaccttgggcctgtttcccaacttcctttgaaaggatttataaaagtgtggggtgaagaccaagggtgtcagactcccccatagttcttgtttaaaatgtactgaatacaccagactctgggggatgatggtaggtaatggagcgtagcttcaggaacctataatttaaaaagctccacaaatggattctactgtcctctgaagtttgagaacataataaataccagctggccacaagcaaggaccttttcaaactttcctggccctggccttcagtcacttggtggttcctgtctcagcaccaaaggcaccgggaaggatccaagtgattgcctctcacctgtaacctagccaagatactggctttcttggagttggaggagtagctcctggagcaggagacgctgcagaacctcttggtcttggagaagaaggcttcccttgtacccacgataccacacatctcacagacagctgggaagagaacttagcacatgactcacccgatatgaccacctcaaagcaaacaaagtgatgggcccttcaaaacctggggcactgcattaaccaggtgagcccctgcccccacaaaggctaatggaataagaggaggaatgggaggtactggtgtgtatatcctgaatctacctgaatgaagtgctgctgcttggcctcccttggctacagatgtcaacagaggggctaatggaaatccatgaggacgactgggggaacaggtgagtgttgaaaagtttgtcagaggaaagtgagaagaaactaggcatggtagctcctgtctgtaatcccggcagtttgggaggccaaggagggaggattgcttgagggcaagaatttgagaccatcctgggcaacatagcaagaccttgttgcccaaaaaaaaaaaaaaaaggccaggtgtgatttggcggggggaaactgcctgagcccaggaggctgaggctgcagtgagccatgactgcaccactgtacctctagcctgggcaacaaagtaagacactgtctcaaaaaaaagcgaaaaaatttataggaagaaaaagtgccaaagtcacttaacctctgtggctctattttctcatctatatagtaaagggactgaactagatcagtgttttatttatttatttttgagacggagccttgctctgtcacccagcctggagtagtacactggcgcaatcttggctcactgcaagctctgcctcccgggttcacgccattctcctgcatcagcctcccgagtagctgggactacaggcactgccaccacacccagctaatttttttgtgtttttagtagagacggggtttcaccatgttagccaggatggtctcaatctcctgaccttgtgatccgccgtgtcggcctcccaaagtgttgggattacaggcgtga

SEQ ID NO: 5197 - DNA, 2618 bp, Homo sapiens
aatcccacagacatgcggctgctacacatctctaccaggtatcaagtaaggcattctaagcagcacttctaggtatatttgctatcttacaggcagagaaatcaaagcaattgataggtaaacgtcatgcagtctttagatacccttcacaataattaaaacatcggttatcagcaattgagtggagttcccttataatctacagaataacttaaagcatccagacacgcctcagtgctaccactcacgttctcttactggccacattgcatatattcaaattaccacaagcttcattcaccaaatctgcctggtgccctgccctaccatactcccccaatcctgtttacacattaaaaaactgacaactggtaaagtaactgaaattcaggtgggggggctcacctgcaatgcccgttgctcccggctgagctgactggaatctgcatacagttcggtagtgacacatttgaatcggtcacccacgtaacccgctgagttggcgattctctttgccagcttagatggcttcggtttcagaactttgccatcatttgattcagcctcatcagctccatctttggtataggtgggggtcacatccacacttggtggggcactgcccacacaaaatggtttgggatcctcttgggttttaccaaaagttacagcagggccatcgctccccagaggtggctccaggaatggagtcgagactggcaaccctaggttctctttgttggtacctgccagaacactgtccttgcttacggtgaagactggctgtttgaaagtataagtttcgtggaagtcactgatgcgccccaactcctctctcagggcgatgaaatcacggtgctgctgcagggccggctcaactgagggcttggggggctcagcgctctggccaacactctctgctgcaaagctgggtttggacacgtttgtgtcagttttagcatctggttcttctcggagaaggtctacgtagacaagcttgtcgcttttgacaacagtcttcccttgattccagttggggttcggctttaggttcttgtcggtggggacatctggatgtaacttggtgctgctagtttccaaaatctcggaaaaccgattccggagggttgggtcctcgtaacgggctctctcatgggaccgggatctcctctctggtttctcctctttagtaatctctatgggcgtgtgtggtatcaacatgggatgcaccatgcccaaccccagggcatcttggtaggtcacaaactctggacggccggtgggaagcccatagggcagcccaggctttggggcaaggtgcccaggaaacagactgccattgggtaacaaaactgggtgagggtagacaggtcctttgccatgtaaggagaggggacttacagcaatgccctcaggggctgggtaagggaggtaactcctggggtagggaattggtggggacctgaatgcctcatttggagacagaaatatagagcttggtggaaggccgttctcgtttgctttgaaactcggttctgggttgctggctttggcgcccttgctgctggtgctgctactgtgcttggcaggagtggccgggggctggaaggctggtcgtgtcatcaaccacttccgtgttacccaggagggtaggctttcaaaactttttccaaaacaaagttagggaccatgtcctacgaaactggtttccatggtgataaaaaagccatatttgactgcctttgtcaaaatgacagggggatacacactagtatcatacaaatgtcagctgttccaggctgaaaaggaagctgcacatctgtgccaggctgctgcggctgccctgggacttgttatcagagagcatcgataaagaaagtgcttggtgccaacttccaaatccccaggataaaaatcgctgacaagcggcagaggaaaagtttcctcattaccccgaagagcagcttcaatcatctactgcttagctgcctccaccccacaactccaaaattactgattaggaagcataacagagctgtctgacgaccaaaagcaggcgccagtggcctctgggaacaggcagcagaggacaatgagagatcctgggcttcaatgaaggaaaacggtggctctctccccatttattactgagcaaactatttgttttaaaagcacatagaatgctgctccacctgggcccacactcctgacatttagagttaaagcagtatatagactgggattaattctccttcataaatatgaaataataaattaaggacgaaagtgcactgaaaggccgctttaggggctaatcttttaaagggcggcaatgcttcactgagccaggttgcctgttaaaactgtaaatcaagagcggcctactaggcgggaagctctttctctcccaccccttttgggcccacggtggctgtgagaagttgaggggggcttcagcatgggcgtgggctccactcaggcccggcccagatgggcgcattcacctgtcttcgctcgccccacacatgcggaccctctcgctgttcatccagctgtgaacgttcccatacaggggggttgctgagagcatgtcgtcttctgggatggcagctttgctt

SEQ ID NO: 5198 - DNA, 611 bp, Homo sapiens
gtccgccacagaaacgcttccactgtaaggagcagcctcgtcaggaagttggaaagccacgttaaggggactgaaggcctcttggcgcagcagccctttcaatcattcgcctaatgcttattgctgcttctctgccgactccaaggtagggatggggctgtccccaacagacaccagcgcacatgccctatttggtataagcatcactgagtgtacactgggcagccgtaggctcgaccagatggggtctgtgagggaagctccacctcaggggctgtggagggggaggaggggacacaaggcccgcccctcaggcctcctaaccttctcttagctcacgatggaaaaggtcacctgcaccatcatctttggaaatgagcacgtcgatgcccgaggaaagaggcaggtagtcaacgttttggtttcacaagaactacagacactccagagttggaagggccctgcggagccgctggcacagcccccaccgcaatctgggcagggctgctctcgacagctggccatctggcccgtgctggaacagtccatgctccgctggctattcttccgtttggttcagacacgctaccacccagttttctgcaaacagc

SEQ ID NO: 5199 - DNA, 2310 bp, Homo sapiens
gacatatgataggcatctgcccttgaggtcttgccagcacccctcctgccctctgcagcttcctggttgaatgaggggctgcaaggtgaccacacaggctgccctgatgggcatgtcctggcctctggtccatatccctttctgcttggcactggcctctcttggctctcacctccacctttgccaagcccaggagcctccttcctccaggaagccttccggagaacccttcccccaccccaaccaaggtgctccctctcactgccttgttgcaattgtttgttttgtaattgtctttccctgagtttgtctttcctaccagatggtgatccctagcagggagggctgagtaggaacttcagattttatttccagtttcgtgctcaagatagcacagggcctggcctgagaaggtgcttaggaaatgtctgtggagtaaaaatgatggcagctatatttcttcaatgattcctacttgcccagtgctattttgagtgatttacatgtgtgaactctttaaacctcacaaccacctgaagttactgtcgttatccccacttacatgtaaggaaactgaggcagagaagtaacttactcaaggttacacaggtgagaagcggcaggacagggccggttacttttagctattacaggaaacagcctccaggtgaatggaataaagcctgctgattagtactttgtgagaggctgatggggccaagtagagtgctgtggtttcttctgaaagacattgcctcatggggggattttgcaacaaatggaaccttccacgcagtctgaaaggctacctgtgcaactccagcctgggcatggtccctcgtggctgctcggtcccccaggcctttttgagactctagtacagcttctctgggctgtaggcccctagctacgatgtcccttcgtttcttgtctggaacatggatctcagaattatatctgcctcaggggcctaagagatgatcaaatgaaggagggaagggcttcagtgattatcaagtgcagggcagagatccttgtggctatttttgttggtacaggaagaaagtaaggcgtgatgagagtgagaaacacttagcatatttaggagagtctcctgctgtgggccaggtgaggaggagaaggcccctgccatccccagagtagcatctcagggctgacttgcatttgttgcttgatcttgcctgggaaatgcagtctcccttgactcactcttttttgttttgttttgttttgttttgtaagggtgatttcatgaacattctcagagacagtcacactagagtgcagaggggcaagggcatggaaattatgggcttggaccctggagccagatggcttgggtttatctcctggctccatggctggtagcatagcctcccaaccttgggcaagtcactttacatctttgacctgcggttttttctcctgtaaaataggaaaatcatgttgaggaaaggggcctgtctggtgagccgagtactggatattatgcttgcatttccttctgttacatccccacagcagctataggaggtagacctctctatccccattttacagatgagaacagcaaggttcgggttgttaagtaccttgacagctaatgtcaaagagcatgtatgtggcagagtgggaatttaagtccaggttttctggctctaaagtcttcaatgttttcatagtttgctgctttgtagccttagagcccagtgcagggcagatacatgataattgttaaaggcttgtcttttacatagtcttggttgggagagggggctcctaagtgatcttccagagctgaaaatcggggccagcttcaggtgcatgcaatctgtgcagtcacacagggtcccccacttaggaagcccctcccatttggtttaatgctgtgctgtcgccatcttgaaattcttcattatttttgtagaagaggccccacattttcatttcgcattgggcccattctgtagctgctgctgtttaaagtattgagagaagtgaaaaatggtgagggcatgagagccctgttccccctctagggggcctgatcagtggccatcagcccttgggccagcttggaatcatgaagatgtgtgctgactggccacttcatatcttcacaaacatctagaaccatggcagcaaaagacgattctagtagacctttcaccaagatggttagttagcagggctggtgtgtcatcccaggggacataagcctgattttccttggtgaggggtgattttcaggcctgctggaggacacataacagaggtaaatgtgcaggt

SEQ ID NO: 5200 - DNA, 11038 bp, Homo sapiens
atctttattgaggacgtgagcgttgctcctggtgctgaacagagcgcgaagctctccctgcgtaactcctggcacgcgccggtctcgccaggccaatgggtggacctggcgcaacagacgtcacgagaggagcggaggcgaggggtgaacgcggagcactccaatcgctcccaactagaggtccacccaggacccagagacctggatttgaggctgctgggcggcagatggagcgatcagaagaccaggagacgggagctggagtgcagtggctgttcacaagcgtgaaagcaaagattaaaaaatttgtttttatattaaaaaagtttttagagatgggggtctcactttgtggcccagcctgcagtgcagtggcgcgatcatagctccctgctgcctcgacttcctaggctcaagggaccctcctgtcttggcctctgagtagctgagactacaggtatgctccaccacacccggctaatttctttacttttttgtagggacagggtctcatcattttgcccaggctggtctggaactcttgagctcaagtgatcctcctgccttggcctcccaaagtgctgggattacaggcatgagccaccacagccagtcaagattttttaacaggacaggactgtctaacaggattgtctaataggacataaaatacactaactataaaggaaagtattgataaattggattacataatgattgagaaccttcttttatcaaaagacattaaaagtgggagaagatactctaagatagaacatccatggactcatatcctgaatacatactacaaatcaataaaatatacacaaacagataaatggggcaagagattcgaatagttacttcacaaaagagaacattcaaataatattgaaaaggtgctcaacctctttagtcatcagggaaatgcaaattgaaaaaaataaatactggctaggtgaggcgactcacatctgtaatcccagcaccttgggaggctgagatggacagatcacttgaggccaggagtttgagaccagcctggccagcatggcaaaaccctgtctttactcaaagcacaaaagttagccgggcatgttggcccacgcctgtggtcccagctacttgggaggctgaggcatgagaatcgcttgaacccaggaggaggaggatgcagtgagctgagaatgcaccactggactccatcctgggcaacagaacaagactttacctcccaaaaaaaaggtggagaggggaggactactgcactctaccaggatagcgaaaataaaaatgacttgacaataccaagttttgggaaagatagaagcttgaactgtctgacactactgaaggagcatacattggtacaactactttggaaacctatttggcagtatctgcctgtgaccgtgaaattccactctttatttgggaatataccctcctaaaataatgcgtatgagcaacatgaagacatgtacaacagtgctcctggcagcagtatttgcaacagacaaaaattggaaacaactgaaaggtcatcaacagtggatggatacgctgggtgtggtggctcatgcctgtaatcccagcactttgggaggccaaggagggtggatcacccgaagtcaggagtttaagaccagcctggccaacaaggagaaaccttgtctctactaaaaatacaaaaattagctgggtgtggtggcgcacgcctgtaatcccagctactcaggaggctgagacagaattacttgacccctcatcctggggttggccttatgcatgtgcagcttatggctcagcacatatgccaaagacacggtgccagcacttttttttttttttttgagttggggtctcactctcacccaggctggagtgcagtggtgcaattgctcctgagcataagtgattcttccacctcagcctcccgagtagctaggactacaggtgtgggccaccacgcccagctaatttttgtattttttgtagggatggggtcttcctatgctgtccaggttggtctcaaactcctgggctcaagcgattttccctctacggcctcccaaagtgctaggattacaggtgtgagccacctgcacacttacacacccattcctagctgcagcttcagaaacttctgacccaggaagtcagcccaaaccccctcactgtcccccaaaatttgagttcttctcaactctacccaaacactcccctttcttggggtggcttaatgctctgtctcattgcccttcctactgcctacccacatatcacatctaccaaccttccacgcagccatagacgtgttctatcaaagacagttccctccccaagaggacttctctgactaatcataatctgcctttggttgtaattttgtgttgtgaggccaccacaagggtgtttgctgaagaggtcctggagtcccctcagagcacgcttgctaccaggagtcagcatgtatgtaacttcatcagctggggcttctgcttctcttacaaacaggtgccagggcccaccttgggcactcctgcagaagtgagcagaggcttctgccatggggccataccttgtttgacctaggtgccagcactgggacagatggcacagcacagtcctgccgttcccacagggtttgtgtgtgcatcatgacaggaaacacagcaagtcacaaaggctgtccgatgtccctgcctcagcttcctgaggacctgtgctttttactgaaatacactatctcataagaatacttccctgccttccgcaccccagtgagaaaggagttgtgactggaagtcagtgtcattgactttggatatgaaaaggaggcagaatgtctccagggttaaaagtagtaaccaggccaggcgtggtggcttatgcgtgtaatcccagcattttgggaggcggaggtgagtgggtcacctgaggtcaggagttcaagaccagccgggccaacatggcgaaatcccatctgtactgaaaatacaggaattagccgggtgtggtggcaggcgcctgtaataccagctactggggaggctgaggcaggaagaattgcttgaacccaggaggttaagggttgcagtgagccaagatcacaccactgcactccagcctgggtgacagaacacgattccatctgaaaaaaaaaaaaaaaaaaaaaagcgggggctgggcgcggtggctcacacctgtaatcccagcactttgggagcctgagacaggtggatcgtctgagatcaggagttcgagaccagcctgaccaacatggtgaaaccccgtctctactaaaaatacaaaaattagctggatgtggtggtgggcacctgtaatcccagctattcgggaagctgaggcagaggaatcatcgcttgaacctgggaggtagaggttgcagtgagccgagatcacaccattgcattccagcctgggtgacaagagcaaaactccgtctcaaaaagaaaaaaaaaaaaagttagtaaccaggttgtgtcccacagagctttactgggggccaaacactgtcaacccctcctcaggtcccagtgagtttgtgcacctggccttctgacagtaagcggtgagcagggcatcccccaccaggaccccatactttcctcccatgggtttcctatggaatgttgctgcttcaacttctgagagcctcttgctggggggccccatccctagcccttgcctccctgtgctgctttaccttctttttgggaggataactgccctctgttttcagcaccccaataagaaagaaaaagtcatgaccagaagtcagtgtcagtgattgctgatgtgtggaaacatctgatgaatgaagagtttgggtaaaaaataaagggaactgatgaaaaccacttgtgtgtgaagcctatatagtggtgtgtgcctgtagtcccagctactcgggaagctgaagtgggaggactgcttgagcacaggagttggacatcagccttgaaaagatagtgagactcaatctagaaaacagaaacaacacttctgactggtgtctgcctgtgggtttctgactctgctcccaaacttatggtgagaacttctttgctaacttgagagtctgcaagagtgaagtttttgccaaattttggcccttagttcctctaaaacactaatggaaacgtaaccccatgcttgttaagaccctccttctgccctaccatgattaccagatctctgctgaggttgcaagatgaggtgatcttgctggaaacaaggacaaatgggggaagaaaatagggctggacaggcccaagcattcagaggccagggctgggggtaggtaggggcctgcttcatttgagaacaactatgaaggacaatagggtttcaacaggggagagagtagcggtattcaaagcaaagcaaaagatgtaagtgaaagatgtaagcgggccggtgcgatgggtcacgcctataatccccgtactttgggaggccaaggcaggaggatcaccggaactgaggtgtttgagacctgcttgagcaacatagtaggaccctgtctctaccaaaaaaaaaaaaaaaaattaaattagctgggcatggtggctactgtagtttcagctactcaggaggctgaggcaggaggatcacttgagcctgggaggtcaaggctacagtgagcctgggtaacagagtgagactgtctcaaaaaaaaaaaaaaggagaaaaagaaagatgtaagtgtgtaagtgaagcctggagatgcagacacctgcgaatgggctgctgaggggcacttggctatggctggggctcaggaaaagtggagctcagggaagagaggctagaacagggctcaaagggccttgaaggccaggcctgtcagggtccatcacctcctcaggctggagaagtcagtgcaagctgcagtgatggggtcctgaggccccagtacttctgcccatcctctcccactgtctcccaagatcatacagggaagcctgtttccagatgcctgtgatttatttccaaaggagagctacagcacataggaaaatacacatggcttttcagtctacatttttacagagaaaagagattcggtcattggctttctcagtgccatcatcctgttccatgaggctccaggatggatggcctgtctccaagatcccgctttcaaagcagcagcttggccaaggcctctgggggtaggagtgaagggcagcgacccccatgtgcgggtggaggggaggacatgagcagcactcactgcaaagctaaggcaaagaatagagctggtgggagatgcctcccctcaccccaggggcatggcttgctgaggcccaggatacagaccaggaggggtggggatgggggtctggtccagcctggagcggcagcaggactctgagtgtacacatgggtgtggggtgaagaggggggcatgctgaagaggaagcctaccagggtatagaggggctttagcttgcatattccccctgccccagaacagctcccagaccatggtccccaatcctacacttggcccctctcttaagttctacttcaggtgggggtcctgctcaggttccttctgccaccttatcccctcccactgtcagtgcaaaacattcttagggccaagcccctgagtcccctgcacactgactggagctgcagggaagggaggacagcaaggtgctagctgggagcctcccccagcaccaggaattccttgcacatctctcggacaatcatgcggtccatctggcactggggtgaggtctcctcctcattcaggatgcgtcgcagtatggcctgcaggtcgggtagccggtggcggtgctgcaggtagggtgtggtgcggactatagcatgcatcagggagaggtactccatgcgcagctgtgggaagagcaggccagctcagggaccccagggaggtactgcaaccaccactggacagggacaggaccccactgtcccacagaccccagggctgtggacctgaacatcagggctgcatccccagcacccacaatatacctggcacagaattggtcttcaatagtttttgagtaagcgaataaacgaatcatcccagccacagacagccccaagtatgtggcctgcccagggaagtcctgcccatcctttgaagctgggtctctcaaggtgcctctgtctatcagtcagaggccctctgcttctcaccctatcctctcttaccctggaagacctcgtgcacattcacagcttcaaatagtgaaccactctcatacctcttacctagaactcccctgtgagctccagacaagaatattcaactgcccacttgacatctcctgcacatgtgacagacctcaaatccacatatctaccaccaaactcatgatctttcccatcctcccagagttgaaggttttctcatgttcttacctttagaaagagcactgttgccgattcaaaagcacaggcctgaaatatggtgtcctctttgcttcttgtctcccacatacctcatatccaagccatgtctaagacctggccatcctacctcctacatatgccccaaattcatctccaacagcctctcctccaacctatactcccaacacctctggctgaaccagttccaacagcccttatgatctatatatatatatcatatatatatatatatatgatatatatatatatatatcatttttttttttgagacagggtctcgtgctgtcacccaggctggagtgcagtggcatgatcttggctcactgcaacctctgactcctggattcaagtgattctcctgcctcagcctcccaaatagctgggattacaggcatgtgccaaaatgcctggctaatttttgtattttttttaagaagagacggggtttcgccatgttggccaggctggtttcaaactccagacttcaagtgatccacccacctcggcctcccaaagtgctgggattacaggcgtgaaccaccacgcccggccagcccttatgacttgacagcttgttctcacagagacccccagtccactgacctgatgtctgcttccctcaacatccctcatttctctttttacctttaattagagaaataataccaaaacctcctttaggcagcacaccctgctaagtcccagccctgggagtcatactgaggtgcctgcacatcaaacaccagcgtctaagctatagacaaatgcagagccatgtgcaggcctgaatgtcattcaccaccgcaaacctcaaacggacacacagcactgcctgagcctcccactgcttttctctgctgtgtcactctcccttagagtagtaataatgtccaccttctctgtctttgaaacctacctaccttgtcagctggccttgtgcttcatagagaatacagaagtaatcttgcagaaacccgtctttcccctcagtacccacatctcacctgtccctaccagaatgagcagccctagctcctgtccatgtgggcctggacctgaactctcccctcctgccccatccacttgactcctgtggtggctcaccatctccaacacatcatccatctctctgtgcttgctggatcattccctccggctcagaacatgcaccatcatccgtaccatttttgtttttgttttttaaagagacaaggtctggctttgttgcccaggctggagtgcaatgacacaatcatggctcaatgcagccttgacctcctgggctcaagtaatcttcccacttcagcctccaaagtagttggaattacaggtgcataccaccatgcccagctaattttattttctactgtggtccatcaggttatacagaggtctcactatgttgcccaggctgatcttgaactcatggactcaagtgatcctcccacttcggcctcccaaagtgctgggattataggcgtgagccactgcacctggccaacatcccccatctgtcacccaagctggagtgcagtggtgtgatcttggctcacagcaacctccacctcccgggttcaagcaattctcctgcctcagcctcccaagtaggtgggattacaggctcccaccaccatacccagctaatttttgtatttttcgtattttgtatttttagtagagaccactttgaccaggctggtctcgaattcctgacctcaagtgatccacccacctcagcctcccaaagtgctgggattacaagcatgagccaccgcgcctggccaacatcccccatcttcaaaacactctccctggccaggcacggtggctcacacctgtaatcccaacactttgggaggctgaggcaggtggattgcatgaggtcaggagttcaagaccagcctggccaacatggcgaaaccctgtctctgctaaaatataaaaattagctgggtgtggtagtgggtgactgtaatcccagcaacttgggaggctgaggcaggagaatcacttgaaaccaggaggcggaggttacagtgagccacgatcgtgccactacactccagccttggcaacagtgggagacaaacaaacaaacaaacaacaacaacaaaaaacccccaaaaaaacactctccctatccccatgtcatctctctccagcaacctcccttccatttttctcttccccttaatagaaaattcacaagagttgtctccatttactgcttccaaccctcccctcatttctactccccaataacttcaagctctctcaaactttcattcagactctcctccttgcaccccactgacactgcttgtcaggcaccactgacctctgtgtggtgaatccaatggccaaccccagtctcgctcaggctcctaacggtatagagatggctgatcgtcttcctctaaacatgtggctttgggctcctgctttcttggttctcttcctgggtttctccctagttgtttcagctgtgcccagggctgcagcccgaacttcccgctgacctgcctatctatctcatttctgaggcaatcacattgtcacaggcttcccatcgtatctctgcatagaccactccgaaatgtctctctagtctcaactcattccccactgcctccctgatgccctcggtacctgggtgtctagcagatatctcctcattcttgacacattcaaaacacgactctctattttcccccaagaagttctcccagcctccccaacttcaaaaatcagcacttcatccatctagctgctcaagataaatcaagtggcaagccctgccagatccacttactaaacactccacagctggcctcttctcgccactgccactgccacgacctatcccatccccaccccatccatgccacctggaccactgaggctgcttcctccctggctggcttccactctgctggcatgcagttgattccatgtgggatgttaatcacatcacattccccggtcctgagatcacaacctcttgcagcagcctccgaggctttgtgtaaactccatcctccatgcctcatctccctccactccctcctctccagcctcctccagccccaccacctccagatcacctcatggctggctcctttgggtcttggtgcacctatcatggcctcctacacttacctggctccagcagtggccttgccccctcatctccactcaatgtcatgccccccaccattttgtttcagtttccacacagtgacccccgctgctgcagccacctccaggcaccttgtctcctggtgacaggtctgcgatgtgccgcacagtgatgtcaatgagagccatcatgtctgtgtggtagaagatggcagctgtggccgggctgccaaacacgtcctgcaggaacttgaggacagagtgtggtggctgtggctcatgtttgaagatgcgcacagggtcatctaggaggcaggggtcatagcggtcagggtggaccttgtggggatcccagagtcaccccagggggttacgggagtcattgcaggggtcatggagtcacagggcatggaagtggtacccgcgcagattcccgggccctcaccccctctgttcaggagcaacaacagcttctcggagaagatcttgacattggcgtgtttgctcagggcagccatgatgacattctggtcagcagctaaggaaggacatgggtatagacagggtgctgagcctgagagccaccatgtgctcagccaccgcccagccaggccccaccccacctggcaggtgcaggttgagagccagaagcaggttcacgcagaggtccggcagctgctctgtggtgtccaagggcagcccatcctcgacgatgttcagtaggaactgggcgaaaggcgtgcccaggtgctctgggagaggggcgcacagaagtctgcagccccattcccctccgacccccgcaccacccacccttcctggctttctgtgagccttggggatagcctctccctgctaggctgtgtagtcagcaggtcccaggccctcgggcaatgggccctggcttaggacctgtgatcagctggtcggttactgcattcttaccatagtgtgcatagggcactgcctctcccatggagaagaccatggccaggatgagggcagagtaacagagtttctggtggtctgggggggacaaggcaggcagtcagagtccccaaagatggcaggaaaccccagcagatggcaggaacaccctccagatagcaggaagttccctcctaccccgccctccagcctcaccctgcgtgtctgtctgcatgtccctcgccagctctacaggcagcacggatgacacaagcgtggagatgatggctgcatccaggctgcacatggcgccaaagcacttgaggagcagcagccgcagtgatgctcggtgttcctggcagggaaccctgcgtgctcagtgcctggaactcccccactatctaggtctctccattacccctcccctccatcctgcacataccatttggtaataggccaccaaggccaggacagactcgaactcgtttctcttgcacattttcttgcaaacttcagggtctgcatcagt

SEQ ID NO: 5201 - DNA, 471 bp, Homo sapiens
atggcgccgaaagcgaagaaggaagctcctgcccctcctaaagccgaagccaaagcgaaggctttaaaggccaagaaggcagtgttgaaaggtgtccacagccacaaaaagaagaagatccgcacgtcacccaccttccggcagccgaagacactgcgactctggagacagcccaaatatcctcggaagagcgctcccaggagaaacaagcttgaccactatgctatcatcaagtttccgctgaccactgagtctgccatgaagaagacagaagacaacaacacacttgtgttccttgtggatgttaaagccaacaagcaccagattaaacaggctgtgaagaagctctatgacattgatgtggccaaggtcaacaccctgatttggcctgatggagagaagaaggcatatgttcgactggctcctggttacgatgctttggatgttgccaacaaaattgggatcatctaa

SEQ ID NO: 5202 - DNA, 3232 bp, Homo sapiens
gcggcatatttccctgcgcggaggagtgcgtgttctttctgatccgctctttcaagagcggattcggaagctgctgtgtgaacggttctcgacagcctcagaaatgtacattttctttttgctgtattgaaaatttcttacagtatttcccgggcttaggaatttgttcgtgtcatcgctgaatcttcgcgatcacccccagaaggaagtggctgagccgagatcaggcccgtcgactccagaccaggggtcctcgacctaagtggttaccagacactcgagtgtgcgaacaactttgggcccagtggtgacctgcctctgagcagaggcccaggaaacactgaatggataaatgaatccgtaacaagggaaccaggagagaagctgggaacaggccgtgtgggacacagaagccagagctaggagatctggggctcactgtctgggatagtgactgaaggagtatgaagcactggatgggacccatttgtatctggcacaatctactacctttggggtctctctgcagctccaacacttgtggctgggcttcaagggacagtaagatcctgtatatattttgggcctaccccttccgcatccagcaatgaaatctgagtagaagtaggttgccaaggcctcccctggctcagctcaaatctgactctggcctaagtttcacctcctgcctagacaatctagaagccccaatcctcaccaagctgacccccagcctcaccccagtgagtggcagtggaagggcaagctggagtggcccacaccgttaactctttccctctccctgggcaaggagctggggcaggcccaggagtggaccccagcaactcctagccaatccctaaatccaagaattggccagtgatgcccttggcagttgagtcgtgcacagagagtcactgtgggccagacacaaacaactttaccaggccttgttcccacctggagccaaacccagacccctgtcccccaactatacctccctccctaccagatgccatcccccttcacttggtcttctgatcaagtttgcgctgtaccagctggctcaggaggaatgcagtgaggatgctgctgcccaccgtgagcaggaagaggccagaaaagttgtgaggccagtgcgtgtgcagaggctcatagatgggccgtcgggcctcatagtccagtgccacagcctccagctgagccagcgtgcacagcaccaagaagatgtggaaaagttggtggccctgcccgaagacatggcagctgccagggaaccagcgctcgggcatgaaggtagagaagaaggcagcagccagcagaaagaagaccacctggcacttgtggtagagaagagctggatcatccgtggtggggtcggaggacacgaagatacgatgcaccacaggactaatgtccagtgcgtaggccaggacggagggcacctcctggcatgtgcggcccagcaggcctggtttctggatgtacttgttatagcaggagccaatgcaggaaagccaggcgagaaaggcagccatgggcagaaaaacagcctgcacctgggcatgccaggcgggctcgatagcatagtagaagtgtgccaaggcactgccaaactggtacacggccacccccacatagtccaggaagaagaagctgtaatgccagaactcagacttggcctgcaggaggtgagccaaggcactgaaggagaggtaggtgaaagaggcaaggacaatgatgaagaggggcagggcgtgtgggtctccccagaagtccacggtctccacaaagagggccagccgcagcagcagtaccagggccgccagcaggtgggtccagacattcacggcctcgttgtgctgctggaacagcgtgcggaaatagaagcgccaggtctgatgcagcggccggtagcccgcatagatgtacggcttccagaagagcggcggcacctcagctcgatccaccgtgaagacaggctctggctgcagagatagctgaggctcctggatgacctgccgcagactcggcaggaggtggctgagtttctgggccatggccatggctgtgggcctgggcagggagctgggagagagaccagagcaaagtcaggggcctggtgtcctcacccccacgagcagcagctggggggctctgatgcccaaatcctactccctcctctccgacagccttatccttacactcggtttaagaacagaagactcatcctatggaattcctcatctctgacctcatgagagcaaggatccctgatgtattccaggtacctagaacagtgcctgacacatagtaggtgctcaataaatgtttgaggaatgtattaactaataaggctccctgtcttgttaatttcctttccggtcccaggctccacacagcagcaccagctgttttctctcctaaagaacagatctggccatgtgaaacacatgagaggggtgaggcgctctcagcccgtgttcatgccaccattagtgttcaactggtggcaataatgaccttgctaatagacccactgcctctacctatctagctcctcaagagtggccagggtcccctactgaccctccattaccctgcatgacctggtccctgctaccctctccagtcttgttgcacaaccacagtgcacttcaaatccagacacagccccaccaacccctggactgctctttcacatgtctgtagctttacacgagccgttccctctgcctgagacattttcctcatcttgcctactaggcaaacccctattcattcctcaaaaacccatttcttggctaggcatgcggcctcactcctgtaatcccagcactttgagaggtcagagcaggaggattgcttggggccaggagttcaagaccagcctgggcaatgtagtgagatcctatctctacaaaaaagttagccaggtgtggtggcatgtgcctgtagtcccagctactggagaggctggggcaggaggatcccttgagcccaggaatttgatgtacagtgagctctgatcacactactactctcaagcttgatcaagcttgatctcaagcgagatcctgtctcttaaaaaaacaaacagcggccaggtgcggtggctcacatctgtaatcccagcactttgggaggctgagacgggcggatcacaaggtcaggagatggagaccatcctggctaacacggtgaaaccccgtctctactaaaaatacaaaaa

SEQ ID NO: 5203 - DNA, 435 bp, Homo sapiens
atgcccaagaataaaggtaaaggaggtaaaaatagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgcaggcatacggcgagcttccagagcatgctaaaatcaatgaaactgatacatttggtcctggagatgatgatgaaattcagtttgatgacattggagatgatgatgaagatattgatgacatctaa

SEQ ID NO: 5204 - DNA, 3334 bp, Homo sapiens
ctgaccacagggagctctgcacacacgagatgctggggcttccctggccccgactggctagccacaggcagggctggcaggaggaggccaccgccaccctgcgtgtcccaggagggcacggacagttgagaacgcccataggaacgctgcacagtggagaacgcatgcaggcctccaaccatggccagggccctgcggcgtggccccgtgtctacctgtaaaggtgtggggcagacccgaggagctctaacccagcgcctgggacttcaacttcagcctcgtaccttgctgccacttgggcctttcctgcagtcgtgtaactgacagttagacaggtcacggctggaggctcccctcggagcacaggcagcagctctgccatgggaggagccggctccggccccagaaccggccacttgtagacgctcggggcagacagtcaagactaggggaagtttgtgagctgggtgacatctggttggtcccctgaaatctgcctcggtgggcagttacaccacagccatgggcaaatgctgcaaaccaggaccccctccccaagctggatgctcaatgtcgtcagcaccctgcgtgtaacctcacttcctcccaccccaccccagagaggaaagggcttcaaactacacgcaacacagctcacccaccaagcatgccagcacgagagaacgtgccccgtctctggggcgcccacctgtgccagggcctcatccagggaagcccctcacacccaccctcttctatgccctcctgaggtgagcgggtgcctctccacctcaccgacccggtgctcacagccccaggctgcaaccctggtgcggagggcagccccaggccaaagcgtggcagcactgcccctcgccaccaccacttgcaaggatttccatgaagccctcccagcagggctccctgctctgccccgcaaggaccgcctagcccgcaccgcagggtgatcctgttaaaaccaagtcggatcaagtcaccggtctgctcaaaacctcccaggggctccacgtgactcagagtgaaagcgagtcctgccccaccctggttggtggggcctggggtgaccgagtcctgagacctgtgtcctgtctcctgtgacttgcggccctccctcaaggcctggacagcagcaggctcctgcccttccaaggcctccaggtactgggacccaccacctggcaaggaccacgccgggcaggaggagaccaggaggcgacagtcagacagagaagctgaagaaaccagaaggcgtctgtgcaagagagccccacacagacactggaaagaaccagggcaacctgcagaccaactcgaaagacctcccctagggcgacggaaatgagatgaggcaaacagcttcccgaccagagcccatgcaccttccacgtctgtgcagggagctcggggccacatcccgagatgggaaagacaactgaggcttccacaaagaaattacaatgaaacagacactggccaggccagctgaaaatcagtgatggactacggtccaaatcaacgtggaggttccaacaagagaaggacggtggtggggtcaccctaccccagcctgcgagtgccccagagggtgcacaagcaggacagccaccctgttgcagagtgtggtgctttcacaccatgttcaccccacctcagccctctggcccagacgtcggtggctcctctgccaggtgaggtgaggtgaggtgaggtgggagcagacagtggagaaacaccacaaacagcacaggtggtcggccagggccacgagcccttcagctcaccgatgccgagaccccacaatccccacaacaaacctgcaaggtcagaataattgcgcacgtgtacggacgactaagctgaggccccttcctccttcacctccggaatgccacctgagcgcaaaggctttgggacacaaagcactcagcagtcggcagtggaggcacagcccaggatcaagaccctgggcttcctgtcccaggctcctcaacctgcaggcggccacacagcaagaagaccctgggaagttaaagaacgaggcgctcctgcttcccccaccctcaacggccagcaaggacacaaaggcagcccagggcagggccagccgccagccacaaggcccctccagaacccaaggtccagtggagactctgaaagggctgattgcagggcccccacggggtccacacaccagacacagaggcccatgcagaaaggcggtaaggggcccccctggggtctgcacacccgacacagaggccctgcgagagggaggcatggagcgcccgcggtgtcggcacaccaggattcacagcccggctctccacccccagctgacctcgctgtgaagagatggtttgtgctgagagcttagcaaggccgtcgtctaccgagtgcttcccaccacagcccatgcgcaggcatgagagtcatgcctcccgcaggccacagcttcactcatgcaaggacattctgggggccgggacgtcctagccagtggctagaactgggtgtgaccatgggcccccttggctggggagaaaaggaggtgcccctagatcccaagtcccctggggccgcagcaaagggaggaggaccttgcatcactccagggtgccacgtggacgaacagaggtaacattgggagtgtggctggcagtgttggacattcagaacatgtctgcccaaaacaaacatggccttcgcttctcccagctcccagaaacaaagtaaacagaaggatcacgtctggacaccagggaccagcccctgttacatccctgtcccccccaggccagagcctgaccactccgtgtcacctgcctctactcctgtagtgactgtcaactttttggatttcagaaagccaaaccagcaagggaagccttttcccggggggtagaggtgtctctcctacacacacccctaccccagggtctgagatgacatcccaaatcaaacccggtattctgcagagatacacaaaggttcaaactacagacagccttgtatcagctgtaaaggggggccagattttgctgcaaaagaaaaaacccagtatcccctcgctcagcccactgtgtcaccaagagggagggtgggcggctggccgaagagggctccattttatagtccaggaaggggtggcctgggccccacagctggtggggcagtggcactggatctgaagcaaagctgggcactggaggctgtgccttgggccggtgtgctggcagcgcctgctggaggagccaaggggcactgattcaacactgactgtatttccggaaccagagttagtattgggggtatg

SEQ ID NO: 5205 - DNA, 4622 bp, Homo sapiens
acgatcccggcactacagtcccggcgcaaccacccgcactcagattctccccaaacgccaaggatgggggtcatggctccccgaaccctcctcctgctgctcttgggggccctggccctgaccgagacctgggccgcgactccgtgagtccgaggatggagcggcgggcgccgtgggtggagcaggaggggctggagtattgggaccaggagacacggaacgccaagggccacgcgcagatttaccgagtgaacctgcggaccctgctccgctattacaaccagagcgaggccggtatgaacagttcgcctacgatggcaaggattacatcgccctgaacgaggacctgcactcctggaccgccgcgaacacagcggctcagatctcccagcacaagtgggaagcggacaaatactcagagcaggtcagggcctacctgagggcaagtgcatggagtggctccgcagacacctggagaacgggaaggagacgctgcagcacgcggatcccccaaaggcacatgtgacccagcaccccatctctgaccatgaggccaccctgaggtgctgggccctgggcctctaccctgcggagatcacactgacctggcagcaggatggggaggaccagacccaggacacggagcttgtggagaccaggcctgcaggggacggaaccttccagaagtgggtggctgtagtggtgccttccggagaggagcagagatacatgtgccatgtgcagcatgaggggctgccagagcccctcaccctgagatgggagccgtcttctcagcccaccatccccatcgtgggcatcgttgctggcctgtttctccttggagctgtggtcactggagctgtggttgctgctgcgatgtggaggaagaaaagctcaggcagcaattgtgctcagtactctgatgcatctcatgatacttgtaaagaggactatgcctgttcctgttctggtgtctgcgttctgatctctttctcccctgggtgtccctcatctctgacagcagcaggagtcatttttcctgtcattaaccccacaaggtggaaggcagcccctgcacacagaagtctgtggtattaagagatgaattttcaagcccgtgcagcttttaccctatttccagggctctttcttggattgtattttctatcttttccccaacctttttaaaggaactagattctgaaattagcagagaagagggatgccacaagttctcatcttaggtaactttctagtggaactcctcttctgctcagctctcctacccactctcccttccctgagttgtagtaatcctagcactggctctaatgcaaactcatggatctataaagcaaagtctaacttagatttatatttgtttggaaattgggattcatagtcaaagattgttctttcctaagagggaaatataattgcatgctgcagtgtgcagagggttggtgtgaaggagggatgcagggaggaagggagggaggacacacaagcagcactgctgggaaaagcacaggcggcctggatgtcagtgtgaggggaccttgtgctgtcgttgctgcaaaaccgcatttggcctgaggctatgttaataaagatactgcctttagaataggaggtgctctacagtgatgattcattcagccgacatttgctgtctgccagacatatgacagaatgtttttgcatctggggaaagtcattgaagtaaaatcagaaaaatctctagccttgtggagcatgtgttccagtgggaagaggcagacggtacatacactctaatatatgcagagtaaatgaggaaagtgttagaaggtgataagtgctgtggaacaggtgatcagagtatgggttgtgggacagagaaggtagctattgtgccggggttgtcagcgtgggccttgttgggaaggtgacctttgatgaaatatttgaaggacataaaggaatttgtcatgagggtatctggaagaagttttttctagggagtaggaaccttcagtgtcagtgtaccagggcaggatcatgtctgtgtgttctgggaagaacacgggatcgggtatggctagagcagagagtcactgagataaggtcaggggtttggtcagatcatgtgggcatagggctcaagtatgtgggaaggattttgattttgaatgagatagttttaagcagaataaagacatgccacaacttctcttttaaaaggatcactgtagctgctctgctgagaacagaatccaaaggccggcgatgagcaaggcaggtgggaaaactgtaggaaatgagtgcagtatttcaggctggagatgtcggttacttcaactggggtgtgagcagtggaaatagtgggacgtgattggattcctactatttccaatcactttataccgcattttctaatggactaaatctggggtatgagaaagaagagtaaaggataccaaaaatgtcagactgtgactaaaaagagttgccatcagctgagaatgagaagactagcaggagcatatgagaggaggggacgtcgcaggcagtcactatgggagacgtgggatctgagatgccgctgagaaataccagtgaggtagtcgggttggcagttggacagatgaatctggagacatttaggagaaatagacttgggaggtgatgtcatataacagttatttaaagccttgagtctgaatgacgtctccaagggagtgattggctgtagaagagaacaggaacaaggactgaacactaggcctctgttgctaaaggatctgatcagacaacacacctagatcagactgcacagtcctgaccccacatctagaaggtacatagaccagggagttctagactttcctgtggacaggaatcacctggacatcaccttaagtctaagctgatctggaatcgagaatgagatttcctacttatataatgttgctgttggcgctgatgctgctggtcttcagatcccacttttggtagcaagaacacagaccaggattcctaggctatgcatcagcctcgcctgtgaggcttgttaataagcaattcctgcactccatgcgcaacattctgacacaggggcatctgtggagaggcctgagtattctacaacaagcccacagcaaacctggtgctcagccagatttgatatcactgagatcagtagttggagaatgcccaggatggggaggggtctcagacccacatttaagtgttgctttattctgggttttttatttatttatttatttatttttaaggaggatgtgtttctttaattataagacaggatgctgagagataaatgtcattttctctatcatggggtatagccagatggaagattgagaagtggctcacagctcagcagaatgaaaaaatatctgaatgctgctttctgaaactactctccagaatgatttcacactcactccttggagcaaacaatgacttgcaaatttttctaatttaaacataaaggagtgtacatattggtattagtattcattttattttggggaagggcactgtattagtccatagtccgttttcacactgccgataaagacatacccaacattgggaagaaaaagaggtttaattggacttacagttccatttggctggggaggcctcagaatcatggtgggaggcgaaaggcacttcttacatggtggtggcaagagaaaatgaggaagaagcaaatgccaaaacccctgataaacacattggatctcaggagacttattcattatcatgagaatagcatgggaaagactggcccccatgattcaattacctccccctgggtccctcccacaacatgtgggaattctgggagatacaattcaagttgagatttgggtggggacacagccaaaccacattggacacagaaccaggtttgaagctacacagccaggaacataatccacagccaccctaattcagatctctcataggaaccactgtccctgctcctgagcacagatgctactgcatatacctctgataccctgatggccgacactgggccctgtggcaaagactgctatcactgctgctcctgagaactgctccactactgctcctcagccatctttaccaaaatgcagtatttactgtcccagcctctctgtgtcatctcatcctgattagaagcccacatgtggttatctaaattgtgcagccaaagcctcttgcagtgtttaactgcaataatgttggggaaagtgaatttttctcctttgtagaaggaggtagtccctgccttctaataagactcttcaacataggaagagaattcagttgctggaggtagaggggtgagggatggaaaaagaatgacaaatttcaattcctagaatcatgttctgagactagaactttatctagtacattgcaggcacctgggtttggttgagtgtataataaatgacatagttcaacttattcccttgacagtttgttttggggtccagcttttgtctaccccagttttcacacacagatacgtggagaagcattgtgtgatggtaaaatgtttacttgaaagcctttttccctatctttgtctcttgctaggattaaaaacccgtatctgt

SEQ ID NO: 5206 - DNA, 2615 bp, Homo sapiens
atcacttctgctcacaactgcccagtcccagccagtcacatggccccatctggctacagagggtcaggatgtacaatcctgccatgtgcccagcatatggtgaacagcataatgacttccatactcatgtatctaaacggtccaggagaaacgtggtttcaggcatggctggatccgggatctcaagagctattaccatctctcagctctgctttcttgtgtgtttcttgctgcccctcccagtaccctccttacagcttagtaatcccagcagaaagagagcatggaccagctagggtacgttccagcagagcaaggtgaaaaagagctgaaagtggcatcagaagcccagagttctggttccagctccgaccactcattcagtgtgtgacctcaggcaggtcaccagcctgagctgtgccttcatttcatctgtcagacggatgactctgcccctcagagcttgcagacggcaaggtgataaggaacaatatggacttcttgcagctcctggaggcagacgctggagggctgggctccgcctcagtcacaggcaatgccctgatcccacaaagccccggagatgctgtggaccaacttgcaacacaagaccctaggagggaggacggctgttgtcatctgttgaccacaaacacgtttactgtgcacacttgtgcacatgggtgagctccgtgagtccagacatgcacagggcaggtgaatgcatggagtaccatgggcattatcccaggcccacaggcacgtgcaatcacacacacacgtggacatgccactgcgcacctaagacacacacacacacacacatgcatatgcacacacacacatatgcacacacacacacagacactgtaaacatcaggctcaaaggcccatccaggagaccaaaggctgcaggtgtcttcacatcacagcccaggtgaccttgtctctggctcagggcccagtggcctggccagctctggacatccagtcagcctcattagctggcctggggtccagggctcgaaagtggcggaggaatgaccacccactggcggaggtagctccgggggggtccttcgtccccggggctggtgaagtcacactccacagggctgctgcagtcagagcccacaaagccactgtcaaacgtgtccatatccaggccggccaggggtgagcccgcctcactctctgagacccctccaggtgaccggccaccccagggcagtcccccagcccagtcctccccatctgcaaggggtggctttagtctgtccaggaggcttcccaggggccctcctagcccagggctgccagctgagacacagccacaggacaggactgtggtccctgcatccaagagtgggtcctctaggcctgggctgggctccaggccagcatccaggtccagggctgggtagccgtcatcctcacagctgcagggccaggtgcatggcccctctgcatctagcacagtcactgtgtcaatggacaccaggccgtatggccgatccctctcctcactgtaagctgagccccccgagttctgggctgtcggccagaagctgggcttgggcacaccgtcagactccaccagctctgctggttcttgtagctccgtgagctgcagcctcttggccgggctccgtggtgggtggcagctgtacacctccagggtggagggcacctctgggctccagggtcccagctccaggctggagccagtgaagggtgcacccacccatttctgtgagagagaaaaagagagagtcatagcacaggatgagggtaaggtgagggtttatttttcttttacttttattcttttgagacagtctggctctgctgcccaggctggaatgcagtggtgccatctcggttcactgcaacctctgcctcccaggatcaagtgattctcctgcctcagcctcccaagtagctgggactacaggcgcctgtcaccacacccggctaatttttgtatttttagtagagacgtggtttcaccatgttggccagactgatcttgaactcctgacgtcaggtgatccacccgcctcagcctcccaaagtgttgggattacaggcgtgagtcactgtgcccagccaaggtgagggtttaaacagacagaaagacagacacagacacagagacaagacaaagagacatcaagagagacagacagagacatgaagatagacaaagacaccgagagacagagagagagagaggaatcaggaccacaatgtgctcccaccctagtggatccccctcctactctgggcctcagtttccctacttgtagaagggagttgctacccttagtagtgtgaccagtcagacaactggtggccccatagtccaggcagggaccaagattcctgagtcaaggagacatgggggcaggagggcctgaggtctgaggtacccctgagccatctcctgctttcccgcctccttgatgcttcttgaaacctagcactctcctggtttatgtgtccccaccagacagacacttggcccccggacataagtcttgtctcttctgtccatggctgtagccccagtgcctagcacaaagtaggtgctcaataaatgtttattaacgaaa

SEQ ID NO: 5207 - DNA, 12944 bp, Homo sapiens
gagggtggcgggcttgaggcgggcaggctgcttagttgcggcccgaggcgcctaagtggggatgaccaacccgtgggcgttggcgctgacccctaggcgccgctggtggccccgcgcgcggccctccggccagccccgcccctctcggggctcctccttggtccccgcgccatggcgcgtccgcgttgaccgctgtcttccctttcgggctgtgctgatcgcgaacgctgcgcagtccgtggtggcgtcgaggcacctttctcgtgcctttacctgtgttcactcctttgctttaaaaaacagccctagaagtacacatcgttggccccgaaggagccccagcagccatgtcggaccgcgaggtgaccttggagggcgggaggacggacgaggggcctggcggagctagactgagagggcgccgccggcgtcctgaaggccctgctccccgaatgtgtgggagtgtgtctgacggtgcgagggtggctgtggcggggcctgagcagcgtgtccgtgtcccgatgccgcccgcctgttactgagttaggcaggagtgcccgagtctggcgaacttcagcagttctcgttccagagctccacacgaggttggccaaagctttgcgggacttacatacccttcttcctccgcccagtcctgcttccttccccttcctttcacgggtgttgataccatgtcaacatcctcgtaccccaaactcagtcgcagcgtctgcttctggagaaaccattctgcagcattaaagctggtgagaagatgggattcgaggctgcatcactcaccagtggtgaagtaggagggtgaactagtgaaatggaatccacgagtgggtgaagtatcagacatttcatatatggtgaacgtagtagataaaaggaaggaaagggggattggatagctattgcttagtgccaaccgagactcttaagaatagtggtcagctgaaggcaagcaacaaacagttgtaagccagtgaatctgtcccgttacatatagagaagcttcatttactgcagcaggtcaaagacaagaaccaggcccaggaattaacatccctgtttgactgaactccaaaaatagcaaaacacccaaacaaggcaatactcttccactaagtttggatccctgctaagaaaagatgaggctgggcacagtggctcacacctgtaatcccagcactttgggaggccaaggcgggaagattgcttgagttcaggagttcaagaccagcttgggcaacatgacaaaaccccatctctactgaaaacacaaaaaattagccgggcatggtggccacggctgtggtcccagctgcttgggaggctaaggtgggtggatcacctgagccctggaagtcagggctgtagtgagctgtgactgcactccagcctgggcaacaggagtgagactctgtcttttaaaaaaaaaaaagaaagaaaagaaaagcccgtcatacatgggttggagatacctgggtagatgccttcaaaggttttgactccccaaactgccttaaacctttttttcgtagacagtgtctcactctgttgcccaggctggagtgcagttgctggatcatggcccactgtagcctcaacttcctgggctcaaacgatcctcccacctgagcctcctaagtaactgggactacaggtatgtgtcaccacacctggatacattttttattacttgtagaggcaaggtcttgctatgttgcccgggcttgtctcaaacttctaggctccagtgagccatcacacctggcctgccttgaacctgaagcctgccggggtggctcacctctcctattaacctgacactactcctcctccctccacttactgctcagtagatgtataattatggttgtttcttttgcattattcagctggaaacaatgagatagaaaagagaatatagctccctccccctcagaagaactgcgttattagtttgctggggcttcagtaacaaactgggcagacatttattgtctcccagttctggaggctagaagtctgagatcaaagttttcacagggttggttccttctggggctgggagggagaatctgtctcatgcctctctcccagcttctggtggtttgctggcagtctttggttccttggcttatagaggcattgtcccagtcctgcctttatattcacatggtgatcttgttgtgtgtgtctctccagacgaaggcataagtaacatcattgacaaaggtcattcgacatgggcctctttttagaaggacaccagtcatactgattagggcccactctaatgagcgcatcttaacttgtctacaaagacccatttccaaataatgtcacattcacattgaccaggggttagggcttcagcatcttttgagagggacacacttcagcccataacaagctgtaccacccagccaacatgtactgacaggagctgggaaagtttggggctggattatgagggtgcttgatgaagggagctggaatgtaaacttgcatagatgtgtttattgaaatacgtgatttaacaccttggcaaagagtggctgcagacttcctgcaaggatggctcctagaatggcggtatagctactgctgcctaacaaattactccacacttcgtggcttaaaacaagaatcatttcttatctctaggttactgtgggtcagacatagtggggatcggtgatctctctaggttactgtgggtcagacatagtggggattggttatctctcttccacagtgtctgaggcctcagctggagcagttcagaggctagaggttggaatgagtgaaggttcatctgctcgaatgtctgacagctgatactggagattggctgcagcccagattggggatgtcagccagcacacccctacacggccggtccctgtggccgaggctttctcacaatatgatggctggattccaagggcaatctaaagacaaaggacaaaagaaagctgtatcctttttgtgaaccagcctcagaagttgcataccatcacttcggctacttcctatttggaagaaatgagtcactaaattacccatattcaaaaggagaggaattaggcttcatcttctaaagggaagaatatcaaaaaatttgccagtatatttttaaaacaccacacttggaaaaagccatgggccatggtaagcaaaattgaaatggcaaaattgctatggcagacagtggtggaagggagtaaaaggttcaggggtgtgggcatgttgaaatttatatactccgtgcatctagaagacatttgagacgatcatattccacatgaaggtgtaaataacacgtcatttataaagatcattagacataggatgatgaaaggggcactgatgtcactaaaatattcagtgatggctcatctctgtaggcaagaatgacaatagaaaggctgttccagaacttggctgggtgatagcactggggatgataggatcctaagacaaaagaggccattctgggacatagtggggaccaaagaaaaaaacccaagaagccaaaggcaacacttagctggcagaagtcagaggattgcaattatagcagccagcagggtctgagtggcagccaaggggacctcacttgtatggttatagaactggtcaataaacatggcatccctggaggcaaaacaggtgggcagctaagaagggtactactcagctggcaaaaaaaaaaaaaaaaaaaaaaatccatccaggcacggtggcctgtgcctgtaatctcagcatttggggaagctaaggtgggaggatcacttgagcccaggagttcaagattacagtgagctgtggttgcaccactgcactccagcccgggcaatgtggcaagactgtctcaattgaaaaaaataaataaagatgcttgtcccagttttaaaaaatcaggattccatgcccagcttctggaactgagccagttttcagaaatggaaacattacttgagaggtggccaaacaccaggaagaaggacctataacagtacaagtacaacagaaatgaatccccaggtacttttccaaagggtctgatagcaatttcttttgataactacatcctggagaaaagtgattagccaaacatttggaagacttgtggacacagggtctaaattgatgtccagatgcctagaatatcatccccttctgttagagtggctgcatgtggtggccaggtaattgatggagttctgctaaaggtccagcttacagtggacccgtagacctagtggactgatctagtgatattttcttagccttcgagtgagtaattggcattgacatacttggcagtgaatgctcattccaggtccctgacctatagagttagataacaaaatggaaaaagccaaacagaaacctgaaactgccccatcccctaccaagattataaaacaattatcccagagcgggaatggcagagataagtgccacttctaaggatccaagtgatgtaaagtggtggttaccaacatttttaatttaccagcatgacccctgcagaagtcacaaggatcctggagaatggcagcctactctatttgctgtcaaccagtagttgttttgggtacactgctgcaaactcatctaagaagtatccctggccgggcacagtggctcacgcctgtaatcccagcactttgggaggataaggtgggcggaacacgaggtcaggagttcagtctggccaacatagtgaaaccctgtctctactaaaaatacaaaaaattagctgggtgtggtggtgtgcacctgtaatcccagctacttgggaggctgaggcaggagaatcccatgaacctgggaggtggaggttgcagtgagccgagatcatgccattgcactccagcccaggtgacagtgtgagactctatctcaaaaaaaaaaaaaaaaagtatccgtaatagcctctctgccagatatggtaggtagttgttgactaggtggatttgttcttttctgtacctatcagggatcaaaaacattttgcatttgcatggaattaaaatgcagttttgccggaaggttatgttacttctcttgctctctgtcgtaatccaaagagatctggaccacctagacatcctgtagaatattacattgttcctttacatcagtgacatgttgatcagccagatgagaagtgcagaagatcctggagacagctgctccagagagtggcatataaaccctacaggaatccaggagcctgctacaatcctaacatttttagggctccagtggtcaggggtgctctagggcatcccttccaaaagcgaatgaattattgctgcttgcacctcctgccgttaagaaagcaagacgcttgttggttctcgagctagttcttgcctcaggttctggaggcagcatgtcccacacctgggagtattgctctggtccagagactagtggaattgggagatttccaattttggaaagagcccagaactggaaacgtctgtacagtagatccgggttgtgatgaagtaatgctattgcctgggccatatagtccaacaggtgtttttttggtgttattaatggtgcagaatgatgcaatgtagagattctgtcatgccacctggagcagagaattgtatgcatttggggggcgggcgggtgtagatctgtcttctggtatgccacttgtctctgacagagatggaacgcctgaccgtaagccaccaggtgaccatgcaaccagaactgcctgttaatgttaaactagcaaaagtcataacatcagttggggccagcaacggtccctcataatatggaagtagtatattcaaggttgagcatgagaatgtacagaggttaccaaatgagctgcagagcacagatgcacatgacttccagaactgttggatcagccacaatgtcatttcacacctgtgacagtgtgagggggcccttatagccagttgacaggagtaaaaatcgtgagcatggtgtataaatgggttggctcagtatgagttcaaaatgaaaatagcagctacattacagccttctcaggggtgaccttgaaaaatggtgataagggcatatcctctcaataggcagaatttcaggcagagctcctggtcgtccacttttttgtggaagaagtagcccaaggtgagaatatacatggagccatgggcaatgctagagggcctgggtaactggttaagggcctggaaggaaaacaatcggaagttggagataaggaggtgtgtggtagatttatgtggtcagataaattggaatagcacgaagtacaatgttctttgtatacaatgttaatgcccaccagagagcatccatgaaagaagcattatacaaccaagtagacagttgactcagccagttgatattggacagcatcttttattggctactgtactactggcatgatgggcacatggacaaggtagccaaggtgatggacgctgttcatgggcctgacagcaacccatgctctctacccagctttggttaatatctagctgcccctgaatatctaacctgccagcaaaagagatctacccggctttggttaatatctagctgcccctaaatatctaacctgccagcaaaagagaccagtgctatactcccattgtgggtcacttcatcaaggagcacaaacatccaggtttacagaggtctttagacatagtccccattttataaggagagtttactgtattggaactctcccatcctggaagggctggtggttcacttttcacaagaatagtctcatattccagatacgaggcttgtcttttcctactcacaagtgtcagccagaaaggcttaaggagtgtttgtttcactgacataagcacacaacatttcaaacgagattcactttatagccaaggaagtgtagtgtccatgggccctcctgcctggcagagcgctgagacagcatgctaaaggcacagcctcccaaaggcatgagccactgagcccggcactgaagacttccttgaaaccgttctttgcaatctttctgttattgaccagctggacagtgcgtaactgcatgggaatgcttgcagatcagtaaattcagacaccttcctttccacataagatggaccaccagctgtaccctcccaagttttgccagctggaaatcttcaaaaatccaaccctaaactaggttgtagtgtagcaaccatctttttgtttgttttttgagacggagtctcactcggtcttccaggctggagtgcagtggcgcgatctcagctcactgcaacctctgcctcccgggttcaagcgattcccctgcctccgcctcccgagtagctgggactacaggcacacgccaccatgcccggctaattttgtgtcttttagtagagatgggatttcaccacggtggtcaggatagtctcaatctcctgacctcatgatccgcctgccttagcctcccaaagtgctgggatttcaggtgtgagtcactagtgtagcaactatttatggttcatgccaccataccgtatggatccgttggtagaacaaacctgtattttttcgtcttctgtcaactggtcctagggagcgtcccgtgaaaccacagatgtagactgaggggtgtgaagtagaagaggcggcagcatgtgtttggtcactcacttgggtcacatacttatgccttctgaatctgttcaggcatagttttgtgtatattatttccagtttcagtggaatgctgtttatgtccagtttaatgatttgtgtataggctgtcctcctatggtatgcctcatgcttctgtgggctgtattgggatcagagtcttgggggtctgcaagcaaggtggtattgttgggttttgagaatcagcatctctctgtgaggcactgtatttgttctcacactgctataaagaaatgcctgaggccaggtgtggtggctgaggcctgtaatcccagcactttgggaggccaaagccggtggatcacctgaggtcaggagttcgagaccagcctgaccaatatggtgaaactctgtctctactaaaagtacaaaaattagtcgggcctggtggcgtgcacctgtagtctcagctactcaggaggctgagacaggataattgcttgaacccgggaggcggaggttgcagtgagccaagattgtgccatttaagcctgggtgacagagcaagtctccatctaaaaaaaaaaaatgcctgagactggataatttataaagaaaagaggtatatttggctcacggttctgcaggctgtacagtaagcatagtggcttttcctttggggaggcctcaggaagcttccaatcatggcagaagacaaagggggagcaaggcacttcacatggctgtattaggaggcagagagaggatggaggtgccacacacttgaacaaccagatctcgtgagaactcattcactgtctgaggacagcacccaggtgttaaaccattcacgaggaactgtccccatgatccagtaacctcccaccaggtcccacctccaacattagggattagaattcagcatgagattgggcagacacacagatccaaaccatatcaggcatccatcccaggtgcagtcattaaaagttttctattcaggcttttgaggtgattgtggtggggccccttcaaggtgggggctggacaccagaggacccaaccacatgattggaggattaggattttcagccccaccctcaaacctctggagaggggagggggttggagtttaagttcaatcatgtgatcaataatccaatccatcatgactatgtaatgaggccttgataaaaactcttagccaatgaggcttacagaggttctgggttgtgctgtgttgcgggaagtcagggaccccaaaccgagggaccggctggagccgcggcagagggacataaattgtgaagatttcatggacgtttatcacttcctagtaatactcttataatttcttatgcctgtctaatctcaatcctgttatcttcgtaagctgaggatgtatgtcacctcaggtccactgtgatgattgcattaactgtacaaatcgattgtaaaacgtgcatttgacgaggccaggagatcaagaccatcctggctaacacagtgaaaacccgtctctactaaaaatacaaaaaatcagccgggtgtggtggcaggcacctgtagtcccagctactcgggaggctgaggaaggagaatggcatgaacctgggagatggagcttgcagtgagctgagatggcgccactgcactccagcctgggcgacagagtgagactccatctcaaaaaacaaacaaaccaaaaaaaaaaaaaaacgtgtgtttgaacaataatgaaatcagtgcaccttgaaaatgaacagaacagcgattttagggaacaagggaagacaaccataaggtctgactgcctgtgggttcgggcaaaaagagccatatttttcttcttgcagagagcctataaacggacgtgcaagtaggagagatatcgctaaattcttttcctaacaaggaatattaagaccctaggaaaataattgcattccttgggggaggtctataaatgcttgctctgggagtgtctgtcttacgcagttgagataaagactgaaatacgccctggtctcctgcagtaccctcaggattgttagggtgggggaaaaaaccactccctggtaaatctgaggtcagactggttctctgctcttgaaccctgttttctgttgtttaagatgtttatcaagacaatacatgcacagctgaacatagacccttaccaggagtttttgattttgccctttgccttgtgatctttattggcctcagaagcacgtaatctttgttctcccttttgccctttgaagcatgtgatctttgtgacctactccctgttcgtacaccccctccccttttgaagtccttaataaaaacctgctggttgtgcggctcaggtgggcatcacggtcctaccactatgtgatgtcacccctggcagcccagctctaaacttcctctttgtactctatttctcagactggccgacacttagggaaaatagaaagaacctacgttgaaatattggggatgggttcccccgatagtgctgggagggcagcacgcctgcagtggacacagaagctctgagccccatacctgtcctgctcacctcttccatttggctgttcctttgttgtaccctgtataataaactggtaatcccaagaatagtactttgcatcattctagtaaattattaaacctacaggggtggggctgaaaaccccacaaacttataaattggctgggcagaattgcgggtagcctggaaacaccacttgtggctgacgtctgacgtggagactgagtccttagcttttagggtctgtgctgactccaggtagtaccagaattgaaggactttaggccaggcactgtggttcacgcctgtaatcccagcactttgggaggccaagataggatcacttgagcccaggaattcgagaccagcctgggcaacagggagaccccccatctctacaaaaataaattaattaaaaatggaaggactttgtccttaacttgtgggaactgtgtccattctgactctaggtagtgtcagaatggaactgtaggacaggcagctcgtgttagaaaaggagacaagcctccagcaggtcagggaggcggcagcaggcagcatgaacggtagcccaggctcccatgcagttctccagctctgctgtccccctgcatctatccattcctattctgcatatgaatttgcttttcccgcccaacactcatttgcagacttcccaaattcctaattcatcatcgcttctaaccagaaaactcttctgagagcaagtgtggctctaagcatgtggttgtacgatgccctcatcttaccccaaactcctatcagtcagaagtagcttgcttagtggatggtggaaaggcctcccgaaggctcagttatgatgccagattggagacaatgccctgtcaatatggatgttataatacaggatgtggtataggctttaactgaacaatacctagtgctacttctcccacagccagcatatgctggcttggaaacctaagggctgcagataggaatggcccctcttactgttatgccaagtaaccccagaaggaatttttgcttctcatcttgtaactctgaactccactgtcccaagggaggactgcttctaccaggtacgacaatggtggtattttgaactttgaactagcagttgagactgctgcctgagccaacacccagggatggagttactgcactaactggtgctattgatcccaatttttgagggaaactgggtggctcatacacaatgaaaacaggaacatccttatctgcaatctagtgtcttcactggcaccttttggtaccgaggactttcggctcagtgcagcctccgcctcctgggttcaagtgatcctcctgcctcagcctcccgagtagctgggattacaggggcctgccaccacacccggctaatttttgtatttttagtagagaccgggttttgccatgttggttaggctggtctcaaactcctgaccttgtgatctggccacctcgacctcccaaagtgctgggattacaggtgtgagccaccacacccggctgacagcttcttggcttcaagctagaacaggctcctcacattcatgtcccattgtctttgatgaaacgagggcagttaactgtagaatagcccatgttcatctttttcctcatggtttcatttatttttccttcaataaactataagttagggctggacacagtgtcttgagcctgtattcccagcactttgggaggccaaggcaggaggatcacttgaagctaggggttcaagaccagtgtgggcaacagagtgaaactccatctctacttaaaaaaaaaaaaaaacaaaaaacaactagctcaatgtggcagtgcgtgcctgtactcccagctactcgggaggcagagacagtaggattgcttgagccaggagcttgaaaccaggccgggaaacaaagtgaaaccttgtctctaaaagaaatacgaaaattagtgccaggcgtggtggtgcgcacctgtagtcccaactactcgggaggctaagcaggcggatcatttgggcttggtaggtcaaggctgcagtgagttgtgattgtgccactgtactccagcctgggtgacagagcgagaccttgtctctaaaaataaaaaaattatacccatctagtacatttttggataaagggtccttggctaggtattactgtctagtctaagcgagtatgagtgaaacataaaaaagcacagccagccgggcgtggtggctcacacctgtaatcccaacactttgggaggccgaggaggatggatcatttgaggtcaggaattcaaaccagcctggccaacatggtgaaactctgtctctactaaaaatacaaaaattagctgggcctggtggtgggcgcctgtaatcccagctactcaggaggctgaggcaggagagttgcttgagcccaggaggcggcggttgcagtgagccgagattgcaccattgcactccagcctgggtgacagagggagactcccatctcaaaaacaaaaagcatggccatgagaggtggatacatagtggcagcatctttaaaaaaataagaaaccaagtaagagtaaacaacagtcaagtggctattcaagaatgctccgggttccactgaaaatttttgacttacgagtttaacataaactctctgctcaattttttagtcagtgagaaaggcaaactgataaaatggataaaatggaaaaaaaaaacaacacaagggctattcacaaacaaaacagtgattaa

SEQ ID NO: 5208 - DNA, 208 bp, Homo sapiens
aaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagg

SEQ ID NO: 5209 - DNA, 3567 bp, Homo sapiens
gctctgctgcggaggccgtggccgcgggtagttgggaggaaccgagatttacgcttggtaaggcaagttgcgagctgtccggcgccggtcgagttcctgccgccgtcgtcgtcaggcaggggagaagggggcctcaacccctctagtgacagctgtttgctacctaatagggcttttcatcccaccgggccccagggccttcgttaggagcccagcaggctcaacttcttgctgtggttctggaaaagggagtgaccacctggctcaacacctctctctgtgatgtgtttgggagttttgggaaatgagacggctccgagggaagagcttgagggagcggcgtcgcactcgttcgaccttcccgggcctgggctttgtttctaggcattttaggttgaacgctctacatcttaactgggggcaggggaggtggccagagcatcccgctgagcgttttccgattccccagatggccaggcacctggtcctggtggctggacagtgaccccgtggacgcacatttacagctatagccattcagtgccgcggggaggtgaggatagtgatcctgggacctgctcgaggattcacccttgccccaagaacctgttccattcccaggaatgaaggcggtcaggcaggggaggagaagggggcctcaactcttctagtgacagcagtttgccacctaatagagcttttcagattttgcctcctcaggccattttactcagcctcggactatcaaggatggtcacattgaagctgtttttctgcagtcaggagcgaaaagtcccggctgttgaaggagaaactgaatctggttcaggagtcccaggttcctccctctgagaggccaggtggggcctgcgtgagtagcagttgttcaggtggcaggacactgctgttttcatcccacctggccccaggcccctgattaggggcccagagtgcttatgtacttgcctcggtctgagaaagggagtgactgcatagcccaacacctgtgggatgcctcactgcccagatgtttcatctccgggatgcttcattgcccattcagcaccctctatggtgctgactcttccggaagatgtttctgattccttgctaggctggtggttgcaccatagctgagaggactcaagaagagcctggtctcagcttcacctaggagtcccggaggagtaagaaacacgtatctttcctgttctgggcacatatgggtgggtagcagagctgaggctagctgaggatcccgactctcctttgggagcctttgttgtgccgctctcccaggctgatcagatctggagagctaacagcttcctgtggccacatctgtgtccaaggctgggcccatgcctgtagccagattgccaggatctggaaggggccaagagacagctggtgctgggtaggcagcagccctgtgtcaacctgcccccactattaccccatgctgtgatttgcatgtggtctgcccctgcccaaaatggtattgaaatttgagcctcaatgaggcagtgttaggaggtggtgcctagtaggaggagtttgggtaataggggtggatccctcatggataggttagtgtcctttgtggaggggtgagttcccatgagagctggttagagagtcagccttcctgcggttgtctcttgcttcctctctcgccatatggccacgtaatctctttgtgcatgcctctccccttctacttgctgccttgagttgaagtagcatgaggccctcaccaggtgcagctgcccaatcttgaaatttccaccagaattttgagccaaataaacctgttttgcttttttaaaaaaataaattcccccaccttggctgggcgcagtggctcacgcctgtaatcccagcactttgggaggccgaggcgggcggatcacgaggtcagatcgagaccatcttggctaacacggtgaaaccccatctctactgaaaaaaaaaaagaaacaaaaaaattagccaggtgtggtggcgggcacctgtagtcccagcccctcactcgggaggctgattgaggcaggagaatggtgtgaacccgggaggcggagcttgcagtgagcccagatcgcaccactgcactccagcctgggcgacagagcgagactccgtctctaaataaataaataaataaataaaacaaacccaacctcaggtatagcagtgtgaaacagactaagacattccacatgccctgtggtcccatctgctaccccagggtgcaaagatgttccctcagccctgaagaatgacattccccccggctcctgggatatctggaggggttgtaagcagcttgggttggtgagataaggagtttggggggcagctgattcatgaccctggcctcctcaactgcaggctcttggtctgaagtactgtaattaaagtatgagagcctcggggccctcacttcaaggagggaagagcatccccatgcctcagcgtttggggattgtagggagatgagagtccttcaggtgggactagttcccgccatgaccccactgctggccagtggcctgaaacgcatctgaccacttctcaggttcatgggtgttgaggaggagccctgtggaatcaaccctgtctgcctcctcttatcctgccactcctcttgctctgtctggatgactgcccttgtttttcaagggaatgttccctgtcttcctcagccaggattttttctgaacttgacatctccgtttgttcagggggcaatcattgggcacttcactgtgctggtccttgcattctcatggagatgcagagattaaaaattagtatcttgtccacatactgcccagagttagcaaggattgcttttctgtggatttgtctcaggtcgggcacagtgggggtagggtccttctcgaaccttttcctagcctaaaggttccagctgaatcttcccaggcagggctgaaacaggaaccattttaggctttgctgcaacccatggtcagttctccaagaaaagtgaagagggttccacctggggcagccctcaagggctcagagggccaaaacacacgtacaacatgttgagacactgagtttgtgcgatccccacacatctcagcagtgagtatttctgcctcattttaccgatgaggaacctgagcttcaaagggaagaggtgacagctcaggaccacacagctgtaggtaggaggcaggaaaatagggtctgagtgcagggaacataggctgattcacacttcagttatgataggaaataccttctccataggacataggccaagcaaatgactttgtaacttcatcctctccatctgcataacgtgtgccccaagtaaccaatggaatcacctagagggtgtttaaactctcagaagttctgtaacaggctctccatctacataacgtgtgccccaagtaaccaatggaatcacctagagggtatttaaactctctgaagttctgtaacagggcttttgtgctcctatgctcaggctcacccccacactgtggagtgtactttcattttcaataaatcccttcattccttctttgc

SEQ ID NO: 5210 - DNA, 335 bp, Homo sapiens
gcagccacccgacttggccatggcgagtgcctccagctcacaggccctgaggccgcgccgccggctgccctcaaactcgaggcgctcggacgtggcgaggacgcagaggtgccttgtccttctcacactccgcgaaggccagccactcgagtcgccagagtagtcgtcccggtcgccgccgctgcttcaaaggcagccttagcctcgctgcagccccgatttcctcacacacacacaccgagagggacaataaacagagccgccgccgccgccgccacggtcacctccctcttgtccggcataacaccgcacacacacatttgcacaccggggag

SEQ ID NO: 5211 - DNA, 4650 bp, Homo sapiens
acaaacacaaaagacacgctgaggggccgccggctcccgccgagactgccgcccgcacccggccagcccccgcccccggccctgcactcccatcccgctccgtgtgcgcacggcgtcgaacccccgaagcccgggtttggggcgcccggagggaagtggggggaggggaaggcgggcggaggcgcggcgggtgaacgcccggcctgcgggcgtctcgggccgcggcggggaggggagggaggggctgcccccgcgcgggccccggcgcgcgcccccgaggagacccgggcggcagtgggggaggaggacgcggtcggccgggtcgccgcgccccattggaaaacgctccccagcaggaagctggcaaataggaatccagcgtcccgcgcccgctgtcggacctggccgctgcggcagcgggaggggcggaccgacggcctccttcccgcctgcgcgctcggccaagtgcggccgggtcctgcgggaccggcccgagtccgccgtagacaacttgatccgctaagactcctgggccggccgcctgcgtgcagggcagcccctcgccggtgttggcctccgggatcaggggacggggctcgctctcctcccgggcccgggcccccgacgcaagatggctgtgtcgcgtcggcctctaaacaatgtgtggagcgcgcagctcctgcaccagggcctggtggcttgtcctgcccgcccgtgggggccgtgtgatctgttttcggtaggattgctttggaaaggaattgccgaatatagatagtcaaatgtccgcagcttctgcatagtttagaagaggctgaaaacggcagaaagaaggcaaacgtggtttgggaattagtacatatacctgttttccaattctcagtagcataggaaacggacttttcatggcccaagttatcctcacgacttgtcagttgattggctttggaacctctgaaccgtccctagatggtattgacgcttcacaactgtgtgtaaaggttttcaatggaagggtcatgcaaatatcccgtagggtagtgaaggaggaaaatttcataaatgaagggcagtaattatttgtaatctgaagatctcacaaagcggcttagtgataaacattatcccgaaacagatacatggaaatcagatacgagggaagaaatggatttgtccaaggtcacttaagtgaggaagagacctaggagaaacaaacagacaaaaatccaggcctcccgtttcattattatttcatgaatgttaagtgtccatggttgctgtgcagaacacatgcaatctctaatcctatcctaaaagcacatatgcaatcagcttggaccgagctgccagcaaagaatttcctataattcaagccaagatgagttattttgcttgttttttgttttgttttcaggaaaccgaaatatttattgttggatttatccaggaaggctgttctgcattagttaaatgcatcatatcttcaagaaatgttaaatgacatgggtaatgttttctttgtatgctggatttttcaatagcttctacttcttggctttaaaaaatatttctaaccaagggtcagaccattttaggtagagtaattatgatcttagatgatttgaactaactcagctgtctgtccatttgtgaaatgggaataataatatttatctctatgaagttaggccacaaattctttctagtaggttcaagtatttaagcacctggagaggtgactggttaccctcctagtggcttcaggaagttttctcactgaatgaatatttattgagtgccaactctgctcagcacaattcaggggtgctgggaatgcagcagtgaataacacaagcagtgttcctgccctcatggggcttatgatctctggaagcactgctttgcacagggaagtagcaccaggagggggtaaagaaagagggactttggagccccaagattggcaaaaactatagctaatgagagaggtgaactgtagagtctagataatggggaaggagaggtgccagagcaagaagggattctcacagggccctacgggtcagtcctgaattggctttactagaactcaggcccagcacaatggctcacatctgtaatcccagcgctttgggaggccgaggtgggtggatcacttgagatcaggagtttgagaccaacctggccaacctggagaaaccctgtctctactaaaaataaaaattagccgtcatggtggcacacgtctgtaatcctagctacttgggaggctgaagtgggaggattgcttgaatttgggaggtggaggttgcagtgagccgaaattttgccactgcacttcagcctgggcaacagtaagactccatctcagaaaaaaaaaaaaatagaattcttgggctaataatggcctcaacatttgcagttaaaaaagaaatggggaggatgggagcaaaaggttttaagttaaaatattttccttagaatagagtacttatggccatgaatttagatttgtttataagtagaaaagtagaatggaaaggattttaaaagcaacgctattcatatctgcttggctcctgtcaatcaactgcaaagattactgcctcatggagatgcttctggtcactgtaatgctatctccatgcacactttatcacattgatttcacatcacctttttatcacattgatttacatctatcatttgttcacttgcttattgtccagttcctccccaaagaatataacctctgaggtaatggtggtcttgtctgttttttctcctgtccctgatcatttgctgtacctttttattaggtgatctcatccagttacatggaaattatcatgtagaaaaatagaataaaacaatgaaccccttgtacccatctttagaaattactgactcatgaccaatattgggttccctctatactctactcacttctacctcaccgatttgaattattttgaagcaaatcccagcctgcattatttcatctgtagataatttagtatgtatcataggagtcaaatagatgattgatgtgccccttaaatctcttataatctacagattctttctctgtatttgtactttgttgaaaaatatggattggccaggcgtggtggctcacacttgtaatcccagcactttgggaggctgaggtgggctgatcacttgaggtcaggagttggagaccaccttggccaacatggcgaaaccctatctctactaaaaatacaaaaattagccaggcgtggtggctcacgcctgtagtcccagctacttgggaggctgaggtaggagaattgcttgaaccccaggaggcggaggttgcagtgagcagagactgcgccactgcactccagtctgggcgacagagcaagactccgtctcaaacaaaagaaaaatatggatcatttatcctgaggctttggatccacactgtctaaaactgtcctttccctcagtcttgtccagtaaatagcactaccatttactcaactcaaaccaaaaagtacagacagcctccttgagcctctttttctttcaccccgatagccagtctattggtcttgctctgaaatgcttatcagaatgacctactcctcttctcatctcttacctgcccttcaacagtaactttctgtatgacctttctctttccactcctgcacctctgtattttatttgctaccaagcagacacagattagattatagaatataaatcagattaggttgcattcttgcttaatccattcagtggcctcccactgctcttggttaaattccacatgtgtgggccctggcattacccctctttcccctccgcactgtgctgcagactagccacccctggtccatcaagtcctcctctgccttaggatcattgcatctgttctttctgaagcttgaattctcttccaccagcttttgataggactgtctcaccatcttctaaggcaaactttctaacctttcccatgtcattttcttcttagaaaatgatcatatttggccaggtgcagtggctcacacctctaatccctgcactttgggaggccgaggttggtgaatcacctgaggtcaggagttcgagaccaacctggccaatataatgaaaccccgtctctactaaaaatataaaaaattagccaggcatggtcgtgggcacttgtaatcccagctacttgggaggcctgaggcaggagaatcacttgaacccgggaggtggaggttgcagtgagctgagatcacaccactgcactccagcctgggcaacaagagcgaaactccatgtcaaaaaaaaaaagaagaaaatgatcatatttgtaagttgcaccgaggattagtggagggtatttggagccactcatatggaacttgatttttaaatttgggcttggcatggtagctcaagcctgtaatcccagcacttttttatttgtttgtttgtttattttttttttttttgagacaagagttttgctcttgttgcccaggctggagtgcagtggctcgatctcggctcactgcaacctctacctcccgagttcaagcgattctcctgcctcagcctcctgagcagctgggattacagacatgcaccaccagttctggctaattttgtgttattagtaga

SEQ ID NO: 5212 - DNA, 6971 bp, Homo sapiens
ggagtgtgggctcggcggtcctgcgggcctctccggcgcgggggagtcctgggaagacgcgcgagccacaacttcagggggcgtggcgggaacgggagcccctaccgaatggggtggcagaagaacgaaggcgacaccaagctggccccttgcgggggtcgggacggcgggagacctcatccggagccctgggcccgcagagccaggagaccgcgccaaaatacatcagggaagaggggaggacggaataatgggcctggggacaaaggaacccactgaaagggaacccactgagggtacggattgcacccgagcctgagacagctgaaggtttgcagtcggtgacgtggcgaggtgggcaagggactccaactcccagcgggccccgcgcggcctgggcggggccagctgtccctggaggctccgcccattagccccggcgcccaggctccgcccgccgtccctggcgactccaagcttctcgccactcacgtcgctccccggccttccgtggattcgctcattcgctctgctaaaatggaatgactacttactagtagttgtataagatttttccctcgatttttgttccttaaacgtgggtaatacctaaccctagagtggttatggggatcgagcccgaggggctgtgcttgactgcttggcgcagtcactactcaaatgttagcttttctttaaaaacaacaacaaaaatctgttatgagtaccctgtccagttctgtgctcggcgacgaccgaatcagaccacgtccctcacaggccccacggtccactggggagagacataatcacaggctgtgctaagtgttaactagcgcacatccacagggcgatgggatatgaccatagcgaggtaaagttagcaagcaagggaagtcaagaaaacgacctgtgagcaacctgccattccagatggctggaaaagtgtgcaaagaggacagaacagcaaagacaaatcctgaaagtagaaggaataaaagggagccagtgtgggcggagtcgagtgaaggtagagaggagaaatagacacagctgtaggaggttagagacggagtccctacttctgtttcggatgttgactaaacaatgtagatagatattgatgtcatagcctggagagagaaattcgggagtcatcagtgtttgaatggagactggatgagctcacaaagagactgggacactcatccctttagcagtcacgacaatgagaagcaaccagcaaaggacacggaggagtggccagtgaaatggcagaagaacccgtaggcctgtccatgttttcctgcccaggggctcccgagggctgactggagcccagccttaaaccccaaatccaacctgcattgtggccaaacggagtcagtgctccctgaacacaaactgcaagttagttatcaacaggtacctccaatgccctgtcaatcacccatgtgaggacaacctggcagcaggaaggagaaaaaacaggagctgctttaatctcccggaatcctcacttctccccattcttgttggtccaaaccatcaagatctcttgcctgggtgacgtctcctaactcttgctgccttctctgtcactacaataatcaaaaccatccaatggcttcccagtgcctttagaattaaatccaaacttggtactgtggcccctgctgccgccccccaaaaaatctctctcccatccttcctgttctctacctgttaatgccttcccatccctcagaacccatcaggacacacgtgagtttgaatgccctgaattgtataagcatggagagcggtataccagggtgtactccagagtgagcaaaatgggaactcatgtcagaaagtgaaatgaaaatgtaggctgaaattctatcagtaatactgcaacaaaactctctgaaaccatctcacttaactcggtccaccaacttgaaagacactttccttttcatctgtgaagcccactgctggggctagcaggctactattatgactaagcaattccacttccatctctcaagctgtttacttcctgaaaggtagctgtttgatccaaacctgtttatgccagaagttcttgtttaatttactatcaaactaatgaaattaatgcaagacagttgtttatacacaaaccagattgcttgctttggaaagactaaaagggagttgttaaaagaaaaacatgccaggcgtggtggctcacacctgtaattctgcactttgggaagccgaggtgggcagatcacttcaggtcaggagttcaagaccagtctggccaacatggtgaaacaccgtctccactaaaaatacaaaagttaaccgggcatggtggtgtatgcctgtagtcccagctactctggaggctaaggcaggagaatcgattgaacccagggggtggaggttgcagtgagctgagatctcaccactgcaactccagcctgagcaacaaagcaagactccatctcttaaaaaaaaaaaaatgctgccaagttaggtacaagtaaagcaactgtaaattatttaatgaaaaagcttataaaaacctaggaagactcagcccccagtttgtttcataaatgtctttaggttctcaagccacttaaaaaaatgactcattgtggtttgtgggtggagcttatacaagaatgtgatgttctactgggcgcagtggctcatgcccgtaatcccaacacattgggaggctgaggtgggaagattgcttgagcccaggagctcgagaccagcctgggcaacacagtgagactcccacctctacaaaaacaacaataattttctaggcatggtggcatgcacctgtggtcccagctactcaggaggctgaggtgggaggatctcttgagtccaggagattgaggctgtagtgagccgtgttcacaccactgcacttcagtccaagtgacaaagtgagaccctgtctcaaaaacaagaatgtaatgtcgtgtgctaactaggagaccaatactgaaagaaagggtcttggtcctacgtacaagagatgtctgtttaaatgttcttggttaaaataagatgtttaaagtgttaagatggccgttagtgctatttgccatatatttctagctccacacttggccagcatttgaccccatttagcttgagtgcggccatgtgattaattttggccagtaaggtgtgaggccatgtgattacatctggccaatgagatatgagcagaagtgacacatgtgaattcagcaagagcacataattgctaatggaagaccagacccctctgcctttactatgtccattggcaaccttcatgatctgtccgcacgggctccaagctgacactcaatacagcacgagtgacaaaatccaccttggctgtttcaagccactgcaatctgggggtaatctggcctttcctgatatacacaatttttttttcccaaataatcccagtttaaccaacatttgttaaaccaatcaactaccaagtctgagtttcctagaagaacaaactggcagtacatataggttggatgacataggctaggacacaatgacaacatggacaaagtgttttatactggccgggcacggtggctcatgcctgtaatcctagcactttgggaggctgaggcaggtggatcacctgttgtcaggagaccagcctggccaacctggtgaaaccccatctctactaaaaatacaaaaattagccagacgtggtggcaggcgcctgcaatcccagctactcaggaatacaaatacagtctcctgattgatcctccaattcaagcaggagaattgcttaaacccggggaggcggaggttgcagtgagctgcactccaatctgggcgacagagcgacattctgtctcaaaaaatgctaataggctgggtgcggtggctcacacctgtaatcccagcactttgggaggctgaggcgggcaaatcatgaggtcaggagttcaagaccagcctggccaacatggtgaaaccatgtctgtactaaaaatacaaaaaattagctgggcatggtagtgggtgcctgtaatcccagctacttgggaagctgaggcaggagaatcacttgaacccaggaggcggaggttgcattgagctgagattgtgccactgcactccagcccaggtaacagtgtgagactccgtctcaaaacaaacaaataaaaaagataataaaatgctttatgctaagaaatgggagtaagatcatctctggcttggatttttcttttctttctttgcaattacaaaatagtttatggctgattttttttttaaaggtctgcctgatacatgctttgcaaactctaggtatttcaactttgtcatcatcgtgtgtgtccagacgcagaggctcacacctgtagtttcaacactttgggaggctgaggttggagcattgcttgagcccaggagtttgagaccagcctgggcaacatagcaagaccccatctctacaactataaaactagccaggcgtggtgttacatgtctctagtcccagctactctggaggctgaggtaggagaattacttgaggccaggagttcgagaccagcctgagcaacagagtaaaactctgtctctacaaaaaatacaaaaattagctgggcatggtggtgcgtgtctgtagtcccagctactcgacaagtggaggtgggaagactgcttgacccctctaggcagaggctgcagtgaaccaaggtcatgccactgcactccagggttgacagagtgagacccctggcaataatagtagttaatatttctcaagaacttcatgtctgaactcactgaattctcacacagcaggccatgagttcaacaatcttttaatccccactccacagatggggaaaccaaggatctggaagcaaaagcctgacgtcacaggctgcggagacacgggacagggacagggcccaggttcttaatctcagtaggtgttggcctccactttgtggaataaacaaggggccaagcccctcgggcttgggaccgtcttaccctcgtcactgccgcgcttctcagcctctctgccaccatctgccctccagcacagaccatgctgagtgttcccagattgtaaaagacatacatctgccctatccccaaacccagcgtcctgggtttgagattacaggcaggagccactgtgcccagccccctgggctatttttaaaaataaataaaatgaaggctttttgtccaaacttcaagatatgttgttagattgaaaaacaaacaaaaaaatgatagaataaaggagattgccactggatagaaaagccagaaaatcaatcagtttctctatttgcttgtacctgcttatacgtctctctgaaaagacacttaagcaattggtaactgatctctagagggagctgagagagactgcattggttggtttctggagcccctccaagtgtgaaccataggaaggtttctcgtatatgcgaaacatgaatacaacattttttgggtcatgtaaataaagttggcatacttagttttgaaattctgctgctgggaatgcatcccataggaatgcctgcacaagtgggttaaaaaaatacacattcatcctctccagcatgtctgataatagtgaaaaactggccgggcgtggtggctcacgcctgtaatcccagcactttgggagcccgaggtgggtggatcacttgaggtcaggagttcgagaccaacctgggcaacatggcaaaatcccatctctactaaaaatacaaatattagctgggtgtggtggtatgtgcctgtaatcccagctactcgggaggcggaggctgcagtgagctgagatcacaccagtgcactccagcctgggcaatagagcgagactccatctcaaaaaaaaaaagaagaaataaaagaaaaactggacaggccctcaactggcagggtgcagtgtggtgggcaccctgaaagacagcccccatgaccctcacctcctgtctgcactgtcctctcagcttgagtgtgggcagaacctagcaacttgttgtaatgtacagaatatagcaagagtgacaagatatcacttccaagattgggttacaaaagactgcagcttccaccttgggcgtcctctctcatttctgtttttctttttttttgagacagtttcactcttgcagcccagactggtgtgcaatggtgtgttcttggctcactgcaacctccacctcctgggttcaagcgattctcctgcctcagcattccgagtagctgggatttcccagatgcctgccaccacgcccagctaatattttgtatttttagtagagacagggtttcaccatgttggccaggctggtctcaaactcctgacctcaggtgatccacccgccttgacctcccaaaagtgctgggattacaggcatgagccaccgcacccagcccttctcatatttctagagaagctggatgccacattgcaactgcaaggtgccctgtgaagaggcctgcaacggcgagaaaacaagggagacctccagccaacagctaggaactgaggctctcggccccatcacctgtgaggaactgaatcctgccaacaggcatgtgagtgggctggaagtgggccctcctcacggagccttccgatgactgcacagccccagccaccagctcgaccgcaaccccgagagcctgggagccagcagctcagccaagcctggattcttgacccccagcaacggtgaggcaataaatgcttcttgttttaagccactcggtggtggggtttgttacacaacagataacttataggcaggatggctcgtggaactgaaatgcgtccatttagtgcactacctgaggccaccatgagaagtggggacatagaggaacaggtaattaacagtgcaggcaggccaggtcggtggctcacacctgtaatcccagcattttgggaggctgaggtg

SEQ ID NO: 5213 - DNA, 1113 bp, Homo sapiens
gccgccgcctcccggccgccctccgccccgcgcgctcgttgaggccggtgctccagagtgaagagcgtggcggtgcggcggtagcgcagggccctcctgcggggccaggcaggggcgggtgggcgctccttgccacctttctgctctccctgctgtccgagaagttcgtgcggtgccagcccagctcccagctggggacagaacaggaaacgtccccggcgagcctggcgggggtggcggcaggggtgtctgtcgcctgcgctgggcaggacgcgcgtcctaccggcctcccactccgcgggcctcaccagccacctcattcccggagcccgggccgccgagagcgccgcggatggacctcagggaaggcctggcgcgccgcctccgggaagccttccggccttctccctccaccgagtactggggagtctcaggccacggtgaatgaagagcaacgggccggagagacctcggcctctgcccaggagcagcgcccagcaaccccgcccacaggggacccggtggacgccctggtggccactttgccaggctccccatctcccagcgaaccagagaggatttccgttcccctcctgcttggtgcctagcgccagggcggggcgtgggctgagcagcccctcccatggagggagcggccagtctacatattggaggtggggctctggggaaagggtgttgttaggaaggcggtttgaggcagcgggaggtggggatgcgcccggcggggaggggcaggtgtgtggggagggcctggggagcgcctccccagccgggcagcgcttccccagccaggccccgcagctggaccccggctccgtccagcctgggaaaggactccacggtttatgctgaagtggtggtggggtgggtgaacgctgcgcaatggaagggcatggccctgtgctaattgccccggggtgtggggctgtggaggcactgcgggggggatgtgctgtgtcagttgggcaatggcggccaactgtggcgtgcaggccttggagctgcccctccatggagctttaataaaggcactagccctgcaatttctgcctgagtttctggcccacagcttggccgactgcagcccctgag

SEQ ID NO: 5214 - DNA, 8247 bp, Homo sapiens
attgcaagcctctgcagaggcgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaaatacaaaattagccaggtgtggtggcgcatgtctgtaatcccagctactggggaagctgaggcaggagaatcccttgaacctgagagatggaggttgatgtgagctgagatcacacaattgcagtccagcctgggcagcaagagtgaaactccatctcaaaaaaacaaaaaaaacaacccacaactgtgggccaaagggacacagcgacaaggggtcccaatgggcgaggctggaataacttgaatagcagaataaagtagcattggattataatgcacagggctgaagaaatatcgatgagtctttgctgatgtaataagtgactgaatgagctgggcagagtgggacctgtagttcagctactcagaggctgaggtgggagcatcagttgagcccaggagtcaaggcctagtaatatcccatttccaaaataaaagactgaattaataaatagatgggagagaggagacaattgaccatgcaggaggagtccaaatatttgttctttgaggcaggatcttcctctgtcattcagaaggctggagtgcaatggtgcgctgttgccttgctgcagcctggacctcctgggctcaggcagttgtcccacctcagcctcccaagtagctgggaccagaggcatgcacatccagccgagtccaaatagtgtatgcagatatgccctcacagaggtgacctgaactttctgagttgtgagtgagcttcacctggggacctccttttaggtagcagggaaaaagaggagggtgagccacacccaggcacctccttccagagagcatgtgcctcagcctccagagtagctgggattgcagacatgtgccaccagcccgactaatttttgtatttttagtcgatacgggggggtctcactatgttgcccaggctggtcttgaactcctgggttcaggtgatcttcccacttcagcctcccaaagtgctgggattacaggtgagataaaacttccttattcacagactacatgattgtctatatagagaacactcatctaaagcaacagcaatgattgccacaaagaccctcgtagagccagtaagtgagtttggaatgttcaccagtaacacatacaaattaatcttagggctgcgtgcagtggctcatgcctgtaatcccagcactttgggaggctgaggccgaggctggtggatggcctaaggtcaggagtttgagaccagctgaccaacatggtgaaaccctgtgtctactaaaaataggaaaactatccaggcatggtggcgggcactgtaatcccagctactcaggaggctgaggcaggagaatcgcttgaatccgggaagcagaggctgcagtgagccgagatcgcaccattgcactccagcctgagcaacaagagtggaactctgtctcaaaaaaaataaaagacccggtgtggtggctcatgcctgtaatcccaacgctctttgggaggctgaggcaggcgtatcaccaggtcaggagttggagatcagcctgaccaacatggtgaaaccctgtctctactaaaaatacaaaaattagccgggtgtggtggcacacacctgtaatcgcagctactcaggaggctgagacaggagaattgcttgaacctgggaggcagaggttgcagtgagctgagatcatgccacatttgaacccgtgaggcagacgttgcagtgagccgagatcatgtcactgcactccagcctgggcaacagagccagactgtctcaaaaaaaaaaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcatatgtaaacgtaaaacaaaactataaaatgtttggaagaaaacagaaaaatacctttgtacctgatgacatttggtagagttcttagacatgatcccaaaggcataatccacagaagaatccataaaagaaaaatttgtaaattggactttatcaaaattaaaaacttacttttttgagatagggtcatgctgtgttgtccaggctggagtgtggtggtaagtcatagttcactgcagcctcgacctcccgggctcaagccatcttccttcctcagcctcctgagtagctgggactagaggtgcaagccactattcctggttttaaaaattttttccagagtctgagtcttgctgtattgcccaggctggtctcaaattcctagccttaagtgatccttccaccttcggccccaaagtagttgagattacaggcatgagccaccgtgcctgacctaaaaacgtttgaactaccaaagacagtgtgaaaagaatgaaaagatgaggagaaaatattcacaaatcacctgtcaactaaggacctgtatttggaatacacagagaactcttaaaactcaacagtaagaaaacagtccaactaaaaagtggaaaagacctgatcagacatgcaccagcaatgacacagcattgactgttgggcacaggagaagaggcttgacaccaccagccaccaggaaatgcagattcagccaccacgcaggacacgaggcacctgcaccacagccgcagtgcaagagaatgctggtggtgccccaagctgccagggtgtggacctgctggaaatggaagacggcatggtggtttcctataaagttcaatgtacacagccacatgacccagcaatcccactgttgggtatttagagaatgaaaaacttaagtccacataaaaactgtacgtaaatgtttactgatgccttattcataatcatcaaaagctgaaattcaaatgcctttcattgggtgaactggtaaactgtggtatatctatgcagtgaaatactcctctgcagtgacaatggggagagactgacacattgggcaccatgggggtgggaagaggtgaaggaaggttgggggaaggcgccgtggtcaggtgtggcactaaggagatttgggggtggagccattctgtgtgtggactgtggtggtggtcgcgtgactgtacatgtgttaaagcttcaaacaaaaaagttaaaaattttagtttaaaatattaaaacatttttaaaaatggacacgtattcctgaatttttttttttttgagatggagttttgctcttcttgtccaggctagagtgcagtggcgccatctcggctcaccacaacctctgcctcccgggttcaagcaattctcctgcctcctgagtagctgggattacaggcatgtgccaccatgcctggctaattttctattttttttaatagagacggggtttctccatgttggtcaagctggtctcgaactcctgacctcaggtaatccacctgcctcagcctcccaaagtgttgggattacaggtgtgagccactgcccccggcattcctgatttttaataagctgtaacagaagataatttctctatttggtaaatggtatttgtcaaaaccctgcagcaatcatgcttaagtcaagatatttaaagtattcccattaaagtcagacaagcacagttctccttgctatcactgtgagtgttttccagacatcccagcagggtgagagaactgaaaaagagggaaggagatgaatattggagacagggtttagtagtttgttgatgatacaatcatctgcatgtaaatccaagaaaatcccctgaggaaccctgaggaccagccgaggagttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccaacactttgggaggctgaagcaggcggatcatttgtgttgaggaatgtcatttgtggtcagcctggccagcatggtgaaacccatctctactaaaaatacaaaaattaggtgggtgtggtggtgggtgcctgtaatcccagctacttgggaagctgagacaggagaattgcttaggcctgggaggtggaggttggtggtgagctgagattgctccactgcattccagcctgggtgacagaatggtactctctctttcacacacacacagacacacacaaaataaagaaaaagggctggcgtggaggctcctgccataatcccagcactttgggaaaccgaggtgggcagattgcttgagttcagttcgagacgagcctgggcaacatggcaaaaccccatctctacaaaaataaaaaattagctgggtgtggtggtgcctgtagtcccagctactctggagggtgaggtgggagtatggcttgaggccaggagcccgaggttacagtgagccatgattgcaccactgcactctggcctgggtgacagagtgaggccctgtctccaaaaaaagaaaaaaaaccccacaccataaagggggtcctactgtgtccggaattggtgggttcttggtctcactgacttcaagaatgaagccgagggccctcgtagtgagtgttacagctcttaaaggtggcgtgtctggagtttgttccttctgatgttcggatgtgtttggagtttcttccttctggtgggtctgtggtctcgctggctcaggagtgaagctgcagaccttcgtggtgagtgttacggctcttaaggtggtgcgtctggagttgttcattcttcccactgggttcgtggtctcgatggctcaggagtgaagctgtggactttcgcggtgagtgttacggctcttaaggtgctgtgtctggagttgttcattcttcccactgggttcatggtctcgatggctcaggagtgaagctgcagaccttcgtggtgagtgttacggctcttaaggtggcgcgtctggagttgttcattcttcccactgggtccgtggtctcgatggctcaggagtgaagctgcagaccttcgtggtgagtcttaacagctcttaaggtttcgcgtctggagttattcattcttcccactgcgtctgtggtctcgatggctcaggagtgaagctgcagaccttcacgatgagtgttacagcttttaaggcggcgcgtctggagttgttcattcttcccactgggttcgtggtctcgatggcttcaggagtgaagctgcagacctttgcggtgttacagctcataaaggcagtgtggacccaaagagtgagcagcagcaagatttattgcaaagagcaaaagaacaaagcttccacagtgtggaaggggacaggaccaggttgccactgctggctcgggcagcctgcttttattctcttatctggccccacccacatcctgctgattggtccattttacagagagctgattggtccattttacagagagctgattggtccgtttttgacagggtgctgattggtgcttttacaattcctgagctagacacaaaagatctctacgtccccaccagggtagctagatacagagtgtcgattggtgcattcacaaaccctgagctagacacagcgtgctgattggtgtgtttacaaaccttgagctagatacagagtgccgattggtgtatttacaatcccttagctagacataaagcttctcccaagtccccaccagactcaggagcccagctggcttcacccagtggatcctgcgctggggctgcaggtggagctgcctgccagtcttgtgctgtgcgcctgcactcctcagcccttgggtggtcgatgggactgggtgccgtggagcacggggcagtgctcgtcggggaggctggggccacataggagcccatggaaggggtgggaggctcaggcgtggtgggctgcaggtcccgagccctgccctgccctgcagggaggcagctaaggcccagcgagaaattgagcacagcagctgctggcccaggtgctaagcccctcactgcccggggccagcagagccggtcggctggccgctctgagtgcagggcctgccgagcccacgcccacccggaactcttgctggcctgcaagcctgcccacatccctggttcccacccgcgtctgtctctccatccacacctccctgcaagctgagggagccggctctggccttggccagcccagaaaggggctcccacagtgcagcggcgggctgaagggctcctcaagggcagccagagtgggtgccaaggccaaggaggtgccgagagcaagcgagggctgagagggctgccagcacactgtcacctctcactaccagacccgagcagagctgtggacaacacagtatgggaattaagcaggtgagatgaccagagtcctcactggcactagaagatggcagcccaggagaaagctaccagccagagcgaggcctgccagagatagccacatctcctctcagagaatgggggtgatgaggccctgcaggccaatctgccctgtgctgtggggcagaggaagctgtgggactggacaactccaacattcacagttgtggcaccagctgcaggtgagaaatgtgaggagggaccctgccccctcaacctctgaggggccctggcagactgggggctgtcgccacctgagggttcccagccttcctacaaggcagtgtgcatggtgatgactgaagtctcggggtaatctcccagcaagaggtcaggtcctggttgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagcaaccttcggctggacgcgctggctcacgcctgtaatcccagcactttgggaggccgaggcgggcggatcaccagaggttgggagttagaaacca

SEQ ID NO: 5215 - DNA, 611 bp, Homo sapiens
ctagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatata

SEQ ID NO: 5216 - DNA, 5552 bp, Homo sapiens
acagcgtgagggccgccgttgctggagttcagcttagggaaggaggactctgaggaggccccgagcggcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaaccttctgcagctcactcgtggagtttgtagagatgcgtaataatccgaagtgttaaggaagaaggttctgttgagaaaaagttggagggctgaaagggatgcctttcgctatttcgacatgtgtggctgtaccccagagtgccctggctaacacgcaaaaccatgaattaggcggcttggcgaggctcagtggaggctggggccgagagtcatgtcaaagtttgtggggttaacctgcacccagtgacagtcatggcgaagtttgtgaggttaactcgcacccagtaacgctgttccaatgcaaggtgtgtatttggtgtcatccacgggaagaggaaacagcaaattttctcatggccttggcagttccacatgatggacatttcatatctgcagttttcttcgcatgagatggcttttttgcacaaaaacactggaatccagtgagcaagaatgatagaatgcaagatggatttccacatgaggaagtgtcacgaacaagcgttttgcatctctgtcagctggattcccccatgtgtacgtatgtgagaacatgccgtgtttcctgtctgtaatggtagaggcagccctgatactggattttcacctgaggatggatagatcttcagggttcaagtgggtttgcatctggactttagggtggccctgtaggccctgtgtgagaagcccccttcccagtgaactttcccttgtgtgcccgcgtggacagccaacagggggagcagtgcgagcgtgaaggcagacagtggcctggcccagtctgatggtaagtgggccagaggcagtgagtaccatttcttgatctgactactcaagacaggcgcttccctaggtactttcacacctcattgcgaggtacgtgttgttcccattttacaggtgcagaagctgagctgcagaggcgttaggtacctgcctcataagtggtagagactccagtgtcaccctgcccctcacgttcggagcccccgagggagggtctgccgggcagctcagcccagcactctgtaaggaaatcttcagtgccactgcccaggatgtcttcccggggattgggcctgaatgtcttgaccatgccgtgctggaggtaggaggggtgtcttcatatggaagaactgtacatatttctttggcagatggctgaactctgtgaccccggggcctgtttcagcctcctgctgtcagaaagcagctgtttgggaagaggctgtgattcggccttgtttgagggccgatactctgaatgggtgaggcttggaatcctccctttggaacaaagaaacataatgattttgctgaaggtagaattgggggactaggcagagtggcctcctgccctccctggggtggttctgtcttttgcaaaggtggctgcatccttaggggaaggtgaggggagaagcagggagcatggagagaagtggctttcgattttctctctccttttggggagttcctccttatgtggctggtctggtgcatagtgtgatgtattcctgtacgcaacgttgccctgacagccagtccaagctgagtctagagctggcaaggtgagctcccagtagtaagagggtgtgggcggcaagccacccaggcaccgaggcaagagacagaggacacgagctgttccagtataataaaatataaaacaagaatagttataccagatatagatcttagatatgattatatatgaatatcattaatcatgagtttgcagcaattactttttattccaatattatgataatcctcgctctataatcatagcctaggaaaaaccaggccatacagaggagctgaggggacatagtgaggtgtgaccagaagacaagagtgcgaggcttctgttatgcccggacagggccacaagagggctccttggtctagcggtgacgccagcgtctgggaagacgcccgttacccggcggatcgtggcccagtggtagcaaaaggtgtcaaggaacaacactcactacttagcagaccgggaaaggggcggggggggggtctccctttccccgggggagtttagaaaagactctgctcctccacctcttgtggagggcctgacatcagtcaggcttgcccgtagttatccggaggcctaactgtctccctgtgatgctgtgcttcagtggtcacactccttgtctgccttcatgttccatcctgtacacctggctctgccttctagatagcagtagtaaattagtgaaaatactaatagtccctgatatgcagaaataatggtataagctgtctttctctctgtctcctctccctctctgcctcggctgccaggcagggaagggccccctgtccagtggacacgtgacccacgtgaccttacctatcattggaggtgactcacattctttaccctgccccttctgtcttgtatccgataaataacagcgcagtcagacattcggggccactaccggtctccgcgcattggtggtagtggtcccccgggcccagctgccttttctcttatctctctgtcttgtgtctttatttctacactctctcatcgccacacacagggagagacccaccgaccctgtggggctggtccctacatctggcgctctgacgtggggctctccctcgctgtgtgaagttgcaccctgagtgcgggatcagcggaggagttcaacgagagattcctgaggattgcagtctataaacttggtggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatga

SEQ ID NO: 5217 - DNA, 571 bp, Homo sapiens
gtttggtaccgagcggagaggagatgcacacggcactcgagtgtgaggtggagagcgatgtggggcgcggcagggggatcgcgtagaggaaccttcgcgcaccgcctctccgggtctgggaatctgctgaactccttgcctctcctggggtccctcgaacgccccagctaagaagggcgggggccttgccagggcgcgagcaacatgacgttcaaggtcttcctgtggcttctgtaaagaaatgttcacgtgggagcctgtccacatgggctgtactaaggatctggcacgaggaagaaatatcactgcagaacctgaagccctccgttggaagggtcgttcactcgagtacctattctaagtaacagtgacacaaaacacatgttagaaaaaaacaaaaagtatggtaggttatactgttttttaaaagaaacttttatttatgccttttgctgttaagtcctctaattttacattggaactgagtcattcttggagcaaaactagaataggtttgtatttgttttctttttggatgtgtatctaaattgtacataattaagaaaaagca

SEQ ID NO: 5218 - DNA, 351 bp, Homo sapiens
ccctcctccatcagtgtcattaccaaagctgactgcgcttctccgggtatttagtactgtggtgaggagcattggggaacgcttcagcccaattcgggtcctccgattactgaggcatacgtaacagatattctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcatg

SEQ ID NO: 5219 - DNA, 5094 bp, Homo sapiens
gtcctcggcccccgccccattccgttcgcggtacgtacgtccttgcccgtcaccctccaaaggctatcctttatgtttccctccatcgaatcctagccgcgctctaccttgggcctctgctaggtcttgcctcactcgaagaaagcgcagaaatcgaaaacgcgggtgagagtttgtcctctgcggttcccgtgtacccagatatggcggccgaagcggcgccgcggaggtagctgtagttccggcgccttcaccgtgtgcccgaggaggctgcctggctgggctccagcctcctggcggttctccgctccgcaaccccagcaacttctttgcactgcagaattttgaagcgccattagctttgaggagggttcatgctcagttgcccaggcaggagtgcagtggcgcgatcatacctcactgcagcctcaacctcctgggctcatgtgatcctcccgcctcagcgtcccgagtatctgggaccacagatgcgcaccaccaagcccagctaaggtttctattttttctttctctttttttttggagacacggtctagttctgttgccaggactggtctggaactcctgggctccagcgatcctccagtcttggtctcctgaagtgctaggattacaggtgtgagccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacaggcgtgcacgcccctctaaattttttttggttttttttgagacggagtcttgttctgtcgcccaggctagagtgcagtggcgtgatctcagctcactgcaacctccgcctcctgggttcaagcgattctcctgtctcagcctcccgagtaactgggattacaggcgcccaccaccatgcgtggcttttttttttgagacggagtctcgctctatcacccaggctggagtgcagtggcacgatcttggctcactgccagctccgcctcccgggttcccgccattcttctgcctcagcctcccgagtagctgggactgcaggcgcctgccaccacacccggctaattttttgtatttttagtagagacgggctttcaccgtattagccaggatggtctcgatctcctaatcttgttatccacccgccttggcctcccaaagtgctgggattacaggcgtgagtcaccgcgcccagccgcccggctaatttttgtatttttggtagagacgaggtttctccatgttggccaggctgctctcgaactcctacactcaggtgatccgcctgcctcggcctcccaaagtgctaggattacaggtgtgagtcactgcgcccagcctccaggctggtcttgaccttttggactcaagtgatcctcccatctccacctctgcagtaactgggactacaggcgctgcaccaccagccctgcagtcttctttgtgtgtgtgtgtgtgtgtagaattggggtttcactatgttgctcaggctggagcttgagcttaacaagacagcggccattctgggtgctgcctcatcgaccagctagctatgtgtgcccggctgttgtttgaaactttgggcccagctagtttttagaaaaaaagaaaaaagtttaatagcgatatagaaaattgagcacctaaattatcagcaactccaggccatgacccagtgtcccattctccttcacggtttgctggtgtgtagcctcctggatacaggcaatgtatatagatcgcagagaatgtccgttctggcctcttccttggaagggtctaaaaacagaccttaaggagctaagtgacttccccaaagcccacagctccagtgccactgctgacttttgggtgggggtgggatcagttaaagaggaaagctttcagtactgtcagcacatacacctgccaattaaggggctggatagagttcatctctaggagcaggacctccacccccaccctccaccccagaagccatgtcatgctgtttcaccaggatcttgcctgaggttagatgggagagaacagctacaagcttgggtggagtcactcataaacacaccctgaaagctgtggagcagggagagtgcaggctttagagggctctccatgatcccttcccctcctgggggctcaaaggcaagggtcaaagatcttctcggtcaagtttggggtggcttcctgtcttggtcatcttgtctcccccttcctcttcctcctcttcctcctcctcctcctgctcttcctccccttctgttttctcttccccatctgtgatctcctttccagtccaagtttcctgtagacatgctagatcggatgacagaaaacaatttagatattagtcctggaggcaggggaggctatggcttggcaggagaggagttcaacccttacgcttaccagtttcagcagctgggagcacatgaccttcacagagaaaattttgtaggggctgctcctgatggtggaagtaccagtctcccacaatgtcttcaaactcctccaacatggtctcacactggtcaagtagaagggccagaagagtatctgctctggagggatttgggatcccgcctgtcttctctccctgctcaacctgactgattttggagaggcaggtagccaggaagctaagtttggcctactagatgtgcaatcctcattcattcaacaaacatttaccagcacctattctgccaagtagattattaaactcttgagtctcagctccttgcctgtaaaatatgtatggtaattgcacctaccacatcaggctgttaagggtaaaatgaggctacagatgcaaagtatctggtccagagtctgggacacagtaggtgctcaataagtgatggtggatatcattagcaaccattgttacttttttttttttttgagatggagtctcgctctgtcacccaggctggactgcagtggtgggatctcagctcactgcaacctccgcctcccgggttcaagtgattctcctgcctcagcttcctgagtagctgggactacagatgcatgccaccacaccaccacgcccggctaattcttgtatttttagtagagacagggtttcactatgatggcccggctggtcttgaacccctgatgtcgtgatccgcctgcctcagcctcccaaattgctgggattacaggtgtgagccaccgcaccccaccgctcctggacccactttaatcaatggcacagtcctcactctggccccttccccatgcttaggggtagacatcccctatagtcaaaccctagaacctagctcccctctcaggttcccttctcacctccctggatggtgcagtgtcttatcctacctgcttcttgaggtatgtgacctccacgctgggctcatcccaaagctccagagggatccccagatccaccttcacccccttctgcactaggcctttcagtgttgccatggtctgactctgaccctgagagattaagaatttggcatcagcccagctcaccaccccacccctcccttcccctttctgccatttcagttttgtcaactactggagattcaagggtgagttccatgatggtgagatgatgggcagataacctctggagggcctcaggggatacagatctttgtatctgagaagtggggtcctgccctggggaagggtctgaccttggcatatctcagtgagcccttgcgctcagcgtgaacactatagtccaggatccgctcacataaattctctaaggcctcttccagccttgtctctctgtggaaagagaggaaacaaagattccctggatgctgtaggaactcccagggctccgttgggggttggaaaggggaggagcacgaaggactcacgaaacgctgtaaggcacgtgtctcttcctcttgcctgtatccagcacctgccccagctccagcacctctcgagatcgaccggtgcgactcagttccgcctgtagctctgtgctcagcagcttacacactggtggggaggagaaacgtccggggggaggtaaaagacaaacacaccagccattcattctgcagatgacctgaggcagcagagcatacaagtgcagactatggagccagactggctgggttggaatcctggctcagccatttagcagctgtgtggcaatcttcctgcttgctgtgcctcggtttcttcatctttttttttttttttttcagacggactctcgctctgtcgcccaggctgtagtgcagtggcgcagtctcggctcactgccagctccgcctcctgggttcacgccattctcctgcctcagtctcccgagtagctgggactacaggcacccaccaccacgcccggctaattttttgtatttttagtagagacagggtttcaccgtgttagccaggatggtctcgatcagctgaccttgtgatccgcccgccttggcctcccaaagtactgggattacaggcgtgagccaccacgcccggccggtttcttcatctttataatgggataataggccaggagtggtggctcacacctgtaatcccagcactttgggaggctgaggcgggcagatcacttgaggagttcaagaccagcctggcccacatggtgaaaccccatctctattaaaaatacaaaaactagccaggtgtggtggtgcgcacctgtaatagctactcgggaagctgaggcaggagaatcactcgaacccaggaggtggaggttgcagtgagctgagatcccaccactgcaccccagcccaggcaacaaagggagactccatcttaaaaaaagtaaaatacattaaaaataaataggccagcacagtgactcatgcctgtaatcccaacactttgggaggctgaggtgggtggatcacgaggtcaagagattgagaccatcctggccaacatagtgaaaccttgtctctactaaaaatacaaaaattagctgggcatggtggcgggcgcctgtaatcccagctacttgggaggctgaggcaggagaatcgcttgaacccgggaggc

SEQ ID NO: 5220 - DNA, 480 bp, Homo sapiens
atgatgaacacaaagggaaagaggagaggcgcccgatatatgttctctaggccctttagaaaacatggacttgttcctttggccacgtatatgcgaatctataagaaagatgatattgtagacaccaagggaatgggtactgttcaaaaggaatgccccacaagtgttagcatggcaaaactggaagagtctacaatgttacccagcatgctgttggcattgttgtaaacaaacaagttaagggcaagattcttgccaagagaattaatgtgcgtattgagcacattaaacactgtgagccgagatagcttcctgaaacacatgaaggaaaatgatcagaaaaagaaagaagccaaagagaaaggtacctgggttcaactaaagcgccagcctgctccacccagagaagcacactttgtgagaaccaatgggaaggagtctgagctgctggaacctattccctatgaattcatggcataa

SEQ ID NO: 5221 - DNA, 414 bp, Homo sapiens
ttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctg

SEQ ID NO: 5222 - DNA, 7730 bp, Homo sapiens
agaaggagtgcggtccactggaggtctccctacattcttcctccattatctcactgcctccggtggctgctgggataccggaggactcgggtcccggctcgactcagtcctccagccgcccggggaatacctctagttcttcccggccgccgccgcctccgccccgccgcttcctcctccgcctgccggcctccttcgccccgccccgtccgcgcagctcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacagatggagtctctctgtcacccagactggaatgcagtggcatgatcttggttcactgaaacctctgcctttctggttcaagcaattctcatgtttcagcctcccaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacaggctggtcttgaactcttgggctgaagagattctcccacctcagcctcccaaggtgttgagattacaagcatgagccacctcacctggccaagagctagttgttaaaagagcctagcactacccccctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttataaattacccagccttgggtattcctttatagcaacacaaacggagaaagacatatgcaatttgccattttaatcatttttaactgtacaatttggtggtattaattatatttacaatgttgtgcaaccgttaccaccatctattaccaaagccctttcatcaccccaaatagaaactgtgcttattcagcaaaaactcccattttcctctccttccagcccctggtaacctctggtaacctctaatctacctcctgtctctatgaatttgcctattgtaaatatttcacataatggtatcatacactatccttttgtgtctagcttatttaacttagcataatgttttcaaggttcatccatcttatagcatgtatcagtattccattcttcttttctatggctgaataataattgtatgtatatactgcatcttgtttatccatttatctttttgtttgtttgttttttaaagacagggttttaccatgttggccaagctagtctcgaactcctgaactcaggtgatccgcccaccttggcctcacaaagtactgggattacaggcgtgagccatcgtgcctggcctatccgtttatcttttgatagacattttggttgtttctaccttttgtctattgtgaataatgctgctatgaacattagtgtacaagtcactgtttaagttgttgttttcaattcttttgggtattgtattaggccattcttgcattgatataaagaaatacctgagactgggtaagtgccaaagaaaaaagggtttagttggctcacatttctgcagtctgtacaggaagcatagcagcatctgcttccagggaggcttcaggaagcttccaatcatgatggaaggcaaagtgggtgcaggtatgtcacgtggcaaaagccagagcaagagaggaagtggggaggtgctgcacacttttaaacaatcaaatcttgtgagaactcacaatcttgatgacagctagagatggtgaagccactcatgagaaaccactcccatgatccaatcacctcccaccaggccccaactctaacaccggagattaattacatttcaacatgagatttgcataggaacaaacagtcaaactatatccggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtattttgtccattaaaaaattgagttatttatcttttatttgttgagttgtaggattctttatgcattcaattcttttgggtattgtattaggccattcttgcattgccataaagaaatgcctgagtatattagttttttgtcagatgtatgatttgcaaacattttctccaattttttgtgttatcttttcactttctttatagtgtcacttgatacacaattttgatgaagtccaatttatcagttgtttcatcacttgtacttttgatgttatatttaagaaaccgttgtcaaacccaaggtcatgaagatttttcagtatgttttcctctaagagttttatagcatttaatatttaagtgttttatagcattaaattttggtctttgatccattttcagttaatgtttgtacattgtgtaaaagtataggtccaacttcattcttttgcttgtggatatctagtttccccaacaccatttgttgaagagattgtccttttccccattgagtgatcctggaacccttgctgaaaattaattacccatagatgtgagtgttagttctggcctctcgattctattccattggtctatattgtctacctctgtgccaagtccatgctatttcaattattatagctatgtagtaaattttaatatcagaaaatgtgagtcctacaactttgttcctcttcagattattttggctattttgggttccttgaaattttatatgaattttagaataggtttttccatttctgccaaaagcgctgttgggattttattagcgtgattacattgactctacatatcattttgagtagcgttgtcattttaacaatattaagtcttccaacttatgaacacaggatctctttccatttatttaagtctactttaatttctttccagaatgctttgtagttttcagtgtacaagtcttctgccttcctggttaaattgatttctaaatattttattcttttgggtactactgtaaataaaaaattcttaatttccttttcagattttgtactgctagtgtgtagaaacacgactgatttttgtgtgttgattttgtattctgcagccttgctaaatttgtttattagctttaagaggctatttttggtattctttagggctttctacacttatatcacttgcaaatagagatagttttacttcttcctttctaatttggatttattttatttctttttcttgcctgatgggtctggctagaactgccaatactatgttgaatagaagtggcaaacacaggcatccatggcttctgattttagtggaaaagcttgaaatttttccccattgagaatgatgtcagtcgtgagtttttaatacatggtctttatcatgttgagacagttcctttctattcctggtttgttgaacagttctatcataaaggaggaatggattttctcaaatgttcttctatatcaattgagatgatcatgagtttttcactccttcattctattacttggtgtattacatcgactgattttcatacgttaaaccactcttaaatttctgggataaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcatttctaaacgtttggtagaattcaccagcgaagtcatcagttcctgggcttttctttgttaggagagttttggttgctgattcaatcagaattgaatatcattactttttatagatctattcagatttattctttgttcttgagtcaactttgttggtttgtatgtttctaggaatttgtctgtttcatctaggttatccaattttttgacatatagctcttatacgaattctcttacaatcctttttattcctataaatcagtagtagtgtctttcatttctgattttagtagttgagtattctttttccttaatctagttaaagctttgtcaactttgttgatctcttcaaagaactaattttttgtttcattgattctattgtttttctattctctatttcatttatttttgctctaatccttattatttccttcctctttatggcttcaaactcaattgaacataaagtattaagaaatttgactttttttctcaaatgtctaaaatgtaagaagaaatatgtctagagtcatcaaaaagcagcctgtttgtcagatttactgtttaatccatgtaaacagctttcatataattcatgatagaatattactatgtgctttggaagacactgaggaaagacaaaaggtcattgggcagaaccaccctagattgactgttaaggccatcttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttggttacgggggcagatccctcatgaatggcttggtgctgtcttcatgggattatgttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctggtgccatgcttctcgtacagcctgcagaattgtgtgagccaaataaacctcttttccttatatattacccagcctcaggtatttgtttatagcaataaaaacagactgagacacatgatgaagaccctttgatatcctataaatattgatttctctccctgagagaagagcatgaatctaagtgatgccattactgtaatgtgaattccacaacttttctcaaagatgtggcccatatgtttctaataatggctttctaagaatctgttctgaaggggtaccttctctctgattttcatttgcatttcctgcttagcttacacacttcaacttgcctatccacctgtcctgaccccaataacctccatcatcagacatctcatcttacctacctactttctacttttcccagtccttcccgtgcttcataaaccatgatcatgagctagagacacaaggtcatagctaaggagttgggatcagaaaatcaccttctgtgattttccattattctcaatacgtaacttcaacaaaatcaagaaaatcatgaaaggacatcctaaggggtcaggtgaggttgcagtggggttagtcggtcaatagtttctttatgccaattaggatttctgcagaaaacaatgaaacactggtttaaacagtaaaaatattttaattccttacagaagcccatggaacatacactccaggtttaattcatcagctcaatagcatcatcaacgacttaggttctttccactttctgcttgtcatctgtgttggctttattttcaagctagctcctccctggttgcaagataattgcagcaggtttagttatcatattcggacatgctaacgcccaggctagtgatcccttccttacatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgagctcggcttttgaggagtgggaaaggaggggtgcatagattagtggaagatgagaagctagtggggctcaagtccagcaggagcaggagtttggagccaggacttcctagcctctcagggtttttttttaacttccttacctgaaatgatttgtgctatataacttgtcctggctaaactttcttaatctcaactgtttcatttaatcaataacaactactgcgccaccttcataatatcaattttcagcatttcatttactgaatatcatttcctttccttccagactattctactgtgtcaaattcaatattcctttgactcaataggatctccaatccagtgaccccattatttgtttgtttattaggacaagaaaaacaaactttcccagaaactccccagtagactgctcctcatatctcgttggctagaactgagttgcgtgcccattcctaaaacaaaactggcaagaaagatagttaccaagattggttcagaccaaatcaggattttttcctgaggagaggataaagtgagcttcccgggaggcaaatatttacacattccaaagattccaaagaaaaaaagagaataaatactgggtcgttaactaatagtaagtggtacggtattacaggtaaaatttatccttttagccctagcaacaagtgacaccttctgaagccattattcatttgtcaggaatagggcaagtatcaggaaaagaaacaccgaaataaactctgtttccatttattgcattctagcactggttctaccaaatatttgttggatgactttaggtaaagcatctagcctctctgtcttgattgccacacccacaatatgagataaatattattctgcatacttcctgggagagctgggaagataaaatcagatcattataccacataaagcaaagcaataacacttccatattttagcttcccacactgcctatctgtcctattttcatttattcatttatactttttaacaaacagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgtgagttcacaggtgcctacattgcttttttgg

SEQ ID NO: 5223 - DNA, 3060 bp, Homo sapiens
ttttatctagaatctagatatcaaacttttataatgatagttataacttagtcttggcaaatcaaattcagaattaaccaaaattcctttttgacctgaaatcaaaaacaaattagtttactaatttgtaaaaacatctttgtttttacttctctgaaacaaatgaagatagctggatttttttttcttttaagagatcaaagcaagattaagcatctcatacctatcttaagctgctcagaaccccatatcttttctttccattttgtttcctctgttaacatttggcaagaaggattttataagtttaatatgtatacatgactacagtcatttattctcattaatatcactagctataagtagtggactggttctgtgggagttttttatatgatatcagagtttaaatgattcgtaattggtatctgagaatctcattccataggtcttttactcgtgtacagtgttgtcagattggggatatttgcttgatttttacccagattccttactaatatattttaaacaagtagggtaattattattattattttttttggtggggggtggttgagggggcggtaacttttgtcaagtatttgtttccttattgacaactcattgggttgttgtggaaattcaatttttaattatttttttttagcggagtctcactctgtcactcaggctggtgtgcagtggtgcaatctcatctcactgtaacctccacatcccagcttcaaaggattcttgtgcctccttctcccgggttcaagcacttagcctcctgagtagctgggattacaggtataagtcaccaggcccagctaatttttgtagttttagtagagacagtgttttgccactttgggaggctgaggcaggtggattgcctgaggtcaggagttcgagaccagcctggccaacatggtaaaaccctgtctctcctaaaaatacaaaaattagccgggcatgatggcaggcgcctgtaatccccgctacttgggaggctgagccaggagaatcgcttgagcctgggaggcagaggttgcagtgagccgagattatgccactccagccttggctacagagcgagactccctctcaaaacaacaacaacaacaaaaacccaaatctcatccatttacccatatgtagcaggcaagaactgaatggcaagataccagggaagtggcatgatgacatggctgtttatttcaatacagttttgagacacaggaagtgttgaacctggctttgggtttgccacagaatactgagtctctatagataatatgggtaaaatttctttaggtgtatgtaacatgacctacttgctcagctaagagtgctgattaagtccatgttttcctagttattcaaaataatatatttctaagtcttatcctgtgtgaaaatggtttaaagttcttttttcttcaagttctcttcatagatatttccaaggagtttcctggattgtattcagtttacagggttctttcttagttattactataggagaaaagtgtgtttctgctactgcaggacatgggtgggaaggagtgagtacggacaggtgacacatcagagcccaggggatgtgagggggaaggaatgggtctgtgcagctgtacagcgtgatgataaggggtcggattcatgttgggtgagaagggaatccatggtgcagtgaagttccttagtgtggagtttcagagcccaagtgggatgaggttgacatctacaccagggaggtggtagctgcagagatagaagattggttacatatggaaggagagggattgataaatacagtgagggtgatgagagcaggtttctcatagtaataagagagttccaaatatggaaaggaagaaaactacaataaaccttgtggtattagataggaatattgtggttgtttcaattttaaaatattttaaattatcgaagtaatttataaataattttgaaacaatatagcttaaaatgaaggtatataagtttataaatggagccaaatattatgtatatactcctgaagtgttgccagactttgctgagctttgaaaagaaccatatggtccatggatttcctcggattatatgtaaatttgcatgtgtgtgaattttttttcgggagaaagaatgcatagttttcattaaattctcagaggggtttgtgatgcaaaaaatgttgaacttttttttatatatatgtaactgaggggactctgagtttatttttagaaatcctcctgcagcttacgttaatagagcatgtgtggcctaattaaatgtaggttttaaatcagtcttcatatatatgaggaattaacattttattgaataccttttaatgcctagaagaaaaagtactattatacattgattcattttcacagcaatgatttattctcccaacaatgatacaaagtaattattatcctgttgtgctgatgaggaaactgagattgggattaaaaaggttgcccaatgttaaaaaactagcaagaggccaagtaaggtagtaggtgttctttctgctcctccacactcttatctccagtggagtgcctgctgtgttcagggcattgcacagggtgctggtgatgtaatactgaacacaacagactcttaccccaaccttgtaaagaatataggggaattaggtatagggaattttaaactattgagaatgcatttatttcagatattccttatattgctccatttgctcttttaagaatgctagcaatgtttattgtatttccttaagccacccaatacctttaggggaaaacacctattattcaaatgcacaagtgaggcagagtataaatgtgacttggctcattatcaccaagtttacttgcaggatcaaatttagaaccatggtttgtaatactttatattacacagtagtcatcagtctgcatagttaaaaaaaactaaacctgtaatcctagcactttgggaggccgaggcgggcggatcacgaggtcaagagatcaagaccatcctggccaacatggtgaaaccccgtctgtactt

SEQ ID NO: 5224 - DNA, 1841 bp, Homo sapiens
tggaaagagaagatagtgcatgatcactgtccagtgacttccaggtcattaattaagacaagcttgtccatgggctgcatgtgggccagaatggctttgaatgcagcccaacacaaattcataaactttcttaaaacatttttttttttttgcaatttttttagctcatcagctattgttagtgtattttatgtgtggcccaagataatttttcttctagtgtgacccagggaagccaaaagattggacacccttgattaagaagatatgatcaaaggcagattttcttggttccttgtatttaattgaaagacaaacaggcactgaattttttaaattaaacatctgatccttaaaaaggactcatttctctccatttaaggtaggattgcactcagtaggaaatcctggaatgtgttccactatttttatcatattagctctgtggatataccctttaaccagatataaggtaacaagtgtgtggcacaatcacagagacagaatattgacaggtacagcttccctttgtaaaatctgaaggagaaatggtagaagcaatcaaagcaaagaataaggataacaaaatagccataaagggacaaaaattataaagagatataaaaagtcttgtagtcaaatacaaggattttgtagaaagcccaggatctccagtgaagtagtttcaaaaaggaatctggtaagaaaacatacatagatcggatttgatatttactaccctggctactagaaaggaaccctggagattctagctgtctttagctgccaattagatatctggataatgatgctggtgaattacttaactttcaaacatatgtatctgtgtgcctgtgtgttatacatgtatgaatgtgtgtgtgtgtgtgtggtgccaagtacagtgttcagagttgtagagtctcctgccctcagagttgctcattgtccagctgggagaaacagataagagtacagaactatagtggagtggggtaaatgctataacatgggtgtgcacagtgttcttggaagtacaagttattggaggggagacatgaaaatgaagtaaaaataaataaaatatacaaataaaagtggggaggcagaatacacacatttcaggcaaagggaaaaacatttgccaaataaacaaacaacaaacaaaaaactaagcatttgacagagttgatgacttcttcctctttgaattgctttcttcatttggtttccatgggatcacttcagtagctgctacttctcatattcatttgctattattttatatcttccctatcttccctaacactaagtgttgttagagttccagtgctcagtccttggacatctttttaactctctctgtactcattctattgtactcattctattgatgatctcatccatctcatggtattaaagaccatatatattctatgatgccaaaatgtatatctcctgcctgggacttctgtaaaacctaaattcaacctaaaaactgcctacatggcatcatcacttgaaatgtctaattggcatctgaaaataaatatgtccaaagtgaattctttagctccctcctcccaccacctcctccctaaacctgcttaacacacagccttccccatctcagttaatcccaactctatccttcaagttgcctagaaaaaaaaaaaagcttacagtcatccttaattccttttttttttcatcataccacacaaccgatctgtcagcaaatcctgttgttttaaccttcaaaatctaatcacttctcaccatccccatcattatcaccctggtcaaattcaccattgtttcccaccttgattattgcctta

SEQ ID NO: 5225 - DNA, 2116 bp, Homo sapiens
tagagcagttgcctcctgtcactaagagccctgtgccagtctttctgtgctttcaggaccatagattaatcatagaattgattatgtggaagagtatgattaggtttatcttactcctagactcttgagggtatggatgttgccttgaagtctctactaatgtcttgggaagagttaaagtcatggggtaggtattaaatacatgtatgttaaatgaaagaagccagacatagaagatcatgtattatttgattctgtttacatgaagtgtccccaaaaggcaaatctgtagagacagaaagtaattaatggttgtttggggctgggcattacagggattgactgtgaatggacataaggggtcttagttgggtgatgaatgcctaggcagtaactaaggcgtcatcttctctggatctcagattactttactgtaagggtatgtggtgaggattgggagggagactggatgagaatgttggttttcaaaccacaccatgatgtatgaagatgctttagggattctgcagacaatgaagtaatgacataacactaaataacagagatttagatcctcagggagcccaatcattatctttaactctattgatgttttacttaagagtagttcatttagaaaaaaagaactaaatgtacactaagtgccagtaagatgtatgaaaattactaaactagataaggtctaatatagatttggaagccaaaaagccagcctcttttccaacatttagcaaagattatcttgactgagatactttaggtactcaaattttcattcaataaattttaggatttttcacattaaaataatagttataaacacatatactttaaaatcatgtttttaaattcctaacatatttctaacacttgtatttgtttaacattttgcagatttttctaatgaaagaaaagcctatttgtatgtctaaagccaggcatgttggttgtgtttagatgtcctggtaatgaaaatttgcttaataaattgaggatcactcttaataaatccgagatttttctcaatacacagaagataggagaataaagcacttttctttgttttttttttttggtttttgtttttgtttctgtttttttgtttttttcgggggggacggagtcttgctctgtcgcccaggctggagtgcaatggcgcgatctcagctcactgcaagctccacctcccgggttcatgccattctcctgcctcagcctcccgagtagctgggactacaggcgcccaccaccacacccagcaaatttttttcatatttttagtagagacggggtttcactgtgttagccaggatggtctcaatctcctgacctcgtgatctgcctgcctaggcctcccaaagtgctgggattacaggcatgagccaccgcgcccggccaaagtccttttcttgaattcttgagtttaacatttctgcagaagcagttagcttagacatacagaatcagaattgcttccatttagcattgttcctgctttagaagaaccattttccttgataataaatgatttctatgctcacagaaaattaggaagatatattgagtataaaaagaaaataaaaaagcatccatagtaccaccacctagagatatccacagttaccaattttggcacatttcagtctttttattcaacacttagtatgtgtatatttacttgatcttataggccaaacaaatattagaaaaaattacaaattctgaaatacttctttgtatagaattttattatctttcttaatcatttgtgtgatagaatatattagttctcttgtagaaatttggtgactgaaatggttttaaaacattttaaaaggcagataaatgagacagttccatgaaaccaggtagcaatgatttcagataaaaactgcattatcagttgtggctgacttcagagaaaaggttgtataatttcctatcattgtgaaatgtttccactttctcttgctattgcatgagtgaccttgagtattgccatatgttcatctgtttatataatgcatttctagtttggaaaaatgtatattactttcagaaagtaacaactcatttcctctcttttttttaatac

SEQ ID NO: 5226 - DNA, 2740 bp, Homo sapiens
attcacaaggaatttgtgttcctaaggtagttgtttttgttttttgttttttatttttgagacacagtcttactccataattcaggctggagtgcagtggcatgatgatcacggctcactacagcctcgacttcacaggctcaggtgattttcccacctcagcctccagagtagccgggaccacgggcacgcaccaccacacccagctaattttttgtatttttagtagaggcagggttttgccatgttgcccaggctggtctcgaactcctgggctcaagcagtctgcccacctcggcctcccaaagtgctggattacaggcatgagccgctgtgcccagcccaagataattttcatactcttcataggtagcagtttcatagccttagaaattcaggcagcaaggtactgtgattggtgtatatggacttatctttggagtaaaacaggcactcatcagatagtagctcttgctaattagcacatggactattgaaattccttcctgttaatgccaatcagtcagattttgctacagaacacattttacagaactttctttctttctttctttcttttttgagacggagtttcactcttgttcaggctggagtgcaatggtgtgatctcgactcaccacaacctctgcctcctgggttcaagcaattctcctgcctcagcctcccaaataactgggattacaggcatgtgccaccatgcctggctaattttgtattttaatagagatggagtttccccatgttggtcaggctggttttgaactcctgacttcagatgatccgcccacctcggcctcccaaagtgctgggattaccagcgtgagccaccgcgcccagcctacagggctttcatatgggaaagttaatacttttcagtcctgtgggtctctttaaagcaataagatggcatccttcagtttactcagtggttgctcttgcttttacgcttacatttaatgagttttaaaagtacagttaaagtacttccctgtatttgacatctgtgtctcagtactcaaattttcttttttatcaaaggcattctttacatctgaagtcttacatttctccatatatacttcagtcttttctttgaagaggtttactccctctgctggctctaactgtgaaatgaaagcacgtgtaatctatatagttctgattaccaatctgagggattgcttgcatatgatggtattgccttagacttttttctaaaatgtaaaattaaacttttgtttggctccctctgattctgaataataaaattgcccaaaaatctaagaaatattttatattccttttgagaacaatatgaaattctatgaaactaacagtgatttgataattaagaaattctggcatgcacatttacaatatgtaataggtgctcaataaatattagtttcttgattgcagtcatatttttattgtacatagacattgtgtgtgtacttcattgtaggagcaataaatcacccattctgtttaatgaagtcatctgtgtttctgtagcactttctcaatgccttattatacttccagtaattattgatgaacttcaacattatactacaataaatgtcttctcatttgctgtacagacagccagaaagtataagtaattagaatttgttctgcactctacttttatcgtgaaaaagtaattgaaagtaaataagatatttattcagaaaagccactacctgaatgtgagcatatctgaactaataaaaatagtatagttaatacagatatatagcaagatgtcctcaccatctacatctgtaataatatatagtggtaattgactcccataatggttataccaaagccctgaaggattcttaacttttactttcatttttaatgcaaaaccaggttttcatatattttgcttgcttaaagcaagatatactagctcttatttttcttactaaattacatgcatacatatatttcaaattttattttagattatttgtgctcaaccccatacgttgtcatagagtagtgcttttcaactcgttttccaaggatcactaattctgtagaatgttaatagatgttatgtgagggggagaaagtcattcagctttgtaaatgctgaattaaatatttctttttgaacaaagctggaggcatcatgctacccaacttcaaactatactacagggctacggtaaccaaaacatcatggcactggtacaaaaacagacacatagaccaatggaacagaatagagagcccagaaataaaaccgcacacctacaactgtctgatttttaacaaacctaacaaaaacaaacaataaggaaaggattccctattcaataaacagtgctgggataactggctagccatatgcagaagattgaaactggaccccttccttatatacaaaaattatctcaaggtgaattaaagacttaaatgtaaaacccaaaactataaaaacccacaaagacaacctaggcaatacctttcaggacataggcacaggcaaagatttcatgacaaagactccaaaagcaattgcaacagaagcaaaaatggacaaacggaagttaactaaactaaagagcttctgcacagcaaaagaaactatcatgtttcttttgagtaaacagcctacagaatgggagaaaatttttgcaaactgtgcatccaacaaaggtctaatatggagcatctataagaaacatacaaatttacaagg

SEQ ID NO: 5227 - DNA, 1210 bp, Homo sapiens
taccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcacacctctttgctttaccagtggtgtttgtgagttgctcagtagtaaaaactggcccttacctgacagagccctggctttgacctgctcagccctgtgtgttaatcctctagtagccagttaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcactgctgtttgttactataaattaaatgaacctcatagaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtagaagtcatttatgttatttaaatgatgtactgtactgctgtttacatggacgttttgtgcgggtgctttgaagtgccttgcatcagggattaggagcaattaagttattttttcacgggactgtgtaaagcatgtaactagatattgctttggtatataactattgtagctttacaagagattgttttatttgaatggggaaaatac

SEQ ID NO: 5228 - DNA, 2076 bp, Homo sapiens
tatggaaccaaaaaagagcccgcattgccaagtcaatcctaagccaaaagaacaaagctggaggcatcatgctacctgacttcaaactatactacagggctacagtaaccaaaacagcatggtactggtaccaaaacggagatatagatcaacggaacagaacagagccctcagaaataacgctgcgtatctacaactatctgatctttgacaaacctgagaaaaacaagcaatggggaaaggattccctatttaataaatggtgctgggaaaactggctagccatatgtagaaagctgaaactggatcccttctttacaccttatacaaaaattaattcaaggtggattaaagacttacatgttagacctaaaaccataaaaaccctagaagaaaacataggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggttaatatccagaatctacaatgaacttaaacaaatttacaagaaagaaacaaacaacccgatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaaaaggaacacttttacactgttggtgggactgtaaactagttcaaccattgtggaagtcagtgtggcgattcctcaaggatctagaactagaaacgccattaaacctcttttctttataaattacctagtctcaggtatttatctagagcagtgcaagaacagactaatacaacacaccaggcaaatgcaaaataaaagagagctctgtggcaaaactgacatcagaaacaaacagaatttagactgaagagtaatacaaacagcacagaagttttttgcatactgataaaagatatattctaccagtctatgtagtagaagtcatgatctgtaagaaaattgctttaaaatattgaaaggaaagtctgacagtgatataggaaaactgaaaaactcacaattgtagtaaaaaaatgttaaggcatctctgttagaagttgacaagtccagtaagtcaaaattaaatcaagttaaagatttgaataaaataatgagcattctgggttaagtagatgtgtaatgaagaggttataacttgtttcagtacattaaaaaatatctgacatttctgagtactcactctgtatgaggtactcactcttctaagtgcttggtgcgtagcttaacttgtttcctcctcatagattctcatgaaacaggtggtaggcagttagtgagggaacaagacataattacttgcaggtagctaaaagcaaaacaaatggggccaaatagtttagctcaaggacccaccccttagtggaaaggaactgttgcaacaggctgcaaaaataaagacaatttagacgttctagattaggcacagataagaatgtaacaaagaagaaatcaaccacaactggtttaatccaagatggccagaaacttgactggctgtggacccttgactgcattatgcccctattactataagacttccacggggaaacctcccaatcccatcatgcatctgatgccatgtcaattctggattaaccatatttagtaaagaaaaaagtggcaatccaattctgggaactgcctgcccatttcccagaaaatccctcctcttatgatggaatattccacaccttcattatgcttatctgtatagtatgtgagtcctggccatattgggttcagcttattcttttgagcacactcacaatcctctcttgagtatgtacttgctttcacgctgcaataaat

SEQ ID NO: 5229 - DNA, 1129 bp, Homo sapiens
atggcctggtgaggctgggcagagagaggttggggcagcgaccaggcgtggtctccgccagtgggcggccgcagctgcaaggaactcactgaggccctagccccgccacggctgctcagacgcaggtttggcttcttcgcaaaaatgtggattcagaaaagcacccaggaaggctgaacctcaaagatcagacacaggcacaagtggtgaagcatacaagagaagtgctttggttcctcctgtggaagaaacggccttttatccttctttgtatcctatagggactctcataaaatctttattttttactgttgggtttacaggctgtgcatttggatcagctactatttggcaatatgaatcactgaaatccagggtccagagttattttgatgatataaaagctgacggttgggatagcataagatcacaaaaaagagacttcagaaaggagattaacaagtggtagaataacctaagcgatggccaccagactatgacaggttatcacagctgcaaatgaatgtctttgtattctgtttatagagagtaccttctctgcagcggacaatgatcagatatttcgcatctaatccagcctcaaaagccctttcttttccaatgttgctgtcaacattcagtcatttctccttatttcacatggcagcaaatatcttatgttttgtggagcttcgcctccagcacagtgaacattctggatcaagagcagtgttattatctgcaggtgttatttccaattgtgtcagttatgtgtgtaaagttgccacaggaagatagggaccatcacttggtgcatctggcaccatcatgatggtctttgcagctgtctgcactaagatcccagaagggaggcttgccattatttcccttcagatgttcacattcatagcagagaatgccctaaaagccattatggccatggatacagcagaaatcttcatgggatggaaatttttttatcatgcagtgcatcctgggggagctctctttggaatatggtatgttacttatggtcattaactgttttggaagaacagggagcttctagtgaaaatctggcacgaaatgaggactaatggcccccaaaaaaggaggtggctctaagtaa

SEQ ID NO: 5230 - DNA, 8124 bp, Homo sapiens
aactcaagtacgtttaattcaccacagaggagctaaaagaaaagagagggggttggtaaaatacagtatactttctttaaaaaagacttgggaggaaaaaaatcaacttagaagatcatatgaaagggcaatcacatggaacccagttagtgtcctagtttattactagtcttcagatccagaaaacagagtaagacactaggtaaacagaacacctaggcacatctgtaaggcatttgtttcctatcacacagcccattctagcttaacacccaccaactgagatgtagtgaaatactaaaactggatgctcaaattatgtttttatccaaccaaaaagttctttaaatataaaattcctcactttaaactctgccttgtcttctgtgataccaacagaactttaaggttttatgcaatatgatgatttcgtgttacttttaaaagaacccacaaagtaagcaattgtccacagatgaaacatgggatgaggttcatgactgaatcaatcatggagtgttagtcaattgtaaactcctgaaagttaagactaggaaatgtgtatatcagacacataagagtacaacaataggagaaaaagggaagcctgtttgtcattccaattctgacaacgtacaaggtcttcgaaattcttgtccacgttcatggagccatttattggatactgtgagagaaaagtaatatattaattttcccccttaatctaatcagtatttaattagtttctaaaagctaggtctataacaaagtttcatcatgggataaaagttcaacaccaaaaccggataaaggcagatgctacttaaaaacttggctaaatgctgaaaacacagattttatatacctatatacatatgtgtacacacttgtgtgcgtgtatgtacatacatgtatgtatacacatgtatatttgccagtctatgtgcatttcttacagtttccaatgttcaatgtgaggcttgaaatgagacacaaatggacctaagatacaggtacaggtaagagtagaatattgctttatgtattgttttcaaagtacagcctccaaaatacaaagacaataatgaacacaaactttgcactctaaaggaacaactctcttatcaaccattgctattgtatgctcatcaagtttccaaaatacctttaaaaaatgtataccatgtaaaaatgtatcccaaaagcagttaattttctattttttttttgtctctggtaccatagaacccagtcaaaatatctaaagcaggaaccttaattcttaactctttttccttcttcaacccttgtatctacactttattcatcaaaccctgacaattttccttacatctctctcaaatctatttgctctccaaccctttcactgatgctttaatccaggccattatcatctcccacttagacaacagaaaacagctttctaaactctctctcaccaactagcctctcctcattctagtccagtggttcttaaacactataatcataaggggagattttaaaatcctgatcaggcctcactccttaaccttgtaatgtcctgtatgtaaccactcaacatgtggctagtaacacagattgaaatggatacatggggctaattaatagatattaaaactaattttacctgtttctttttactttttaaaaatgtggtcctgcacttgcatgtccctgactgagagtgagtgcctctttaaattttgcacattaggtgctactcgagcctcacattagaacctggtatctaacatgtttggaaaactgctgttctatcttcaggaccaaatttaaagaaaaagctttgaagaagactccccaaacttaggcagtcaccatcttctgtttacatttttgtattaatatgtactacattataatccattagtatgtctcaatcagattattaaccctttgaggggaagatattgtcttattcaattttgagtcagtcattgtttcttggaataagtaaaaatagttaaaaataaaatctgtcatcaaaattctgatttcaaatttgtattatgattaggcacttgtttggctgaatcctgtacaatgttaaaatcatattaagcaaacatgggggcttttgtttttaagacacagataatagttccaaaataagaaacaaaaattacattatcttcgcagaatatatgaaatatttaccccatttgttgccaactagcactggacaggctgcatgccgtgtactataatctccttctccactggcaaacagattataccagaaaacagcagttccctatggagaacaattcacaattatccccaagtatacaatgccaggtaattgctttcggtagttattactttttttttttttttgagacagagtcttgctctatcgcccaggctggagtgcaatggcacgatctcagctcactgcaacctccacctcccaggttgaagtgattctcctgcctcagcgtctcaaatagctgggattacaggcgtgcaacaccaggcctggctaattttgtatttttagtagagacgggctttcaccatgttggtcaggctggtctcgaactcctaacctcagatgatccgcccatcttggcctcccaaagtgctgggattacagacgtgagccaccgtgcccggccgttttcagcagtaattttccctttgttcctgcggaagaactctatagcagtattttattttcctctaatataattctgaaaatatggttatatcactttaagaaccgtttttgatcatatgaaaaataccataaaaatgtttgacaacaaaagtatttgccaaaagaaagctaacatatcttacatagcaagatggaggggaaaacacaatgcagaacccattttagaaatgaaaaattttaaatactaattcctggtcattcattacctctaagtactcgtggcaaggaccataaaaatacctttaaaaatgtaatttggtcaggcacaggggttcatgcctgtaatcccaacattttgggaagctgaggtgggaggatcacttgagcccaagagttcaagaccagcctgggcaatacagggagacactgtctctacaaaaaatttaaacattagctgggcatggtgacatgcacctgtagtccccactatttgggaggctgaggcttgaacccaggaggtcaaagctgcagtgagccatgtttatactgctgggctccagcctgggcaacagagcgagaacaggtctcaaaaaatgaaaaagaaaaaaaaatgtaattcattaattagaccatgaatacaagtgcatctcttccttagggaaaaaattaataaaccaaaaacaaaacaaacaggcttacttttttgggccaaacactagctccaacttcaggaaaaacagtggctcctcctgcagacacatcactcatctataagaaacaagagggtgttatcaaaagtgctggtagaataaagtaaaacatgccattatatagacttgatattggatactagaatattgggaacatatggacttgttcttatatagcatggttggtacatgctactcagtttttcaaaaataaaatgccatttaggtttatatacataagtaaaaaaactacaaaaagcaaaggaatgaataacaaaaaactatcaggatggaagactggggatataatttgagataggaacttatttatagccagagggaaaaagtaatgacttaaaactaatgagtcaatacacagatataaatatgtattttattgtattagaatgtaatctccatggaggcaggaattttcatctgttttgttcattgctgatcattaatgtctagaacaatagtacctcaagaacagtaggtgctcaagaaatatttaaataaatgtaaaataaaaatactcagttttgccatttctcatggaagggaatcaaacatattaaataaaagtgagaaagttaaaggattatataaagttatagtcataaagataacctagaataaaaatggaaaccttttaaattaaccaaagaatcacaaaaaacaaggcaaaggaaacatggatcataaagatttttttaaagcaacataagtagaatgtatagactgattagatcacagagcaaaacccagctacatattatatcagagctgcatctaaaacaagtgacttacaaacacagaacacaaaaatgtaagattttgggcaaatgctatccaaggaaaacaggatatgatcttagtatgagatacagtttaaatcaaggtaaaaagcattaaatgagatagaaggtattttacaatgataaatacataactaatagtaaagaactaagaacacttaaccaatgaaaaaattaaactctgaggaaattaaaaagttgtgcatgagaggaaaagtaatttgagatattctatgtgcccctctgggaatggtatttaaataacggaaaaaatgataatcaattaaaatgctatacaactattttagaaaaacaggaagggtgtttacattaagagggagaaacagatagtgggccaaataatacagcatcaatattcataaaacaaagaaatataagcagaaccaggaacacataaacactaatggcttttaaacatctgaaaagatgctcaacctctctaataagagaaatgcaaattaaagccacaataactgctaatttaataagtgaaatatacatagatcaaaaagtctgacaaacatacttcacaaacatatcccacttaaaattgggatataaactggtacaacctctaagactcacctctagaaaatatgcaagcctttgcagcatgaatttgtataccgtactaaccctctcctggttttccctttgtggtatttctctttttttatatgaatctttgtaatgtaccttacctccttttggaaacaagatggagttgtgagagaaatacaaattgggaattggggagaaaaggaggcatacggagaggaaggagatagggaagaagggaaagaaaacaaacagggaaggtagcaggaagagaaaaaggaaatagactgaacagacagattttggtagggagtgagatactacagacaacaaaaagatgtaattcaaatagggctaaggaatggaaaaagtgatgaaataaccaaaattaagtctacatataaaatatatatattttttttatttttattttttgagatggagccacgctccgttatccaggctggagagtgcagtggcgcgatctcggctcactgcaacctctgcctcccaggttcaagtgattctcgtgcctcagcctcctgagtagctggtactacaggtgtgtgccaccacacccagctaatttttgtatttatagtggagaaggggtttcaccacgttggccaggctggtctcgaactcctgacctcaagtgatctgcccgcctcggcctctcaaagtgttgggattacaggcgtgtgtcactgtgcctggcctaaaatatcttttttaagttaacaaaggttatgacattatggcagattgcattttccaaatataatacatcccaatatgtcccatcctacatgctctttttatgtgacgctgacattcgtctgcagtggtagggtctgtgtgccctctccttgaagctgggcagacctttgtaattgctgtaacagaatacagcaaaattaacatctgtgacttctgagggtaggtcataacaataccatgtacttttgcattgttcttttgggatgcttcctcttgcaatccagtcactatgctgtgaagaagctcagccacatgtattggccagactttaggcattctggctgacagccagcctcaaccttagccttcaagataccccagtgccaggcatttgacggcaaatacatgtcagatttggagcaggaaccatgagttgagcccagtcaacctcataactgttagagatacattaagaaaatcgttgttattttaaaccactcagaaaggagagttttggagtgctttatttggggtaactagaacaaacactacaatcaaaacttttttccatatataaaaatatataaacaattttaaaaattgaattatgatcatactgttttaaaactctgagatagggtttctgggggttgtaatatgctatttcttcatcttagtactgaatacaccagaagtgttcactttgtgaaaattaagttataatacttaatttgcgcactcttctgatatacttcaataaaaaaatgtaattcagaagtttactgaaataatgtgtatgtgtatgtatagaaattcaaatatatagagatttttatatacacatattatatattactaaacagagagactatatgttaaaatattaatgattatctgcaggtagtggcactataaattctaagtttgtccagaagtttctataatgaacatctatcttatagcctgaaaaagttgcaagtgcaaaataattcttaactcactttattcagttgtaaaaatgttaaactaggatgctgaatcagagctacacagaacaaacttaaaacattaaaatgaatcttgtcatcaaatcccaacttaatctaaaaattttagtgacgacttacataaaacagccatgtagcaattctatttcctgtccccagctctttgaaagcatctggctcatctttctgtgaataaaaacacagtaaattcaatggtgtaaaaattcagtaatacaaatactctagtggcaactaaacatcagtagtaatatcctgaagaatatgccaacaacaaccgcaaaagtttcccttgtaatgtccagtgcactataaacatcaggcaatctttttgtaagatggagtcttgctatgtggaccagggtgatcttgaactcctggcctcaagcgatcctcctgccttagcctcccaaaatgctgggattacaggcatgagccaccacgcctggcccctagtattatttttctaataatgctagtaaagtgactttcagcactataatcaagctaaagaattaatatctaaatatttatatctaaattaaaatacaatacaacctcttggcatttctcccagaaaaatgaaaatgcatttttcacatagaaatgtaaacacatctttatttgtaatagccaaaaactaaaaactatccaaatgtccttcgatgggtgaatggctaaactgtggtatatccgtaacatggaatacaggttgagcataccaaaagtccaaaatgcaaaatgctctgaagttcaaaacttttagtgctaacatgacacaagtggaaaattccatacatagtactccctgaagtagctcccctatcatacacactatgccccagccaggatggaaacagacagttccccataaggctcctgtatcacaagagatttattttcaaacccattctttctttactgaaggtgtaatccttgtggagatttagagtttatgccagggtctcaaattcagcagcctacactgtggcagatcctcctcttacagagctgttattcccaaagctctagttcctggaggcacatacctccagcctctgtgttttgtcccctctttaattctctaagtttgggatcattgttcagtttgccttttggaacaccctttactttcttccaggcttgccaatgcatttaaagtatcttaagtgattttattgggtatctaggtgtttggttttttttttttaactggtaaaaaggtttcacagaatatctgccacaccgtatttccataaattccaaataggctatgaatttttaatgttaaaataacagaattaacatgttgacaaagaatctctccttgacccaactactcaggctcctctgaactttcttctcaagtaggccctgactttgggcttctggtatttacctctgcattgtccaatttaagcaagaaccctgctaagtcaggttagccagaattccccgtccttgccatgtgatcaccctcaaaacctaactgggttcttcatcttccactatcccctggatgatgatcactcttccctgacttcagcaagaatcctgttaggtcagtttagccagaatcttcccttacctcttagtaattttccatctac

SEQ ID NO: 5231 - DNA, 444 bp, Homo sapiens
cacacatgcatgtacaggtaagcacacatgtacaagctcctacaggcttgctctcacacacgtgtatgcacagcagagagacgtatgagcttctactgcacacatgcacacacacacgcacacgtacattcactacaaacgtgcagcctcctgcacacgtgcacattcatgtgtacaccacaaatgagttcccagacgtgtaaacacacgtgcacacatcgtacacatgtgagctcccacacgtacacacagatgcacatggacacaccccaaacacgcacaggctcctacacacatgcacacacgtgtacaccacaaacgagctcccagacatgtaaacacacgtctcccacacgtgagctcccacacgtacacatgcacatgtacgcaccacaaacacatgcgcaggctcctgcaggcgtgaatacacacatgcacacacat

SEQ ID NO: 5232 - DNA, 3167 bp, Homo sapiens
ccttcccttctcattgccttgtggggatttccactgtttacaagtaattggtgcagtgaacatgttctgcttacgtctatttaaaatgtctgtatcatagagaaaaaagaaaagttcagtacatttgaacatttggaggcactgggggtatcacagtagtagtggtcataatagagaagttatttagactcttgtgtgctgccctgctaccacatgaagggaactaagactattattcttcattgtaatatttaatatgtgcccattccagaatcaacaaaaggaaaaaaaaagttgcatctgaaaatattaaaatccaaattttggcagcaaattttcagttgagacaatcaattcggtcccagtaaaggcagtagcaaaaggtcaaaacaaaatcattaaagaagtttctaaagcttctagaagcctcattaaaaaccatatcctgttaaaagtatgaaaaccctggagagtcaggtgagagagcatgaagcatgtgtgttgggagtattcccattagcaagaaaatgggagacctccctgggtttagagagaacttaattccaaagcttcttaacgcgcagcaaaacagacaggcaggaaatgccctacagaagctttcatttacagaagtggcaatgttatcgtaatgattttgttgaagattaaagcaaacaagatttttaggtatctgtaacggtagaacaattgtatcagtgacccaaactttctccttccttggataagaggaaatcagcatcaaaacaacactttctttctacctcagccctgcttgtaagttttcataccttgataaatgagacttctaaataaggtctatgctactgttcaagagggcattgacctccatgtgagcagcagaaataatgaaaacaagagccacaattcattgaggacctactaagactgcattgatttttccatcttgtgaattacctaattgcttactattttaaaatatgtaagcattaagtgtggtaggtaggaatcaaggaagttgcagttaaatcattttcttgcagccacatattgaagcgtttggatcggcagcaggcagctttggaagacgtgagctggacatttccaagatcattgtcagtcagcccttcttgggcaccactggcttctgaagaggactctggagcactgtcctcctgcctgctgtatgcagctggcattcagtggatgtcttatggccattcagtgcttccaccacccatttcccatttggcctcaaacactcttctactgctgctgggaaggcaatattagccaggatggtcatctggagccatcagcttaaccatagccagtggggggttaaaaagaatctatcagtattgttttttcttgaacattttaattctctgaattgaatccaagagggactaggtcatatcaaacaggctgtgggtttcagctgtggtctgagagtgcctgcccttgtgttgaccttcctatttcagagaggtctggagactgtggcacctcggcagagtcatgccatctattcagcagcagggaataccactgcttatccacagaagcacccccaatctcctgtaaaaaataacctttaaggattcaggctttgttctttacttgtctatatcaggtcttcttaacctgggaattcagaaaccctccctctaattccctcaaaagtgtgggccacctttcagaaaagtactgatattttactaacagggattttgaggaaagtattgatatttcagtaacagggattttgctttcctcataatctcaaagacgtgaacaaatgaaaaccatgaaagagattaccaggagattagggttgtgatctagcattatttgtaattttacagaattatcgtgtatgacagcaggaagagccagcaagctcatctattaatataaagttgtttctttcatttcgtattcaaggaaacttaagtacagtgaggttaagtgattcccctgaatcctgaccatgagcaaaatgcctgggttccagacccactagctcatagttcgaagggcttttcatttgctaatatgcctctactttttacaaatttccaaccattcattataaatatttatttcaaatgtgtgtttgtcagaaagaaatgtacctactgaaaatatcataaatagtttcttctgtactatctcaaattttcttgccctattagccacacaattccatttctagttttcttcgcgttcttctctgtttgtttttgtaagtggacaccatggctggctgtagacttccttgatttttccacagtttgcttcccaagctttagattgtcctttctttttacacactagtgtgctgtctaatttgcatactgaaatgaaacctttatataaaacaccttaaaagttctagtatttcttctttatttctgacttttatttttggaatacattaactctaatttgaaatcttattttaaggccagacattctaactgaaacgttccttaagaaagacttctaattactatgttattgtatgacaccttgcctgggtaagaggaaagaaaagaaaaaaataaggacaaacctgttaaagataaagaaagcagatgtgtataaagaattaggttcattcgacactgatatttctgaagaaaactttaaaaatattgtaagtaaaataaaatcaggagaaaatgaaatctttacagaaaataaagataaggcaacaggttttgatacacttctacccgggttaaaaaagtaattcataaactgtcttatctaattaagacgatctaaaagggtacactatgtgtcaaagagacagagcgtcttaattacaaaaggttaatatcacagtcagagtcaagaaataggtggaaagatcactctaataaatactacctggaaattcacccaaaggcagcagatacagaaagtctacattgtagatttttcaccagtatatgacgaaaatttggttactataacggccctaaatacagaggtaaccaattcgtgctcagagcatgatgctggggataagatcaccctaatatgtggaaagacatatcaagacaattatgatgactatatggacaaaagaaggtcataaataaggtcaaatgttctaaaagaagccaaaggagcaatgtaagaattctgaattttat

SEQ ID NO: 5233 - DNA, 1488 bp, Homo sapiens
atcgttgcaaagaggggccggaggcgaaggaggcggcgaggctgtgcggcgggtcggagcgacgccgaggtctgacgtgtccgcgtccctgcggccccactcccggccgccgtgacctccccttgcacggggcggacacgagcaatgtcacgggccccgccgcgcgccgcgagcactcaccagggtgagggctgcccgggtgggctgcagcttcctcttgctcacagcccggacagttgcccggactaaggaagccgacatcttcgccgtcccggcgccccggtgcctcgggccgaaggtcggccgcctcagcttctctccatggacacggcgggcgcattgacgccacaagcttcggcgcacggcgccctcagtcctagccccgccccccgccgccaccattggcactgcctaaaaaatgaaatagactggtttacaaaatcgaaaggaagagcatctgaaacagccttaaaaccgaaaccatatccaaggagagctgaaataaggcatgtgggtggcagaattttgcaagttaactgaaaagcaagaccatgggcaggagttctgaaacaaggccccgccatccggtgcccagtaagcctcaccacgcaccacacccgcgcaggacagacaggagtgctgcaggtcagccagaggaaggagggcccgcactgccagcacagcgcaaggacatggtgcagagctgagagcactcagggagcagctcctgagtgaacagatgacagacacgcctccttctccgtttgagctaggtttacctgaacaaataaaccagttggtttcaatgggacaggtgagggcgatccaaacatacaatctgatttagacattcctaaaaaagaaattagcactttttgttcctactttaaattgaaagcagtagccctgttttcaaactttcacagagagactgtctgttggtgtgacagaagctccactcagtatattgtgtggacaaaggagcaatatatctgaagaaacaagagagagcagcataattttgagagaggaagaagcagctgattatttttgaactgccaccaaaggaaattccctgtatctatccccatgcctccactgtcatttcacttttaaaatatgatgactactaactttaatgtgtcaagactgcattctgaagggaccacatttctagataagtgctcttccttatgcttgataattcccctgccacccggactacccgccccgcatctttttgagttgctgctgtccccacaggctgccaaaatcattggtctaactgttgtgagagcttccctagtacacaacttaaaacttgctgctagcgagaaaaaagaaattcatcaaagctggggcaaattctccactttgttgtaccaaagaggaagactgtaataatgtttcagtcatgagtaatcaacacaggcctcgagtaattttaggaataattttgggaatactatttaaaagttatctatacta

SEQ ID NO: 5234 - DNA, 732 bp, Homo sapiens
acaaagccctgcagatctgctgcttttcctgattctcctgtcctgagtgagtgcaaggggctcccctgtcgtcgatgtgttctttgaagcagatgctgtgcctgatacctgctggagagtcccaccgccttgagtgagtcaacaaacctatcatccttcccatcttccaggatggatattggggtggggggaggttaaagggaataccataaagttgctaccatacggttagggctgaatacaatgggagtacttattgtgatgatgtcaatgatgatgacagtgatgatgatgatgatgatgatatctagaactccaggttttcctggagagaaccaaggaggattccccacttacctaataaataaatgtcctgtaaatgcagaacatgccatgtaattgatgacacaagcgggatctcacttctgggggatgagaatcaattctttatggattcccacagggcagagggacccgggtggagatactaagctgtctgttgtatttccgaacgaatgagtacgtacgtaacagttatcgtgtctccttgtaactcgtgtgctaatcataaaatcttcacaaggattcatgacattcgtgctatgactattctcattttacagtgaggaaggcgggacacctaggaattaagtaacttgccaacatagggacgagctcaccacacaacaaccaagggtggggataccagtcaggtactgcggaaaacactgg

SEQ ID NO: 5235 - DNA, 46355 bp, Homo sapiens
cgcgcaatcactccgggggcggggagagacagacaactgagaggaaggaggtaccacgggcactctctcgcgagagggccgcagagccgcctttgacgggggcgtgtacctggagagcaacggtaaggacggagccgacggctccggcgtcgggtcggttccggcatcgacgtatcgtttggtcgccccagagaggagacaggtttcttcagcttgccgctgaggatgtggcatcggctgcgctcaccgccgccgcctctgtgaactgcgggagttgggacagcggccagggctagatgggtgggacgcgagtcctcgccgaaagcttgccctgtgcggggcgcacttggaggcgagctctgggccgtggcgagttttgcagcctaaggtcttggcaggcgcattgctgtgggctgccggagagcaggctggagttcgagaccgcccaccggagagcaggcgagagttcgaggcctagtgacatctgtttgagcagatgaatatgccattgggaaagtcaaggactgtcggagaggaggacatggcagaccttaactaaagtgagggggacagtagagcactaaaagttctaggaaaggagatgaactgcttattccatcagatgaaaatatagtcagaacagatgagtagtagaacttaaacatgcccggagttgccaggaatttgcaaaagccttgatataattcctgttgctgtagaaagactttctacagtcactaatatatcaagttatgttcactagaaaaaaagtttacttagtttatagaaatgggctgaaaaatcctaattacttatctgtgaggttattttcatgaaggttaatcatccagaaactattagagagcctcggaatatatttcttctaatctgctctacctatcccattcaaaggagggaatctgaagatttaaggacaaagagcagttgaaaactcagagctgtggttaatgggagaatttcaaggatggtgaaaaaaactaacatcattgcatccctgttttttgtattctggactttttagtttagctcttggtaaactacatcagaaattctttatgctaactctaacacacattttggggtattgctaatttaatctttgaatactgtttttgctgtttcatgattatatgttatgtcctaccagctagattgccaactcttgactactgactggaagtttattgtttattcagcaaataatgaattaagtcagtgaagtgagagatttcgtgtgtaaggattgttaacttgaacatttcaccagttacacacagttcagccctacttaaattttaaaaatcattgttggcacttgacattgttatgaggagttttgtattttcaacttgtattttgagagtgtcctcatgtgactgaagtatgtgctactcttcttaattgaataaccccagaatctccagaattgataattggaggaaattctactgttggaaagaatggatggattatacagccctgttttttgactgttcattttgtccttggagtcactaccacttggcctcaaagtgtgaacatgtaaccctttccttaatactttgctacacagctgagcagaaactgtaaatttggatcctttgtcagtacaacttaaaatggaacaatttcaatggcttagggtaagataagtatgtaaagatacttttgtaatagaagaaaaaacattggatattaaaatcacacagtagtacctgggtgtggtggctcatgcctataatcccaacgctttgggaggccaagacaggagcactgctggaggccaggaatttgagaccagcctggccaacatggtgaaacctcgtctctaccaaaaaatacaaaaatcagccaggtgtggtggcacatgcctgtaatcccggatactcgggaggctgaggtgggagaatcgcttgaaccagggaggtggaggttgcagtgagctgaaatcgcaaaactgcactccaacctgggcaacagagtgagacctcctgtctccaaaaaaaaaaaaaaaaaaaaaaaaaagtgggtgtggttgtgtacacctctacttcctgctactcaggaggctgaggctggaggatctcttgagcccaggagttcaagtctgcagtgagctatagttgcactgctgcactccagcctgggtagcacagcgagacccccatctctaaaacataaaagtaaacaggctgggtgcagtggcttacacctgtaatcccagcactttgggaggccgaggagggtggatcatgaggtcaagagttgagaccagcctggccaacgtggcgaaaccccatctgtactaaaaatacaaaaattagccagtcgtggtgccaggtgcctttaatcccagctattcaggaggctgagacaggagaatcgcttgaacctgggagacagaggttgcagtgagccaagatcatgccattgcacttcagcctcggggacaagaacaagactgtgtctcaaaaaaaaaaaaaaaagtagaaaacagaatagcataaggataatcttatatacaaaataagactactcaatttctgaattttttttttaactagatatgccacctcctgatgacagtgcccatttcgtaacttgtcttactcagaaacagctcttagataattttactctttaagttcaggtctgagcacagaggacaaagaattcccttgattgcctatgaaagaaaggattctcaaccttggcactattgacattttaagtcagataattctttgttgtggaaggttatcctgtgcattgtaggatgtttattttatcagcatccctggcttctacccagtaaatcccagtagcaccccaccaccaaccaaaactgtctcaaaatgttgctagatgccccttggggacaaaaatcctctccctccctcctccttgaatgccactggcactccttgagcctacagaagggctcttctcacaagtttgataccctgtacctcccagttgatagtgggaattacttctcctttgaagacacaattccagttaccctgagaagtatggcattggccttgctggcctccaccaaattactatatcactgtgtttggtaaccccagacatcatactagggctttaatttcagtatataaatagtaaattagtatccttgtataggttagcttaatgagtttcagaattcttcaagtcatatcttcataggtaggatcactgtggagttaatggcatttgaactatgtactcagtactatgctagtggttggtgcaaggggaagatacaaaataaggtgtgattttagcccatgaggaatttatactttatctgcagaagcaaattaatatggaaccgttagtgaacacctggataaaacagaatgctaaattttaccctagaggtgcttggcctggacttcaagaattctaagtgaattgaagtatgttcacagtaagaaaggttaaaaatggctctgcccacttgtaggcagatgggaagctaggatggcagacttgccaatatttgatatatgtaaaaagtgcaatcatggcctctgttgtttcctcttttatctcgttctctttattagtccaggttctctagaggaatagaactaataggagatatatatatatatatatatggagtttattaagtagtattaactcacatgatcacaaggtcccagaataggccatatgcaagctgaggagaaaggaaggcagtcgagtttcaaagctgaagaacatggagtccaatgtttgaggacgggaagcatccaacatgggagaaagctgtaggctgggaggctaagccagtctagtcttttcatgtttttctgcctgctttatattctggtcgtgctggcagctgattagatggtgcccgcccagattaagggtgggtctgcctttcccagcccactaactcaaatgttaatctcctttggtaacactctcacagacacattcaggatcgatactttgcatcctttaatccaatcaagttgactgtattaaccatcacaagtccaccacttgtcaacttaaacacatacatatctcctgagatcattcataatcttcaaataaagacaataataatgtcataattacacctaatacaactatcctttgtacagctggaaacacaccagtccccaacccaaatgctattacataaagttaacaatacttaaatgctgatatgaagtaaatcttaatgtcccatgataaaaggaggctgggcgcagtggctcacgcctgtaatcccagcactttgggaggccgagatgagtaatggcttttgacagtaatagagggtctcaacctgatttttcttaagtttgcataaggcttaggagaggataaaataaggcaggatctagagattggtgaggagaaacggaagtcctcattcttgacagctctcagcacatgcagccctccccacacacacagtcacactcacacacactcacaaccagattcacattcctacccatgcacacactaacacacacttgtgcacttaaactcgtgcacttacacattcacattcatatactcacatgcacacattcaaaacacacacatactctacaaacactcatgttgcaaaaggggatttgtaagctgaatgtttagaactcagaacacatattttcacaaaaataatattatggtcgggcgctgtggctcacgcctgtaatcctagcactttgggaggctcagctgggcggatcacttgagatcaggagttcaggaccagcctggccaacatactaaaaatacagaaattagccaggcatggtggtgcatgcctgtaatcccagctactcgggaggctgaggcaggagaatcacttgaacccaggaggcaaaggttgcagtgagccgagatcctgccactgcactccagactgggcaacaagagcaaggctccatctcaaaaaaaaaggaaataaaatgaagatattttcttagtacaagtgtatatatgcacaaacatgtttttaacaaaaggaggaaatactcaggacaattacaatcctcatttctgcaactgttcacttggttgtagctggtatggatgactagccttctactacccattctgtattccctttgccttcagcaagcacctcagcaggtcgtggtttttttcctggtggcgtaacccaaaccttcatttctgaagggtctggaccatttgtagtcctttctggactgggcttttatagtttcccattgacttcaaccacagggcatggtaatactaagagacaccttaatagatctctgtattccatgcatactcttccttacctcagttgtggaatagtagactgatttcatcttgatggtccaggtcaatcaccccagccaacactgtaactcccttcttagactgttgacttaaaagtagtagactgggccgggcgcggtggctcacacctgtaatcccagcactttgggaggccgaggcgggcagatcacgaggtcaggagatcgagaccatcccagctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccaccactgcactccagcctgggcgacagagcgagactctgtctcaaaaaaaaaaaaaaaaaaaaaaaaaagtagtagactgatttcatcttgatagtccgggtcagtcaccccagccaacactgtaactcccttcttagactgttgacttaaaggtaggaggagccccaagtgtccaggtgacaatcttaacttcctgtttaatggaattgctgttgtgtctcctggtggcagtgttcctccctttgaaactaagacctctaagccagcagaacgtaatgtcatgggaacaggaagcaaaacttttgctagtgactctctaagggtgatgatgagtggtgccacttccaccccttgattcctggacctgtgaatcctggctatgagagaaatagtatcatatattggacgctgattcagggtatacatggccttctggagaactttgccccaggcctgcaaagtgttgtcacctggttgatgttgtaattgtgacttcaaaaggccattccgttctatcattccagctgcttcaggatgacgggggaacatggtaagaccagtgaattccatgagcatgagcccactgtcacacttctttagccataaagtgagtgccttggtcagaggcaatgctgtgtggaataccatgacagtggataagacattctgtgagtccacagatagtagtcttggcagaagcattgcatgcaggataggcaaaccgatatctggaataagtgtttattccagtgaggacaaacctctaccctttacatgataaaagaggtccaatatcatcaacatgccatcgggtagctggctggttaccccaaggaatggtgccatttcgagggctcagtgttggtctctgctgctggcaaattgggcactctgcagtggccgtagccaggtcagccttggtgggtggaagtccatgttcccgagcccatatgtaacctccatccctgccaccatggccactttgttcgtgggcccattgggcaatgacaggcgtaactggggaaagaggctgagtatgcacagaagggctcatcctattcacttgattattaaaatccttctctgctgagatcacccattggtgagcactcacatgggatacaaatatcttcacagtttttgaccactcagagagatacatccacatatctctttcccagatttctttgtcaccaattttccaattatgcttcttccatgtccctgaccatccagccaaaccattagctacagcccatgaataagtatataatcgcacatctggccatttctccttccatacaaagtgcacaactaggtgtactgcttaaagttctgcccactgggaagatttcctttcactgctgtccttcagggatgtcctagaaaggggctgtagtgctacagctgtccacttttgggtagtgcctacatatcgtgcagaatcatccgtgaaccgggccctagtcttttcttcctctgtcagctgatcatagggaactccccatgaggccatcggtgcaggctcgggagataagtcagggtggcaggagtggagaccgtgggcatttgagccacttcctcatgtaacttatttgtgccttcaggacctgctcgagcctgatcacgtatataccacttccatttgatgatggaatgctgctgtgcatgacccactttacggctagatgggtcagaaggcacccagttaatgatagtcagttcaggttgaatggtgacttgatgacacatagtcaaacgttccgtttccgccaaagcccagtaacaggccaaaagctgtctctcagaaggagaatagttatctgcagaagatgtcagggccttgctccaaaatcctagaggcctctactgtgattcacctatgggggactgccaaaggctccaaacagcatcccttgaggtgtcactgacacctcaagcaccattggatctgctgggtcatatggcccaagtggcagagcagcttgcacagcagtctggacatgttgtagagccttctcctggaccccagtcaaaactggcagcctttcgggtcactcagtaaatgggccagagtaacacaccgaaatgaggaatgtgttgcctccaaaatccaaatgggcccactaggcgttgttcctctttcttggtataggaggggccaaatgcagcaacttatccttcactttagaaggaacatctcgacaggacccacactactggacccctagaaattttactgaggtagaaggtccctgaattttagtcagatttattttccatcttctgtgtcaccagtaagtccagtgtatttgctacttcttgctcactggatccgatcagcataatgtcatcaatgtaatggaccagtgtgataccttgtggaagcaaaaagagatcaagttctctccaaataagattatgacacagccagagagttgatataccacagaggtagtacagtaaaggtatattgctggccttgccagctgaaggcagattgcttctggtgggccttatggacaggaatggagaaaaaggcatttgccaagtcaatggctacataccacgtaccaggagatgtgttaatttgctcaagcagtgaaaccgcatctgatacagcagccacaattggagtcaccacttggttaagcttacataattgactgtcattctccaagatccatctgtcttttgcagaggccaaatgggagagttgaacagggatgtggtgggaatcaccacccctgtgtctttcaagtccttgatggtggcactaatttccgcaacccctccagggatgtgatactgttttttatttactatttttctaggtagaggcagctctaatggcttccatttggctttttccaccataatagcccttactctaccagtcagggagccaatgtgggggttctgccagctgctaagtatgcctgtgccaattatgcattctggcactgggaaaatgaccacaggatgagtccagggacccactggacacactgtcagttggacctgagctaaaacttcattaattacttgaactttataagctcctatgttaactagaggaccacagtgacattttgggtcccctagaatcaacgtcagctcagagccagtgtccagtagtccctgaaatgtcagatcatttccctttccccagtgcacagttttaccctggtaaaaggctagagatcttcttgggggagaatgagagaaagattaacagcataaattgtcggtaatatagcggggtccttcctcaaggggactggcctccccttcattcaaggggttttgggtctatttcctggaccctcccagctgggatgagtaggtctaaagtggctaatccactccaccatcccaatatccttaagcctttggatcccttcctctacattaaattgagagagatcaggcatttccagctcgctcatagtgggccattttttaatccatatttcagctaaccaagcaaataaactattagaaccttttttaactccccgagctgcaacattaaatgcagaatccccacttagtgggcccaaatcaataaattcagcctgatccaactctgtgttccttccaccattgtcccacacccttaatatccattcccatgcctgttctccagatttctgcttatataaattataaaactcaagcagttattttcgagtatagtgcacctcctcatgggtcacactctgaacctcacctctaggggcctgccgggactttagtcttgttatagatccagaagcaaacaagggtattgggggtggctcctgaggagaatcaacgttatcttgcctggcagctgcctcaggggaggccatcactgttgcctcaggcagtgtagggtttatctcctccgacaaaggtagaaaggctgatgacagtgtgggtcagggaggggatgttgccgctacttgctacccgggatggggaagctgtttcttttggcaaaaaaagttcatcagcgtttacaagctcagtgtccccattccaacttacagtgtcccattcttttccaatcaatgccctcactttaacagtagacacctggcaaggctgtgcatgcaccttttgttgcaggtcagccacttgcctaataagagcttgtgtctgtttttccacaatttcagttctttctctacaggagataagactctcacttaggacagtcttagatttgaggctcagtatctgcttctggagcgaggagttagaatccctttggattcactttgtccagtgaacttaggaacaaccaaccaacttaattatgttcctttgttctccacatagagtcaaaggtattatgtatagagtcactaaactccttgcctctcacaagtggtgaatcaggagtgtcaaacgcatttatttttcataactctctaaaaagttcatgccaggccgggcgcggtggctcaagcctgtaatcgcagcactttgggaggccgaggcaggcggatcacaaggtcaggagatcgagaccatcctggctaacatggtgaaaccccatctctgctaaaaatacaaaaaattagccgggcatggtggtgggtgcctgtggtcccagctactcgggaggctgaggcaggagaatggcgtgaacccgggaggcagagcttgcggtgagccaagactgcgccactgcactccagcctgggtgacagagcaagactccgtctcaaaaaaaaaaaaagttcatgccagcgactatcagtgttctccatactattagagtccttagcattttggggtctaatcatattaagcagccaacttcagaaaccccaaaaccaacaaaagaactccatccttaatattctgttcctgtagaatcactcctggtaccaaaatctgtattaggtttctctagagggaaagaactaatggaatagatatatatatttatatataaaggagagtttattaagtagttttaactcacaccatcacaaggtcccacaataggccatctgcaagctgcaagaaaggaagccagtccgagttcctgaagaacttggagtctgatgtttgaggacaggaagcatccagcataggagaaaggtataggctgggaggctaagccagtctaatcttttcacgttttttctgcctgctttatattctgatcatgctggcagctgattagatggtgcccacccagattaagggtgggtctgcctttcccagcccactgactcaaatgttaaactcctttggcaacaccctcacagacacacacaggatcaatactttgcatccttcaatacaatcaagttgacactcactattaaccatcacattctctttctcctcacctttaaattgtttgattatataccattctttgtatttgaaacctcagcagggaagtaatagacaatttttaaaagaacctaagtagtaatacaagatttaacagctatattaaactttataacttgcagatagagaagttgcctttaatgaccaggaaacatttataaaaattgatttttaaaattacacccaaaaaatctcaattttaagttacacactctgttaacagcactaaaaataattttttagataaaaagataaaaggaaattcatctaattggaagctaaagggaaaaatgccttaaatctgggtcaaggagaaaatcgcaaccgtgattgcagatttataaactatttagaaattaatcacaatgagaacaaaaaaaatagaaacatgagagttcagccaaagtagtatataaagtcacaatattagatgtttaatattaatcaatatagaatgaatgaaaatgaaacaaataggagaggattctaggaaaatggcagaataggaagcaccagaaatctgtctcctcacctagacaaaaattacactggcagagtctgtcttatgtacagacaatccctgatttacgacggtttcacttatgatttttcaactttacaatagtccaaaaatgttatagattttagtacgcttctcgacttacagtgaggttatgtcccagataaacccgttgtaagttaaaaataatatgtcaaaagtgtgtttttgacttaagatattttcagcttgtgatggatttatctgggatataattccgtcataaatcaaggaaccatctgtattttagaactgtagaatttattgaaacttgcagcttccagaggaagacttggacagtacattgtggttaaattttgtcaatttctttaaaaaaaaattagtgtaatagacactgtcatagcctgagtcccttagaaaataaagcctaaggcaaaatatatatgctaatgctttgaagaggattgcagaaatgtctccagttctctgttcctccctatattcattcatttgcaatgtgtctctgtaactcccctcattaaagagtggaatctatttcctcaaccctggaatctgagctagccgtgttatgaagttttgcccaatggaatgtggtgaaagtgatcatgtagttgttttaagcgtaacctttaagaagtcttgcatgcttccacttgcttttctgggatcctgctcagctgctatagaacaaacctgggctagcctactgggagatgagattatgtggagcagcagtgagccatctgtcttagaatagccgacacttagccaacctagcaactgggggaaaatatgcgggaatgagtccaacagagaccagaagaattgcccagcggagcccagcccaaatagccaatctatagcattgtgacccaaataaatgcatgttgttttaagaccaaaaaaaggaaaagagaggtggggtgcagtggctcatgcctgtaatcctagcactttgggaggttgaggtggatgggtcacctgaggtcaggagttcaagaccagcatggccaacatggcaaaatccgtctctacgaaaaatataaaattagccaggcgtggtggtgaatgcctgtagtcccagctactctggaggctgaggcaggagaaccacttgaatctgggagacggaggttgcagtgagccaagatcacctcactgcactccagcctaggtaacagagcgagactctgtctcaaaaaaaaaaaaaaattggtcaatttccagtcttggcacagcagcagctaaccatctcctaccactgaatctcatggcacgcagctgtgcacatgttcctagagtggtttgcacacagcttgtaggagctaggggggcaaaaagtacattgtcctcaaaacgttagatctgtgctctgattcctaactgccactcgtgatcacagaggtgcagagagtcattagccattgttgcacttccattgttgcaagcccctcaccttctggttgaagtgacttccaggagaattaaagagctggtgtttccctccccactcccattcatttttctcattttccccttttgggagccagacataaacacaattgcatatatgagagaaatcagaaagtcatggcacagcctaggggatggtgcaggctcagaaaagacctctgagaagaccttagatttatacttcagactcatcttaggcaaagagggcttacaacaatcaaaaaaacaaaaataataaaaacagtaacaaaaacagcaaaccctggagaagaggaagaatctgatttccagagttaacacattagtaaattctaatgtctggttttcaacaaaaatatcacaaaggatacagagaaacaggaaagtgtaacccattcaaatgaaacctaaagagactcaaaaaacaaaaggaatttaaagtcaagaaaattatttatgaacaaaatggaaatatcaaaaacagatagaaaacctaaaagaaaccaaaaagaaattctggagctaaaaagtacaataactgaaattaaaaattcacaagagggattcaaaggcacattgaacagttagaagaaagagtcagaaaacttgaagagaggataatggaaattattgagtctgaggaacagaaagaaaagagattgaagaaatgtgaaagcagtctaaggaacctgtgcgatacctcaaccagatcagcatacacattgtgataactacagaaggagaagagagagaaaaggctggtgagaatatttgaagaaatgatgaccaacagcttcccatatttgatgaaaaacatgaatatgaatatctaagaagttcaataaaccaagtaggatgaactcaaagaaacacatactgagatacattataatcaaactatcagaagagaattttgaaagcagcaaaagagaaatgactcttcgcatacaaatgatcctcaataagattatcagcagatttcttatcaaaaactttggaagccagaagacaatgagctaatatagtcaaagtggtaaaagaaaaaatttagtctatcaatcaagaattccatatctggccaggcacagtggctcacgcctgtaatcccagcactttgggaggccgaggcgggcggatcacgaggtcaggagatccaaaccatcatggttaacacagtgaaaccccatctctactaaaaatacaaaaaattagctgtgcgtggtagtgggtgcctgtagtcccagctactccaggagaatggcatgaatccaggaggcggagcttgcagtgagctaagattgcgccactgccccccagcctgggcaacagtacgaaactctgtgtcaaaaaaaaaataaaagaatcccatacctggcaaaaactgtccttcgaaattgaagtagaagataagactttccagataaacaaaagttgagggagttcattaccactagacctgccctacaagaaatgctaaatgaagtcctgcaagttgaaaggacactagacagtaactgaacttgtataaagaaataaagataagtaaaggtaaatacatgggaaattataaaagctagtattattgtaacaatggtatgtaactccactttttgtttacaacatgacttgagaccaatacattaacaaaaaccaatgattaggccaaaagctagtgttattgtaactttgcttttgttgggaaaactccctgccaggactgagaattgccctctacaagtggaggcaaattactgatttgccatcagaccaaaaaaaaaaggcagatgattccgggttggcaggtagtcaaagatttatccaggggaaatttataaggcagccttgggcagcagcaagacaaggtagatttcagtgcttatagtacatgcctatctagtcttttatatcatgaagagggaatggaaggggcgggggaagtcactgatggtgtgttaagccgtctggttgttttcttaatctgtttactctttgcttacaggaactgtttgggttttgtagagtctggtcaacattcctaaggagaggagggatgttgcagacagcagcagttattttagcactggtatgcatttttaggtcactgcatgctacaatgcactttgtggtcacatacccagaaaacattttcacaacaggtaactccacatcttgttttctacttaatttaagggactaatagatttagtttgttttggacacatgttatatagagatgtaattatgtgatatcaacagctgaaaggggtgggggacagggcagttaaggagcagtttttgtatctttttcaaattaagctgctataaatttatgttagaagcttccttatttaggatgtcaaatgtaatcccatgataacacaaagaaaatagctaaaagaagataagaaaggaagttaaaagtttcattacaaaaatcaactaaacatgaaagaagacagataagaaatgaggaaccaaaaaaagctgcaatatatatagaaaatagcaaaatgacagaattccctcatcagtaattattttaaatgtaaatgggttaaacttcagtgaaaagacagagattagaagaatgggttttaaaaaaccatgattcaagactcctgtgccacataacatttcagtcaatgatggaatgcacataggatggtaatacaatggtaagattataataacgtatttttactatatattttctatgtttagatatacaaacaccattgggttatagttacctacagtatttagtatggtaacatgccgtaacagctttgtagcctaggagcaataggctataccataccatctaggtttgtgtaagtaccttctgtgatatttacatgatgatgaaattgcataacaatgcatttctaagaacatatacccatacataaatgatacatgactgtatatgctgtctgtaagagacttaagatccaaagacaaaaacaggttaaaagtgaaagaatgggaaaggatattccatgaaactaattaccaaatattaaggatggcgatactagtatacaacaaaatacacttcaaagcaaaaaagattactaaagacaaagaaggacattatatactaaaaaacggttcaggatgagcacgttggctcaggcatgtaatcgcagcactttgggagaccaaggtatgagggtgccttgagaccaggagttggagacagcctgggcaacacagtgaaacgctgtctctacagaaaattaaaaaattagctgagcatggtagcatgtgcctgtagtctcagctactcaggaggctgaggcagaaggatagcttgagccaaagcactggaggctgcagtgagctatgatcacaccactgcacttcagcctgggcgacagagcatgatcctgtcttaaaaaaataaaaaacataaaaggttcaatacagcaagaaggtttaacagttgtaaacatgtatgctcctaatgacaaaccatcaacatatatgaaacaaaaattgacgtaattgaagggagaagtacaattctacattaatagttggagactttaatatcccaatctcagtagtggatagaaccatcaaaatctaagcaaggaaatataggactttcacaacacaataaaccaactagatctaacaaccatatacagaacactctacccaacaatgaaatacacattcttctcaagtatacataggataaattccaagataggtcataaattaagtctgaattgattttaaaagacagcaaaatatcttccctgaccacaatgggatgaacttagaaatcaaaaacaaaaagaaaactggaaaatttaaaaatcatagaaattaacacactcttaaccattagatcaaaaaagaaaccacccggcattggttgaaaatcaccccccggctttggccatggcagcgggtgagattcggcgcccagagcctccaggggcctcagctcaccgcacgctgacacatgtgcggcggtgaaacccagccccaacaggccccgcggcctctccctgggtgcggccgctcgcgtggtctggctcctgacccaggctgccgacccctaaccctgttttctctccacaggacactggtcttcccacacgtgagaccgatgtcgccaggaccacggggtcggggggactcggctgtcctccgtctttcaaataaagctgtttgtctaaaaaaaaaaaaaaaaaaagaaaccacaagacaaataataaaatacttataaagacaagtgaaaatgaaaacacagcataccaaaacttatgagacacaacaaaagcagtgccaagggggaagtttctagctataaattcttacattaaaaaataagagtctggtctgaagaaagcaaaattaaaaattatttaaaaaataagaaaaatatcaaatcaccaaccggactttccaatttaaggaactgaaaaggaagagcaaactaaacccagagctagcagtagaaaggaagtagtaaagattagaatagatataaatgaaatagagactagaaaaataatatagaaaaatcaaaatgaaaccaaaagttggttattcaaaaatcaaaaaactttgcaaatctctagctagatctacttataacaaaggagacaagtcagaaatgaaaatgaagacattactaccatttctacagaaatgaaaagagttataggggaatactgtcagcaattgtctgccaagaaattggataacccaagtgaaatggagaaattcctagaaacactaaacctaccaggctaaaccatgaagaaataaaaaatatgagtagatttgtaactactaaagagattcaatcagtaatcaaacatctcctgtcaaagaaaagccctaaacctgatggcttcactgattaattctaccaagcatttaaagaagaactgtatcaatcatttcagacttcccaaaaattgaagatgagggcatacccttaacacgttctatgaggccagcattaacctaataccaaagccagtaaaggtactacaggaaaactacagaccagtatcccttatgaagactgatgcaaaaatcctcagaaaggtacttgcaaacagaattcagcagtatagttaaaggattatacagtttaagtcatcacttaatgttgataggtacttggaaactgtgactttaagcaaatgatacatcaggaagccagttttgccataggcttgccaggcacactgcctcacacctgtaatcccagcactttgggaggctgagatgggaggttcacttgagctcaggagttcaagaccagcctgggcaatagagtgagcctcgtctctaccaaaaacaaaaaaaaaagcctgtagtcctagctacttgggaggctgaggtggaaggatcacttgaatccgggaggtagagattacggtgagctgaggttgagccattgtgctctagcctagccaacagaggaagactctgtctcaaaaaaaaaaaaaaaggctaatttatataaacaagaattaagttcctacagatgttttataaacatcatcaaagttctaaagaaagacccaaaacatctccagttttaaacattgaaataaatgcaagctacatgtacatttaaaaaaagattaatagaaacaagtaaaatatttacctaatctctggcaaatctatgagtgacaagtggttgtagtaatggtgagttaaatcaaagagtaaatgcttgcaaagagaaaattgtaaagagcacacagttcataaacaataacaggtcatgcctataatcccagtacttttgggaggctgaggccagaggatcccttaagcccaggacattgagaccagcttgggcaacatagtaagacatcatctctacaaaaaaattaaaaacacaaatgagctgagcacgatggtgcacacatgtagtcccagctactcaggaggctgcggtgggagaaccacttgagtcccagaggtcaaggctgcagtgagccatttttgtgtcactgcactccaaccggggtgcgagtctgtctaaaaaaacaacaacaacaacaacaaaatggaggaggcagagcaagacagctaaatagaagcctccaccaattgtggaggtgtctcctgacagggacaccaaatttaaccactatctatattaaaaagcaccttcataagaaccaaaaatcaggtgagcactcatagtacctggttttaacttcatatgactgaaagagacactgaggagggtaggaaagacagtcttaaattgctaacacctccccttccccagcccccagcagtggccacgtggcacacagagagactctacagttgaaggagggagatcgcagtgattgtgggactgtgttggaatttagtgctcccatgttgcagttgagagcaacactgggcagaactcagccagcatcctcagagggagcatttagaccagccctagccagagggaatttgcccatcccagaggtcagaacatgagtttcagcaagctttgccaccatgggctaacatgccctacagtcctaaataaacctgaaagacggtctaggccacaaggactgcatctcctagaaagttcttttttttttttttttttggagacagagtctggctctgtcacccaggctggagtgcagtggcgcaatcttggctcactgcaacctccgcctcccaggttcaagcaattctctgcctcagcctcccgagtagctgggattacaagtgcccaccaccatgcccagctaatatttgtatttttagtagagatgggatttcaccatcttggccaggctggtcttgaactcctgacctcatgatccacctgcctcggcctcccaaagtgctcggattacaggcctgagccaccgcacctggcctagaaagttctaatgctgtgctgggctcgtaactagtggacttgggggacacgtgagctagtgagacaccagcccaaacttaaaaaacatatcaatattcaggctgggcacagtggcttatgcctgtaatcccagcactttgggaggccaaggcgggcagattgcctgagctcaggagttcaagaccaacctggccaacatggtgaaacctcgtctctactaaaaatacaaaaattagccaggtgtgattgtgcacacctgtaatcccagctattcgggaggctgatacaggagaatcgcttaaacccgggagacagaggttgcagtgagccgagattgtgccactgcactccagcctgggtgacagagtgaggctctgtctcaaaaaaaaaaaaaaatcaatcaatattcaagtacaaggtggttatagaacactaagcccatttaacccaaagaagactacctcaaggcatttaataatcaaactcccaaaggtcaaaaataaaaaagggatcctaaaagcagcaagagaaaagaaacaacatacaatggaggccaggcatggtggcttacgcctgtaattgagcactttgggaggctgagaccaagtggatcgcttgaggtcaggagttcagcctggccaacgtggcaaaaccctgtctctactaaaaatacaaaaattagccgggcatggtggtgtgtgcctgtaattccagctacccaggaggctgaggcatgagaatcatttgaacatgggagacaaaggttgcagtgagccaagatcgtgccactccaccacagtctgggtgacaaagtgagactctgtctcaaagaaaagcaaacaaaaaaaccacatacaatggaactccaataggtctggcaacagacttttcagtggaaaccttataggccaggagagaatggcatgacatattttaggtgctgaaggaaaaaaacttttaccttcaaatagtatacccagcaaaaatgtccttcaaacatgaaggagaaatactttcccagacagacaaaagctgagggatttcatcaacaccagacctgtcttacaagaaatgccaaaaggagttcaatctgaaagaaaacgatgttaatgagcaataagaaatcatctgaaggtacaaaactcactggtaacagtaaatagaaaaatacagaatattgtaactgtaattgaggtgtgtaaatgactcatatcttaagtagaacaataaaaatgaatcgatcaggctgcgtgcagtggctcacgcctgtaatcccaacactttaggaggtggaggtgggtggatcacctgaggtcaggagttccagaccagcctggccaacatggtgaaacccgtctctactaaaaatacaaaaaattagccaggtgtggtggcaggcacctgtaatcccagctacttgggaggctgaggcaggagaactgcttcaacccaggaggcggaggttgcagtgagctgacatcacgccctgcactccagcctgggcgacagagtgagacttcgcctcagaaaaaaataaaaaattaaattaaaaaagcctgggacctgatggcttcactgccaaattttaccaaacatttaaagaagagctattaccaatcctgctcaaactattccaaaaaatagaggaggagggaatacttccaaactcattctatgaggcaaaatcagacaaagatgaatcaaaagaagaaaactacaggccaatatccctgatgaacattgatgcaaaagtcttcaataaaatactagcaaaccatattcagcaacgcattaaaaaaatcattcatcacgatcaagtgggatttatccctgggatgcaagggggtttcaacaaatgcaaatcagtcagtgtgataatgtgataacatatcaacagaatgaagaacaaaaaccatatggtcatttcaattgatgctgaaaaatctttttataaaattcaacatcccttcatgataaaaaccctcaaataactgggtatagatggaacataacataataaatgccatatatgacagacccatagctagtgtcatattgaatggggaaaaactgaaaaccttctaagatctggaacacaacatggatgcccactgtgaccactgttattcaacacagtactgtatatcctagatagagcaatcacacaagagaaagaaaaggcttccaaattggaaaggaagaagtcaaattattgttgtttgctgatgatatgattttacatttggaaaaacctaaagattccacaagaagagtattaggactgataaacaaattctgtaaagttgcaggatacaaataaacatacaaaaataagtagcaccctttccacagcttcccattctttagaaaccaggctgcatattcccggtggtggcacgctggattccaggctctcgcatccccaccagcctccctgaaggcagacgggtggccatggagacccatccagactcatggtcttcagtgcattacagggtgggtgatgccagggtgccagacgccatgtttgaccagaacattgggaaggtcatagccatgctggaggttcttgtgaggagatgaattggtgaagagagaggccaggatgaagatgcctccaggagtgggccagtttgggactggcagctccacccgggttctgctctcactgctgagggcagaagggttcactggtgagaccctttgggggaagactgaggaggaggcaaagcagcttgctgcttctatgtcagccagactgatgacatcttgctgcatcaagatgtggatctggtgggcatcagcatctcccctccactcacccagcagatacatgtcaaggctctagatttgttgtctgtgtctatgattgtttctgctgcaagctggccagatgagttcccctcctgagcctgtgtgaacagactccatcttggtctgatatggtttgggtctctgtccccacccacatctcaccttgaatggtaatccccataatccacacgtgttgaaggagggacccaataggaggtgactggatcatgggggctgtttctcccatgctgctctcatgatagtgagtgaattctcatgagatctgatggttttataagcgtctggcatttcccctgcttgcacttctctctcctgccaccatgtaaagaaggtatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacatttcatgctcatgggtaggaagaatcaatatcgtgaaaatggccatactgcccaaggtaatttacagattcaatgccatccccatcaagctaccaatgcctttcttcacacaactggaaaaaactactttaaagttcatatggaaccaaaaaagagcccgcatcgccaagtcaatcctaagccaaaagaataaagctggaggcatcacactacctgacttcaaactatgctacaaggctacagtaaccaaaacagcaaggtactgttaccaaaacagagatatagatcaatggaacagaacagagccctcagaaataatgccgcatgtctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccctagaagaaaacctaggcattatcattcaggacataggcatgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaccctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtagaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactgtattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggcgggaattgaacaatgagatcacatggacacatgaaggggaatatcacactctggggactgtggtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataattaaaaaaaaaaaagaaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccaggatggcacatgtatacgtatgtaactaacctgcacgttgtgcacatgtaccctaaaacttgaagtataataataaataataataataataataataattgggaggaaataaagtggttaagaagagaaaaaaaaaaaaagaaggtccttgcttccccttcaccttctggccatgattgtaagtttcctgagccctctccagccacgtggaactgtgagtcaattaaactctttcctttataaattacccagtctcggccaggtgcggtggctcaagcctgtaaccagtactttgggaggctgaggcgggtggatcacgaggtcaggtgttcaagaccagcctgaccaatatggtgaaaccccatctctactaaaaatacaaaaattagccaggcgtggtggtacacgcctgtagtcccagctacttgggaggctaaggcaggagaattgcttgaactcgggaggaagaggttgcagtgagccaagatcgaccactgcattccagcctgggtgacagagcgagactccatcttgagaaaataaataaattacccagtctcgggtatttctttatagcagtgtgagaatagactaatacacagtccatcagggtattgggaagactgtggtttgcaagaacacagcaacatcagtggatgccttttggatggtgatggccttgtgttaactgcctgcagctgatgaacgtggtggggaacatgctgcatttcctacctgcctttgtgtgcaggtgaagcaaccagtctcgaagcactacgcaggagtgatgatgatctgcgacacctgcatctactcaggcagcctgctgagccccagccatagctggatctgtgacgagctcacgggcagcaggggtctgacacaatggggacctacatcgtggacctgctgacccacccgaccttctggagagatgagaagttgcacacactgtcaagacatacatgaggcagagtgccaccatctgtggcatccagcatgtcaccattgatgacttctgtttcaaaaaaaaaaaaaaaaaactacctgccgaaacaggattcaacactgtgtaaaagaaggaaacaacttcacaacatcaagatactaagcaatgtagcagttacaactatacaataaaaaattactagacacatgaagattcaacaaaatatgatccataccagaagaaaaatcagtcaatagaatcagaaatgacagagatcatggaattagcacaaaaaaaaccattaaaacagctattactaatataattaagaatttacaagaaaatatgaacataagaaaaaatgaagatatgaaaaacaatgaaatgcagcttttagacttatgtaatgcaatatctgaaaaaaatttaaatcactgtaggagcttaaagcaaatttaatgtagaagaaaagattgatgaccttgaagacatagcaatagaagctattcaagctgtagcacacagagaaaaatacaccaaaaagccaaactgctatgagtgtctgcagaaataaacttcagtagatgtgtaactccaaggactgtaggtagtggaattgacagatatgaaaagtatagaatttctgtgttctgaatattttaaaaggtaaaggatgttataaagatgagcaagagattaccaggaatggacagacaggttggaaggtagttgggagatggggagatgctctagaaatataaaatataattgttagaataacaaaactcagtggaaaggttaaagagcaaatttgatacagatgaagagagaattaataaatgaagccactgaggtggctcatgcctataatcccagcactttgggaggccgaggtgagacgatcacttgaggctaggagttcaagaccaacctggacaacatggtgagaccctgtctctacaaaaaagtttaaaaattagctgggcatgttagtgtatgcctgtagtcctagctactcaaaaggctaaagcagagcatgacttgagcccaggagtttgaggcttcagagtgctatgattatgccactgtgctccagcttgggcgactgagggagaccttgtctcttaaaaaataaatgagaagatatctttaaaaattacccagggtatactaaggagagacaaggaagtaaaaatatgaaaacaatattaagagatggaagcttggataagaaagtcacacatatgactaattgaaatctcagaaagaaagaaaagaaggaaaaaagtagaggcaatactccctgccccctaatattttgtgaaattgttcaaacatacagaaaagttgaaagaattacacagtgaacttttacatttaccaattaattctagaacattttgttatatttactgtatcatatagctatccacttaaccatccatcaatcctattttttatgcatttcagagtaagttgtagacatcaccactaaacattttagtatgttcatcattagtattcagtattgttctatagcttttttgtatttaaaatgtacatacaataaaatgcacagatcttaagtacaatatttggtaaatttttacaagtgcatatacctgtgtaacacaaactgtcaaaaaaaaccatatactgctcttcagaaaattcccttatgccccttgctagtcaatccctgccctttacctcccactggtaagaagtgttctaatgagaggtatcatttagataaatagtgctgtgatttttgcagaaatgatgaaaaaaatgaattaacagatctgggagtcacaagataatgaaagcaggatacataaacagaaatgtataatgacattgtataaagaacctgcagaatttgtaagatcttacaagcagctagaaagggcagatcacttgcaaaagaacagcagtgaaaatgacagtggatttattatcagcatcaatggaaaccagaagttaatggaataatacctttcaagtgccaaaagataatggtcaactagaattatgtacttgcccagactaccttttaagaagagtgaaatagagacatttaaagataagtgataattgagagtttagctcagagatatgcacaaaactcctaaatgacatatagtcatgcactacatgacaaagttttggtcaataacagaccgcatatacaatggtggtcccataagattatattggctgagtattgctaatccaaaaatccaaaatccaaaatactccaaaatttgaaactttttgagtgccaacatgatactcaaaggaaaggttccttggaacatttctttggattttcaggttagggatgctcaacactaagtatcatgcaaatattccaaaataaaaaaaaaattcaaaaccaaaattttcttgtcctaaggatttaggattagggatacgcaacctgtaatactgtatttttactggaccttttctatgtttagatatacaaatacatactcgtattacagttgcctattcagtacagtaatatgctatacaggtttgtagcctaggagcaaaaggctatgccatatagtctaaatatgtagtaggctataccatctaggtttgtgtaagtacagtctgtggtttgcacaatgatgaaatcacgtaaggacacatttcacctttctcagaatgtatcccatcattaagtgatgtgtgactgtagttgagagatagtatttcacaggagttaagaatatgcactttggagactccataggtgtgaatccctattccaccatttgctagctgtggaacactggacaagtgagttaacacctctgtgcttcagttttttttctcacttgtaaaattttgacaataattgtattcatggaattgttatgaggattaaatgaactaatataaaataaagcacttagaaccaaacctggaatataagtgctttgttaagtcagagcttaaaaaaaggaaattatcataaaagaatggtctgaagtacaaaatagaatggtgagtgaataaaatggtgaacaagcttgtcagtccaaacatcagtctagaaaaataaggtccgatttgtgaagttttgaactaatgcctccaataacaatagcaagtaggcatttgggggagggtcaatgtaattaaaattattctaagatcattacttcgtttcaaaggaaagttaagatatgtttgcctttacattttgttaagttagacacttataaaatgcagggacagttgttaaaaaaaaaaggaataaatacagagctatgaattccaattcagtggaggaaaaatggaatttaaaaaatctaaccataaagtcagttttttaaaaatgcagaaacagccagcgccgtggctcacgcctgtaatcccagcactttgggaggctgagacgggcagatcacgaggtcaggagatcgagaccatcctggctaacacggtgaaaccccgtctctactaaaaatacaaaaaattagccagacatggtggcgggcgcctgtagtcccagctacttgggaggctgaggcaggagaatggcatgaacccgggaggcagagcttgcagtgagccgagatcacgccactgcactccagcctgggcgacagagcgagactccgtctcaaaaaaaaaaaaaaatgcaaaaacgttggggctataaaaatagtagctcagaaaaagcaaggcaaatataaacaaaaaagatatataaacaaatccaactatatcaagaatcacaataaacataaatgtatgacatttaccaattaaaagatagagtttgtcagactgaaatgaaaagaaaaatctagctgtatgacatatacaagaatctgaaaacatacaggcaaaacagtagaagataagagatagaaaaacatataccaggcagatcttaatacaaagaattcacatacatacattaatttcagaaaaaagattttaagacaaaaaaagattattagaataaaaaggtcattacctactgataaaaggtttttttcaccagaaaaaaaacagaaaaattctaatcctgtttgtaactaataaaatggacttaagctatatacagcaaaaaatgttagaactacaggaggtggcaaatttctatgcaactctctcagttcttgataggttaaacaaacaaaaaccagtgcattggtctaggccctgggaatacagaagtgaacaggcagaccatcacctgcatgctagtgggaagataaattaacaaaaatatcaaattttggataatgataaatgaatgaagaaaaaatcaaatataaaggtagaatctaatgggaagaggtggttattttatgagggtggttaagggaaggcttccttgaagaggtggcatttatgcggacacatgaattagttgagggagcaaatgatgtgtatatataggggaatattttttcagacaaaaggaaaagcaactggaaagaccctgaggcaaacatgagtttcacataatgcaaatatacatatttagctttttgaatctgcttagaatgtcttttccccccattttaagtagaatgtagaaaccttacatataggtctacttaacctgtaccccttacgttagagttgtcatgaattacgtctacatatgtttaaaaccccattagacaatggtacagttattttcaaccatcaaatatatttttaaagaacttagtacctgtcaatgatagactagatgtggcacatatacaccatggaacactatgcagccataaaaaaggatgagttaatgtcctttgcagggacatggatgaagctagaaaccatcattctcagcaaactaacacaggaacagaaaaccaaacgccacatgttctcactcataagtgggagttgaacaatgagaacatatggacacagggaggggaacatcacacaccggggcctgttgggggatggggtactaggggagggatagcattaggagaaatacctaatgtagatgatgggttgatgggtgcagcaaaccaccatggcacatatatacctatgtaacctgcacattctgcacatgtatcctagaacttaaagtataatttaaaaaacaaacaaaacttaagaggagaataggagaatagactactatttttacacagatatttaccatttctggtgctcttccttcattcctgatgttttcaggtttccttctggtatcatttccctctgtctgaagaattttctttagcaattattttagaacagctctgctagaaatgaattcttttagtttgtcttcatatgagaatgccattatttcacctgaattcctgatggatattttcactagatgtagtattctgtgttgacactttcagtgctttaaaattattgtgccacttctggccgggcgcggtggctcatgcctgtaatcccagcactttgggaggccaaggtgggtggatcatgaggtcaggagattgagaccatcctggctaacatggtgaaaccccgtctctaataaaaatacaaaaaaattagccgagcgtggtggcaggtgcctgtagttccagctagttgggaggctgagataggagaatggcatgaacccaggaggcagagcttgcagtgagcctagatcacaccactgcactccagtctgggcgacagagcaagactccgtctcaaaaaaaaaaaaaaattattgtgccacttctgtggtttgcatggatcctgctgagagatttgctgtgattcagattgtttgtgtgtaggtagtactttgaatttctctagctacttccaagatttttttctttgtcttcattttcagcattttgattgtgatgtgtttgggtataaatttatgtgttaaacctgtttggggtttgttgaacttcttaaatctgtagatttgtcttttgccaaatttgagaccttttcttccattattctaaatttttcagcaccttttgtcattatccgagaggtctctgagattctactcattgttttttcaaatcttttttctctctgctgttcagattggttaatttttattgatctatttacaagttcattgactctgtcatgtttaccttgctattgaaaccatccagtgaattttttttaaatgttggctattgtatttttctgttctaaaatatccatttgattcttctttatgtcttctatttatttgctgatactttctatttttttcttattggcttcaaaaatgcttgtgactgcttgtaggagaattgttataacaaagtcaagaactttggagggtctgatattttaccttacttgcaagttaacaagttaggctgccacaatttcatgaatagtgacagaagacacgagactcctgggtcagagacaaaggacagtttattacccacacgaatagcaggaggcagagtatcagcatttaacccagttttctgagcctcagttcccacacagtgatgctgtgagggcctggtgatacctgtatatgtagtgggatttatgaatgctgtgggaaacaccagtcttcaataaagggccagcaaacctgcccagccttgccctggagagagacattatcttttttttttcatcctggaaggaaaaaaatctgtccttggtcccaaaggaagacattctatcttccaaggatgtttgctatacaaacagctaaaaaagatagttcagagaaaaagctgttaatgcctttgcctagaacacctgtagaaatgcaagagaccaatggagaatagactcctaacaaatattagtagttgctttaaagccttcatcagacaattttatcatctgtgttatctcagcattgtccttttttttccctatatgaattgagattttcttgttgtttttttttttgtttgtttgctttgtaattttggaccgtatcatggatattttgaatattctgttttgagatgctggatcttatttaaatcctattaagaatgttgatatttttgttttagcaggcaatcaagctggctaggttcctgccacaagttcagactagtcttctgtaggtgagaaagcgcataatgatattaatatccacctcccaaaccccagagtgtgttacattccagggtgataaacctagaggggccttcttcctcttcccagaggaaattcacttacatttcaagataatgaataatttctctcctgaatgggaggaatgggtaggtcaccagcagctttgataaaagcttggaggcttctaaatttaagattcttctcctgtgatgcaacccactgcacaggaaacatctgttgccttacgggaaatggggcatggggaaatgacacaaggtgttgtaaatgctttgtgctttcagtagcaaatcttttatggcaccagcccagcagtctggtgtcttctggcagtatatgtatatgaaactgtggcaagctaacctattagcttgcaagaaggacaaactctaagacacttcacagtttctgacttaacaggggagagtggcaggatgtgaaggtgaaggagcaggcagggcaaattacatagcaccatccatagctaaggtaatagatgaattgttaatgttaaaaataatgacagctggccggtcacggtggctcatgcctgtaatcccagcacttcaggaggccgaggcaggcggatcacgaggtcaggagatctagaccaccctggctaaaatggtgaaactctgtctccactaaaaatacaaaaaattagcctggcgtggtggcaggcacctgtagtcttagctactcgggaggctgaggcaggagaattgcttgaacccaggaggcggagcttgcagtgagccaagatcgcgacactgcactcactccagcctgggcaacggagcgagactccatctaaaaaaaaaagaataatgacagcagtagcagtggaaaggaaaacaagacactgcatgctaagctcttctgcaatgagggtgagagaccaggaagacagtagacgactgtaaaaaaaaaaaggagaatggatgatatggtcaagggaactagaattttcaaaggagaaaaaaggtctggaattggcagtggggaataagcaggacacctacctcatctctaggctcctttggtaagtgggttgagtaatttttaaaagcagacacaatttgagagtattgcaaggaaagcaatattattaggagatggttaggttttggttagagtaagaaaatgaaaggaatgtttagaaaaggtgttaaggattaggggatttgactgatgacaatacagtggaagggtcaacacagattaagaggagtgggagcctgggcacaggggctcatgcctgtaatcccagcaccttgggaggtcgagccaggcagatcacctgaggtgaggagttcgagaccagcctggccaacatggtgaaaccctgtctctactaaaacacaaaaattagctgggtgtggtggctcatgcctgtaatcccagctacttgggaggctgaggcaggagaattgcttgaatccgggaggcagagtttgcagtgagacaagatcgcaccactgcactccagcatgggtgacagagcaagactccgtctcaaaaaaaaaaaaaaaaaaaggaatgggaaattaggctatattagagcaaagcatgatggtgttacaattctatacaatggactttaaaagatgcaaatagggaaatgaggtatgatggggttatttctatttttttaaaaaaaggtctcattatagcctcttgggattgttcttttaagcagtttgtagcgtgttattataatctcttggaattgttctgttaggcagtttataaagcaggtggatattgtgatgggtcgggggtagatttaccaggatcacattcagctctttgtgcctctaaaatccagctggagttgtgactgggaagaactctggatgtgttatttaaatccaggaacactgggaattttagaggctttctttacagtctaagtctttggtgttgctgccactggacaggcaatctccaggagcttggaaatcctgctgtgactgggaaagagcatagtgatataagtaaatatctaccaggaaaatccaagaaaagcaacatcactttaggtgtctcctcaaacttcagctcatcagagggggcttattttaatacattatctgaaagaatatctttcctggtcactttccatcctcctttctatgcttttcccgaccaccacctccttagcacttatcaccacctgtcatatatttctctgtttagtatttcctctctgtaggatataaagacctggagaacagatttattactgctatttccaggacccagaatagcatttggcacattgtacacactcaataaatatttgtagagtggatggataaactgaagaatattagaaccattaaacaagtctagtaatgtgaccaattaaaaaatcagtaattctgctgggcgtggtggctcatgcctgtaatcccagcactttgggaggccgaggtgggcagaacatccgaggtcgggagttcaaggccagcctggcaatcaaggtgaaaccccatctctactaaaaatacaaaaattggtgtggcatgtgcctgtaatcccagctacttgggaggctgaggcaagagaatcacttgaactcgggtggcaaaggttgcagtgacccgacattttaccactgcactccagcctgggtgacagagtgagaccctgtctcaaaaaaacaaaacaaaacaaaacaaaaaaaacaaaaaggacaaaaaaacccagtaatggtaataaaaaatataaaatattcagaagtaaactaaatggtaaatagtactcaaatttaccgacagaggaaatggatgaatggaggagagtaccatgctgctggatggaaagacataatattgtaataatgcaaactctcttcaagttaatctataaaatggacacaatatcagtcaaaattccagtggaatttttggaggaaaggaaggggcaaatttgacaaaatgattgtaaatttcaccatgaagaataaatgcttcagaatagccaattcatattttgaagaaaggcatcgataagggaccttgctctattagacacaaaaacctatataggaaaagacaaatgggtggtatatattaaaagttttttttttaagtacataccctttgcccagacattccacttctggaaaatttccctgagaaataactagatagtatatggctaagatatttattgaaacattgtctataatgttataatgccaatccaattaaaaacattgattgtttgacaagtagaggatggttttaaccaagtatggtttaaataaattcctgtggaataccacagagctcttaagcatgatgtagaactacattaattgatatggaaggtgatcgccatatattgttatgttttttaaaaagctgattacaaaacagatgtctaatactatccacatttttgtaaaataaaaattggcatatacctgtgaagaaaaaaacctagatggaagattatatatcaaaatgttaacaatagttctgcatctgtacactgaaaaatggtatgctttccccaaaatgggatggtacttaaattcctcattactgccacctggtggcaaccaagggagatttctaatttcttttctaccaccttgagtacaatgcacgtaacatcataattatataaagttataaagaaatcttcagtatcacctggttctatccatcattttgtagctgaagaaataaagggcaaagactttaagccacttgtctgaagttgcactgttagtgaaatttaataatagtagcaaacatttgttgagccgttttgctaagtacttcaaatggattatatcattttattgtcacaggagcctatgaggttggtcctatttttactctcacttatccctacttaccagatgaggatcctgaggctcagaaaaagtaagcaacttacccaaggctgtatagttgggatacagccagtgattctgagttttacctccctctcctgaaccttctgtactgtaccttcttagcccattaattgcccctgccccttccactacgtacccttgccctttccttgtccgttccttcagtgttttggtgacaactcttagcatatgcccagtctttgtgttatgtttctcatggatgaaaagacagtataggccaggtgtggtggcttatgcctgtaatcccagcactttgggaggctgaggtgggcagatcacctgaggtcaggagttcgaggccagcctggcgaaaccatgtctttactaaagtaatcccaactacttgggaggctaaggcatgagaaacacttgaaactgggaggtggaggttgcagtgagccgagatcacaccactgcactccagccaggggatagagcgagactctgtctcaaaaaaaaaaaaaaaaaaagggaaggattgattgatttactgagagaagtataaggaaacaaaatgccccaagacccttgtccggaaggaagggagggagggaaaggaaaggaaaggaaggaaaggagggagggagcgaaaagacagtaaagacagtatgaacatttactgagagaagtataattatcaggggaacccgcccccaatatttcaacggaggttctattttccataagtgttggccggctgagaaataaagagtacaaagagagaaattttacagcttggccaccaggggtgacatcacatatcggtaggaccatgatgcccacccgaacctcaaaaccagcaagtttttattaaggatttcaaaaggggagggcgtgtatgaacagggagtaggtacaaagatcacatgcttcaaagggcaaaaagcagaacaaagatcacatgcttctgaggaaacaggacaagggcaaagcagaactcctgataagggtctatgttcagcggtgcatgtattgtcttgataaacatcttaaacaacaaaacacaggttcgagagcagagaaccggtctgaccaaaaatttaccaggatggagtttcccaatcctaataagcctgagggtactgcaggagaccagggcatatttcgtcattatctcaaccacataagacagacactcccagtgcagccatttatagacctccccccaggaatgcattcttttcccagggtcttaatattaatataccttgctaggaaaagaatttagcgatatctctcctacttgcatgtctgtttataggctctctgcaagaagaaaaatatggctctttttgcctgaccctgcaggcagtcagaccttatggttgtcttcccttgttccctaaaaatcgctgttattctattctttttcaaggtgcactgatttcatattgttcaaacacacgttttacaatcaatttgtacagttaacacagttatcacagtggtcctgaggtgatgtacatcctcagcttacgaagataacagaattaagagattaaagtaagacaggcataagaaattataaaagtattatttgggaactgataaatgtccatgaaatcttcacaatttatgttcctctgccacggctccagccggtccctccatttggggtccctgacttcccgcaacatataaggaaacaaaatacccccagctccttaccccagacccttgtccagatagaaatttagacttattaatatattgaattgttcaagtgtccatatactaagaattacatcagcgatgtggaactatggataggcttccttgggttcctggctccacactataaccaccgccccccaccccttaaatttctgtatagcagacttaagagtgaatatcaccatatgcagttgttcatgtacttcttcccctttctcttctagctcttgacaaaattctcagggaaaactcttcagctctggatgtctccctttttgtggatcaaacacaaagggcatcattctaaaatatatacagaaccataaaagccccaaatagccaaagcaaccctgagcaaaaagaacaaggctggaagcatcacactaccagacttcaaaatttactacaaagctctaatacctaaaataacatggtactggcattaaaaaaaaaaaaaaaataggcacatagaccaccaatgaaacagtatagagaatctagatataccaactcatctttaacaaaggtgccaagaacatacaatgaggaaacgatggtcttttcaataaatggtgtgggggaaagctagataactatatgcagaagaatgaaacaagattcctctctctcgctatacacaaaaatcaaatcaaaatggattaaaggcttaaatctaagacctgaaactacaaaactagaagaacacactggagaagtgctccaggaccttggtctgggaaaagatttttttgtttaagacctcaaaagcacagacaacaaagcaaaaacagacaaatgagattacattaagctaaaaagtttctgcacagcaaaggaaacactcaacagagtgggggagacaacccacagaatgagagaaaacattttcaaactatccatccgacaagggattaatgaccagaataaagagaccaaacaatttaagccaaaaacaaaacaaacaaacacacaaaaaaaacaaaagccaaataatctaaaaagtgggcaggttgggtggggtggctcaagcctataatcccagcactttgggaggccaaggcaggcaggtcaagagatcgagaccatcctggccaacatggtgaaaccccatctctactgaaaatacaaaaaaaattagccgggtgtggtggcatgtgcctgtagtcccagctacttgggaagctgaggcagtgagaatcgcttgaacctgggaggcagaggttgcagtgaaccaagatcacacaactgcactccagcctgatgacagagcgagactccatcttgaaaaaaaaaaaaaaaaaagtgggcaaaagatccaaacagacatttctcaaaggaagacataaaaatggccaacaggtatatgaaaaaatgctcaacattactaatcattagagaaatgcaaattaaaacaacatgttatttcaccccagttaaaatggcttgtattaagaaaacagataataacagatgctagtgaggatgtggagaaaagagaaccctcatacactgttggtagaaatgtaaactagtacaaccactatgaagaacagtatggaagttcttcaaaaaactaaaaatagaattaccatatgatccagcaattccactactgaatatgtatccaaaagaaaggaaatccgtatatcaaaaagatatctgcactcccatgtttattgcagcattgttcacaatagccaagatatggaattaacctaagtgcccatcaatgggtgaatggataaagtgtggtatgtatgcacaatgaaatattaatcagccataaaaaataatgaaaccctctcatttgcagcaacatggatgatactggcgaccactatgttaaataagccaagtacataaagacaaatattgcatgttgtcagtcatacatgggagctaaaaatgtggatttcatgatgacacagagtacattggtggttaccagaagccagaaaggaggggatggagtaggggatgaagggggaaaaaggatataagtgtacttattaccactgaactgtacacttaaaatggtaaagatggtatgttatgtattacctcagtttacaaaagaaaaaacaaatggcatcaacgttaataagtgtaaaagttgtactagggataaatccgccatttaaaagggaaattagaaatctgaaataatgagtgcagttagactctgaaacccttgaagtccccaaaagtctcattcagaactggtcccaaaatgaatacgtacttttgtatcattgtctaattaaagctgcttttttcaagtattagtttgcttcaaaattaatctttttatttgtactattattatgagtgttatttcctattcttcaggtatattttttggagaacagtgttagtgaaaagagcttgactgttagacagtcttgagttaaaattcacgttagctgtgacgaagaaactattacattaaattttaattacttaattttattatctacaattaaggataataatatcaccaaaggttgtggagaggatttaatgggatgacacataaaactaggacatagaggcatctagcaaatacacacttccttcccttctcccttgttatatacttatccacacgggctaggatttctttgaaggaaccatttctatcttagccagtgttctatctgaggtatttgatgctctctgcttttttctttcacaccccactttcagtctctcagtatgtactgtgagctctgctttcagactagattcgtaactcagtgatttcctactcctccacaaccaccaccctggtccaggccatcatcatttttcatctggactactgtagtcacttcctaactggactcccaacttccactcttgctgcttgccatttattgttcacatagcagccaaagttattctttcataaattagatcatgtcacttctctgctcaaaaccttccaagagctctccaccacttttagactaaatatctgaagtccttaccaaatcctactagatctatgtgatttgaccccagcctatcattcggacttcagacctctctcctgctaccttactgtgctccagcagcactggcctccttgctgttcttttttttttttttttttttttttgagatggagttttgctcttgttgcccaggctggggtgcaatgctgtgatcttggctcactacaacttccgccttccaggttcaagcaattctcctgcctcagccacccaagtaactgggattacaggcgcctgccaccacactcagccaattttttgtatttttagcagagatgaggtttcaccatgttggccaggctggtctcgaactcctgacctcaggtgatcctcctgccttggcctcccaaagtgttgggattacaggcatgagccaccgctcccagccctccttcctgttctttgatggtgccaagcatactcctgccttggggcctttacatctgctgttccctctgcctggaatgctctttctagatttttaatgccttactttctcattttctaactcagagaggctgaacctaggtacctcattttaaacagatacccctgcaagggtttcttcctctccttatgcttattttcctcatagcacttaccccacattgatattgagattttttttctttcttttctttctttttctctttctttctttttctttctctttccttccttccttcctttcattcttttctttttccttccttccttccattcttttctctctccttccttccttctcccttccctcccctcccctcccctcatataggggtctcactatgttgcccaggctcctggactcaagtgatcttcccaccttagcctcccaagtagctgggattataggcacacaccagcacacctgactctatgtagtcccacctgaaatgtaagtttccctctgaaatacaggttcaatactttgttttgttcactttgtatcatcagcatttacatctgccaggcattcaaaaatattcgttgaataagtaagtgagcaaacttacctgcttccacagccatcctttcccctctccctagagatgtttttcttcctgtctgagattataatgtctcccctgtgtcctgcctcctcagcattccttaatattgcctatcttccacattcagttctccctggctacattttttgttttctggcaagcatacatctctcccatcttaaattaaaacaaaaaaagagaaagaaaattctctctgggcatcccctgtcagctgccagtctctgtctctcctgctcttaacaaacttttgaaatatttatttatactctttgcattgcctcaattctctttcattcaagtttctccaaacccatagaaactgttcactcctgctttaaactttctttcctgagctcttccaagatattactctcttattgtttttttaatcttacttccctgattgctacttttcctgtccctccctcaaattttgtatatcacagcgttctgatacaagttcttcatgttctccagattcttccttggcaatcttactacatccattgctttagttaccacctaaacctggaagcccagctcagatttctctgtactaagctcatgacttatttgacctagtgtctacttgatatccaccttgatttccacaagcacctcaaaataaagatgccctcttccatctccaaacttgattctcctccagtgttacttattttagtgagtggtagcatcatccagttgctcaagtagaaaacatggatattgtccttgatttatccttcgccttcagcccccttcccccatttagccaaccattggcttccattaattctattacagtgagagaaattgtatccccccagaaagatatgtgaaagtcccagcccccactgcttatgaatgtgatcttacttagggtctttgtagatgtaattcaggatcttgagaggtgattatcccggattagggagggccctaaatccaatgactgatgtccttaaacatgaaaggagagggagatgtgagacaaagacacaggggagaatgccatgtgaagatccctataaggctggagagagagattggagtgatgctgctacaggccaaagaacaccaagaattgccaaccccattgacagcctgatttcagacttctgacctccaaaactgtaagagaataaattctgcttttttaagtcatgaggtttgtagtaatctgttatggtagtcccaggaaacaaattttctaccttctaaatagctctgaaatccatctatgtttctctaccaacactgctgctaactagttcagatcatgattaatcttctgcctcatctccctgctactagtctcagcccatctttctaaaatgcatgaaattcattccactatttaaaatctgttgagtagtttgccagtgacttggattaagtctaaatgcctagtatcatggtttatgggactttataatttggcttctgcctacttgtgtagccttcttttcccactcaccctcaattctgttttttgttttgttttttgtttgtttttgagacagagtttctattgttgcccaggctgaagtgcaatggtgcgatctcggctcaccagatcaaggttcaagcgcttctcctccctcggcctcccaggttcaagcgtttctcctgcctcagcctcccaaatagctgggattacaggcgcatgccaccacgcccggctaattttgtatttttagtagagacggggtttctccatgttagtcaggctggtctcaaactcccgacctcaggtgatccgcccgcctcagcctcccaaagtcttgggattgcaggcgttagccactgtgcccggcccccactcaccctcaattctatgctacaggcatagtaataatttctgatatttctcagcatttattctgtgccagccactattctaggggctaaattgcacaacaaccctgtaagatagaaaacaggtttctttcaatgtctcagcctttctttctctcgcttccaggattttgcacacgctgttcacactgctctctgcctgaaacactctactttcttttcccttgctctttgaccctctctcaactggctaattcatactaacactttaggccccagtttattcaatacttcctccaagaagcgttcctcacttcctaaatctgggtatatgtgccaccctcactgcctatattcccattacaccctgaactcccccatcagaatactgtttactggtctatacctcacactgtattttatgttttctttggggaaggggtgtatctctattaccattgtaactccattcccagaatcgagcacaatgcctggcatagaagagatgctcaatcactatatgttgagtaaatgaaaaaaccttaaacaaaggttgctaatagcattatgtctctaataccagccagggcagaaagaaatgcatcccagacctacttgccaactgtcctcttcctcacaattctgatgcctctgcctggaccagtcctgaaacatcttttcataggaattccatgagatctctaaggccagttaatcttcagttccctatcatattcagcacttctccaaatacaagcctctacaggtggctctcctttcccagagagctttgcaagctctcccaaacccttctgcttacttctgctctcctttttcctgggctttctggaactccagcctattcaaaacaaactcacctgtattttcatccttttttttttttttttttggagacagagtcccactctgtcgcccaaactggagtgcagtggcaccatctcggctcactgcaacttctgcctcccaggttcaagcaattctcagcttcccgagtagctgggactacaggtgtgcaccaccacacctggctaatttttgtattttcagtagagacggggtttcgccatgttggccaggcttgtctcgaactcaagcaatccacctgcctcagcctcccaaagtgctgggattataggcatgagccactgtgcctacccatattttcacccttttaacagaatattctttccatctctggcctgaaatagaaacctgttttccattagaaaaattatcttcttacttctctcttgggtggaagttgttaatttgtctcacccttgtagaaaaccctctcctttcaa

SEQ ID NO: 5236 - DNA, 1448 bp, Homo sapiens
ccatgcccggctaatttttaaaatttatttgagacagggtctggctatgttgtcgaggctggtcttgaattccagggctcaaacaatcctcccacctcagcctcccaaagtcttgggaatacaggtgtgagccactgtgcctggccatggtagcttgtcttgatggtataaaattactgttttcattactgtgttagatgttttttcattttcccatggtggcctcctttgggactgtccatgcttttgctccaagagtaaatctcaaaggagcaagcatgagtaggaattttccttgcatgcacacagccagccaaacagccctatgtccgtgatgaggtgcattccagaaccagtggtaggatggggttgggttgtacctactagctgaagtttttattagatgtagaatttaaactcacacttggttctgggtctagtatttaaaaacttcctattgtattatgtatatctttgtattcctagtgcttaataaattatagttcctcaactactgtttgttgatgatttgaataatgtacaaataaatatcagggagtacaacagctccattaaatcatgtgggtttttccaattatttgctgctatttgtttctggaactgatctgaaatagatagcattttgatgtgtgacctttaacttaccaaggcagacagaaaacaggaaaagggtgggagtccctatgactaaaacgtttatgttaagtccatgatggatattccaggtgttctggtaggcatcttcctggccaaaatttaagctgaatttgagcgcaacgtctaataacggctggacttgttttccagggacctcaaaggtattttcttagataggtcatgttctggggcttttgactctaatgcaatgtgggcaatgcaatgaccatgttattttagagacatttacaggtcactcagggagtatgaaggaggcaaacactttggctctcttatatctgtcactcacaggaagctggtggcttaaagtttttaagacatttgttttggttgagttctccaccagaagttgagcaaggcagaattgcaagggcaggtccaggttttgtgatgtctgaagctttagacaatataagttgtcctatttaagaaagataatataaaatcataaataaaaaactagatatgaaaatgagtatgtaacttgaagccccagctaggcacagtgtctcacacctgtaatccttgcacattaggaggctgaggtgggagccttgctcgaggccaggaatttgagactagcctgggcaatatggcgagaccacccctctttacaaaaaaaaaattaaaaattagccaggcatggttgcgcacctgtagtcagtcccagtgactcaggaggctgaggcaggaggattgcttgaactcaggaatctgaggctgcagtgagctatgataatgccactgca

SEQ ID NO: 5237 - DNA, 1710 bp, Homo sapiens
gctttccgctaactaccaccgtcctgccgggttccacacaggctgctgctgcagtggggcaaacttgaaaggctgaaggcctcttccaccgcagacctctcaccttgccaggaaagaggactaaaaggcaaaggtaaccacggccccaaaggaggcggcgaacaggaagtgtccatattgcagcgctgaaacagtagctcccaagacagccaccctctgaggccccctcgaggcggtggaggggcgagagggtgccggggtcgctcccacacacacccgggacccgcctctgcccaccacaacgcccggccgcccccggcacctccccgtgcactacttggcggggcccagccagtcccaactggggccggacgaggactccgagcccgacatgtctcgctccacttcaagccagaggagggggcgttgcaaaggctccgaggtgcttggggtacttccctaacagcagattccagccccgagccgagccctgagggtccttggggccccctccacgccttcccggagagacgacacccctcgccgcggtttccgccgcgcgacagcccctcccgggcggtcattacctctcaggaaaaactcctaactcctcacaagccacactcccctcagttcgacatcccccggagcccacacaccacccgatacgcgcgccggggacacccccgcgccggcgcaaattcctcactggacaaaaatgtccgggcgcgtcacgggacagccgcctccgcgccccacgcctggcgcgggtcgctcgcgctgcctccgcgcccgggagctgcgccgcgggctggggcggggagcgccgaccctggaggggaccgctccgcccgggactcaccgtcagctcggccgggaggcgagggaccggccggggaagacacaatatggcagagcaccgcagctgttccctgcagcttccagcagtcgcctccgggaagacgcggcaaccagcaggcagcagcagctgcagtggcggccccggcagcaccacatccccctcccgctcgcttcctccccctccctccccttccccgctgccatggcaacgcggcgccaaggcgattagccccacccctccctccagtcccgcctcccgcgaccccgaggaagggggctcggccggcccctcccggttcccgcccacctcctaccgaagggaggggcctgggttccggctggctgcctggcacggcggctggggtgggggtgaaatgcagggtccggaagggcggggctcacacggaaagcagggtggaggcgctgtaggccggtgcgggtttagggctgagcagggcaggggaaagcgggaaaatgcaaaggcctcgcatgtccgaggaaggacctataggagtgcggcggaggcgcggcgcggccgctgagtggtcgaggaggcgcgggggcggggctaggctgccgcagggcagtacggccctcggtgcctgtgcccgggctgaggagaccttcctcgacaccccacgttatgtgggtttccgcaagaccttccgccattgcctgggctttgaaagcgctttaggaacgatacggaaacggaggcttagaagtggaaactttacagatatggaaactgagacttagaaaaatgacccgtcaaaggccttttctacaatgatcttttcaaccagaaaatgaagagatggattttacagtgtgtgcttactgcctatg

SEQ ID NO: 5238 - DNA, 1149 bp, Homo sapiens
tttgtgtttgaattaggacatacaggatttgtctaggcatgctgtaatactagttttgtgaaactctggtgtgataaatagctacttttatctaaaccaatgttatttactacactaaaaaaagacaattaaaatcttagccaggaaaactaacacatacattggaactcttcctacattcttttatgttctaacactcagttgctatctctaaacttttggtttgcatatgaaaaccagtaaatcacaacaaacctatattctgaaaaatttatatttagaagagccaatgctttaggaaaaagcattactttataaggtaatatttttctagaaacatacacttacttctgcttttttacgagcttccatagctttcataagcatcatgtgttgtcgccttcgctctcgttcctattaggccagataaaatgtggaaaataactcagccacaattaacagtttgattttccaatgaaaaaacaaaaacaaaaacaaaacaaaaactcagtatagcatgtttagcatttatagacaagtcacagtaaatactaaatataagacaagaatggccagtctgtgcatgttttagttcaggtttagaaagcaaatacaacaatcaaaagcaaaaaggtaaagcaatgaacatggagacagtgtaaacagaagcatacaagatttacttatggtcagttgtgatgctccttcaaaagctggcagaacaaaaagcataatggttggctggaacagccacaaaagctgcaccatgggctcacaggtggaatcttaaaggcacagtatgaaaataagcctgtgcatgcaaaacaggtctcaaagtcatgcaacagcaccactacaacttgcaaataatgtcagacttgaaatgaagctacatgtctcacaagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaattta

SEQ ID NO: 5239 - DNA, 4145 bp, Homo sapiens
gcgtgcccgcgctgagggctggcgtcgtggcaagtggcaccgggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaagtaagaacagtgctcaagtggcagcagatactgactatggcttcatttcacagcttcacacagcagggtagcagaaaacaaagaatgtaagattggacccagttgcagctgttcaccaactctgtgatcttcaaaaagccatatagcttctccagacctgttaatcagggaagaagcagataactgaaggctggctttgagaagtttcgaggtaacataggaacctgctcatgcaggcactctttccatctgacttgggccaaggtgctccgtgattgacaagcagccagcctctgggagagcactctgatcagatcattgatagaacattcactactctacttatcatacccatttacttatctccatcttctgttagactccttaaaaacagcagcccacagcaggtgtggggataaaacagtcctgggcagtgctcattgtactcacactatgccaggcactgtgccaggaacattcaaatttctaagaatctacaaagtagatacctcattatacatcttacagagagcatcattggtgtttccaaggtcacagggctaggcaagggtggaaccctgagtctgcttgtctgtttgccccatgacagcccaggggtggtggcctcaccccacctccaggcacccacaagaatataaaatcttgtacaaggatgtcgatattactattgccattcccaagtgcacctgcacctgtagtatcaggtggtttgcagccttggctgcatagctgcatatgagaatcacctgggaagcttttaaagatcccagtatccccacctcttccccagttacagtggagtcttgcgggtggtgggggacatcattatttttgaagcttccaagtaattctggtgtgcagtggggtgaccagctgtcccagggacctcctttaaaaaataatatcccgggcacatgacaggccaattgccctaatgcaaccaaggttaagaactactggtttaatgggagatattttttctgtgcttgattatactgttttattaaactctgaatccatttctttctgcaaatttttaaggcaaaaaagaaatgtgaaaatatacgtctcatttttagcaccttcagagacccggagtcatttgatgtgcttcatgacataaaattttgtaatatgccgtgtgatactaccttatttttaccatatatgtatttttaatgcttaacaagagcatatttgctctttcacatttttttttcacatacaaagttttagacatcaagcactctaaattcttttttacaaatatttttttcttaaaatgttaagaaaaagcctataatatcacttcctttgtttcctgatgtagactcagttgatgtgcacagcagtgtcaagtcaatctccaaaatactccctgtagacagggtggggagaagaccctcacttcctgccgactaatgaactcatgttgatacagacctttgcctcatcagattcatttgttaagctaaccagtgtctgcttctctggacattactggactcttctacctgtgaagccatcttaaaaaaatatattgactgatttcttaacgaaacatctactctttgccaagcataaagttacctcccacttgcatacacccttttctcatttgtcctcacatcagctgtataaatgagaaatattcacattttataagtgagaacattcaggctcagataggttaacaagtttgaaatcatgtgctagtaaaccaaacacctaggttttgaaccttgttcttcttgtcccaaggtcattattctctactgtgttacactcagctgctttcacctggaaaagcagaggaatcaggctgtctcctgcagctgtcttggtccattctgctgcccaagcagtacacttggtttcagatggaaatctaggatcccaagcatgggtacatttgtcggcagcatttggaagtatttttcgtcatcaggatggcagtcaatttgcaattcagtcatctcagtgcaaggtagtttggcaaaaagattatgacacttaatggatttttttcctcttttaaatctgtttacccagcattttgtagtataatgcaatgtaataacattgcattattttgagcatagtttagaagccaagaagatgctttcaaacagctgacataattcagttatggcccagatgtcctgccttccccatcacacattcatattaatggtcttagaaagctgtttctgaggcaacagtttcttcctcaatatcatcctactggggaaattttggcagttgatgtctaatgttgatttttttttcctgattgattttaattgttcactgggcactttggggtagaattgttttaaaaatttggttactgggaaagctagacaagcctttgctatggtgaaagagacagaaggaatatagatataatttgtaagtggttatgccattgggcttaatgctttgcatacattatctagtttgcatctcctgatcgccctttaagtttgcttacggtaaagcattattccttgcttggcaatgcacagagaaaaattatttgctgaaggaccctgcaaatgagggacaggatcagagttggaactgtaaaccctgccactccatttcatgtgatcttcatgggtacagcagctataccctgccccagcaatgagtatggtagagccacattcaaaggcggactttggggtcagcattcctgaaaagagctgcttaagtttgcttctacatccaaaaacgatgcagtcacagtcaactaacactgagcttgctgggcatctcctgaacagaaatgtatgtggtggtccatgtagcatgtatgcgatataattggccacccacctttccttttcacattaacatttatcacagaaacacattcatttgctacagggatatttcacaatttggctgaactttgagagaagtgggtgaggaaaaggtagtttcgtaactagtttatatataaacctaaattgtagtgagtactcttgtaagtggagcatcttttctatggtaattataaatggctgttagcccctttgcactaaagctaggtgggtggttttgccacagaggtaaattatctttcgggcggtataaccaaacaaataaaatataaagtgagattcagggcatgttctgaatacagcagttaattaggcagctaagaaaactgtattttagcccctctgactatgtgattggtatttttttaaattaaaaaatggaaaataatatttttaacaggttatgatatgtcagtcatttaatcctcacagtaactctgtggggtaggtaggtactgtttctatctcattttacaggtaaggaatcaaaacagtgggtatacccaggttgtatatctagaaagtgatagagctgggattttaaactttataatctgattccagaatctctacctttaaacactatgttaccacttacttctcttcaaattttattgagcattagatgtttccagtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatctgtgacacaccgtgcctcttgcctttggtgcgtggcagtcatctttggctcatgctgtaccttattctacattagaaaactcactgtatgttgctaaataattttttgaaaacaggcagattaataaatggacatcttatttattgcaccataaaa

SEQ ID NO: 5240 - DNA, 1729 bp, Homo sapiens
ttctgtttaatagtgcacttcatttatgctacaggatgagcagggttgggaaaacacaatggaaggtcatcccgtcggttgggaaaactcggggagtgccatcctcacccagcaacgagctctgctaccaggctcaggcacagcctgccttctctgggcttcgtttttttgtttttttgttttttttttctcccttttgggctttgctctttctctgcattaatcttcagctgctgaagagtcagaggtggaggcaggagtggtctggctcctggggctgggtgtcagaggtgagagggcagggcaagcaggccaagtgagctccttgaaagcatccttacccaggcatttagagaaaatcattttcatcattggagtgggaagaggacaagagaggacagcaatcagaggccaacgctaagtgcttctgaccctctccctcacagccggttactagctgtttggacagatttgcccattcagccccaggacaactgggggggatggcagggggtctgctggcaatatcaccaggtttctcttggaaacatggtctggctgctccaagagccctaaaggacaccatcatcacagatgatgattctggaatctcttctaccctcaataaaataatccctcaatgccaaatttccataattaacgaaatcatgaaacaaaacagcatgtttcttaccgaaacttaaagctggactaggaacagtagctttgaaatagtctccctttaccctccctagcaaataacaggacccagagcgtcctttccactgctgtctgtgctgactacgcggactccaactaaaggaatccatcgaattctgtcccgactgtgcttccatccccaccttggaaaggttcctctgctgtgagaaaaacagtttagtgcaaactcctttcctaaatggggtaactggtcccagagctgctttctattcccagcacgccatccacttgccttgacgctttctaaggctggtgtgatttctgggaaaattcaacgatttgccccatctgccccattctctaaaatgaaaagtctgagttgaaagggacacatcctaagctgttgagatttatagggtaaggcaagagctcttgagactcagggaaagtgaggaaaatgggtgtgtggctctttcacgtggactctctgatatttaactcggtcgtaactctgagggagcttttgctcatgccgatcccattcaaaggcttctctccagtgtgaattctctgatggcgaacaagagccgagctgtacctgaaggctttcccacactcactacattcataggggttctccccggtgtggattctttgatgctgaataaggcctgaactgtaggtaaactttcctccacattccatacattcgtagggcttctctccagtgtggattctctggtgctgatagaggtgtgagctctggctgaaggctttcccacattcattacattcatagggtttttctccagtgtggattctctgatggtgaataagggttgagctcctgctgaaggccttcccacattcattgcaggcgtagggtttctcaccagtgtggattctctgatggtgggtgagggtggagctccagctgaaggtcttcccacactcattacattcatagggtttctcccccgtgtggatcctccgatgcagaatgagggcagagctacagctgaaggccttcccacactcattacattca

SEQ ID NO: 5241 - DNA, 963 bp, Homo sapiens
aaatgggggctcaccagctgcccgtggacggagtgggaggaggcccccagtctccaggaggctccatgcctcaggctcagaccggcagctcgggaacccagctagcaggatgaactccagcagaggaactcagcgccattgctgcggctgtgggccagaagagaaagagaaagagaaagagaatccgcctcggtgtgacaagctgtgcctcagaacccgagcagcaggagagtgggcagcagggggtgtctggcagcagagaggggctcaggcctgctgggtggagcggcgctgggggacacaggtgggccctgcgggaggcaggagctgtccaggcaaagccgaggggaagggccggtatgaaggaggcgcccgatgggaggggcgagttctccccctgcaccattccagtccactccgggtttcctgtagaagggggagccccccaaagtccatctgtgtttccccacctcactcacacactcagggaccctcggctgctccccggggcgctgactgacatttttgccgaataaaggggccctgtgggtttcctgttcccatctcagcttctgctgaacagggtaaacttcccttccgaataaaaccaccagaatgcggtctggccaatttcagtcatagacccaccaggcctgtgtccctgcgtgagggggtgggaaaagcccagagtgcccctacccgtcccctgggaggggtggaagggcagctcttgctccccctgcagagacgctgcgcggactgggaaggctgccagcctcgcccggtctccctgtggaccctgccctgaccccaccccagcttcctggctccctgcaccccactgggcttccctgccccacagagcctggtggtagggagacctccggatggagacagcccacagtcccggagccccaaggcaggcaccagtgagtccctcgtgacggcctcgctccctgcatc

SEQ ID NO: 5242 - DNA, 3079 bp, Homo sapiens
gctgcgccctccccactccacagatgaggaagctgaggttaaagtcacttgccccaggtcactccgcaagttgaagcgcaaccaggatactctggaacaggatgcctgacttcagaggagaggcgcgtaaccaccaggcaactggccccacgaaaacaagtcccgcaacttcccttctttggctcctacttgctcccggaagaaaagccttaaacggtattcaagccctttaggatctgatgtcctaggactccactctgggcttccagcctggggtggtactggtccctaggcatggaagctcctcccactgccccttccttcacccggccacctcctcccacaggtgtcttcctggtactcttgcacaggcccgagtcccttaccaccacggccttagcctgctctcgtgctctcagtaatgttttctccatttgctgcctttcattctttccagagattcttgctcaacccaaccaggccagcccggggactagggacatgtagggacaatagtccctgcttcaggcagttcagggcagaccacagagatgtgacattacagaccattgtgagcagaggccttgtcccattctgtgttgcatccctaagccaggaacaaagtccagcccaggcctggctccaggggacacgcagtagtatcctctggcctgtgcaagtgtatctgtagcctcacatgccaccatgtgagtctgcaatctgtctgtgaatgccctggtgtagaagccaggagtttggaggtgggagggagccctacagaatgatagccagtgctaactcctgggaatgtccagccactaagacctgcccacagccctgccatgccaatgtcctccttttcacgggagcagcttgcacagactttcagcgcacagctggcattgtcttcccaggagccatcctgtaacccaggccaggtgaagggctcctccctgggaccccacagccccgttcccatcatccttttgtggtgatcaaggcacccatcacacagtattgccataaaccgggtcaggttaacctttcattcccttaggagctgggtgggggcagccaaaagtatttgtaggaggaagagagaaaggaggggacagagctaggaagaatgggaggacggtcagaacgcccctgtgaaggaaggagagcaccaagtccccgtgttctgcctaccctcccccagacagcagatcaggagcaccccgcgcgcccccccccgccccgccccgcgtcggcgccggccccctgcaatggttggcggtatggggaggtgaaccaagaaggccaggagttcaagtgcgtgatcccccactggggcatataggttacagccgccagggcaactgaaactcctcaggctccagagggctgaagtgagtcgcctccacgttcttgaggtgcttccgagccaggaacagtgcgaggcgccggcgccgccgcgagctcaggccctggcccaccagccatgggaaggcgggtccgtgtggccccagggcctcctcgccctccagctcctcttcgcagcgtgcacggtaggagcgcagcagcgccaggcaccagtcctcgtccacgcggtagcgtgcatagaaggcggcctcctgcgccaagctgccagcgcgcagccagcgggtgacgacggcgcggccctctcgcgccatcacgacggggtagcggtgctccagcaggcgcagcagcagctcattgccccggttgccctccacgtcaccaggtgacagggggcgcaggcggcccgaagtgctgaccacgtcatcctgcgtgcgtcggagcagcagcaccggccccgggtagcagcacagctgctcggccacgttgaggttgaagtgctcgcgcacggtgcgcaccaccagccccttccaactgtggggcatgaccttcagcgccagcggcacaaggtcgtcgaaggtggcgtccagcaccagtgcacccagctccgggtaggtcatggtggcccaggtggccgtgaagccgccaacagaccagccgtagaccaccaggtgcgcgggcgggaagtgcaggcggtgcagtgcgtactcgaccaccacgtccatggcgttggcgtcgtgctgagggaagggcacgccagtgctgctgccgaagccggggtggttccagcccagcacggagtagccggcctcgagcggtgcagacagacagcccatctcgtagaagcccgcgttgccttcgcagcagatgacgaggcgcggcccgtgcacgtggctgcccgggtgctggcggcggtccatgaacatagtgtcgatctcgttgccgtcacaggccaccagcttggcgcgccggccgtggtagcgctccacgaggcgctcttggccctgctgcagcagcggcagcagcgcgcgcgtcatcagggacacggagccggggtacacgagccagcggcccagcgagtgggccagcgcgtagctagcgagctggccgggcagctcgcggagctgctgcaagaggcactgcgcctggctgcgcgccccacgtggaggccgccccagcgcatccccgcccagcgtctcgtcccgcagcaaccacacgcccgccgcggctgccgcgcaggtcagcgcccggtggctgctgctccggcccacggcgcgcacgtcatcccagcggaaggccacgggccagccgcggaatgggtaggtgtagctggcggtcaggtagatcttgaacacgcgcaccagcgccttcacgaagcagatgacgcacatgagcggtggccctaacgcccagccgctgggccgggatcgccgcgagaggcacagggcagtcttaggggataccggctcccggacaagccctgatggcctttgtgacctggccttccagggcggagggaaggctgcatcctgttgctaggtgatgggtgcacaaagggttcccagagatgatgaacccaaggttctgcccgtcccccgccttcgccaagaccccaccagctaaacgctcccaggcccagctttcccacccatgatttgagcagctactgtctccctctttcttccttatttatttattaaattgagatggggtctca

SEQ ID NO: 5243 - DNA, 785 bp, Homo sapiens
ctcccaaagtgctaggattacaggcgtgagccactgtgcccagcctggtatgattccatttaaacaaaatatccagagtaggtaaacccacagagacaaaaagtggttggtggtaccccggagctgggataggcaaaatcacacacgcagggccacaacccacacccactcggagatgttccaggaacaatctcaggaacctgcatttgtaaaaatcctccccaataccccatcagaacacagagccactggtctatgggccaggagcccaagacctgagaacaatcctagtttcttcaacaactagcaacatgactgggcaactcacacccacctctgctcatcttctaaactgtaaatcagagtccatatggcttgtattattcacaaggtttttgtgaaggcaaacgggggaacatggccaccactggaaaaagtggaagatggaaagttagtgatctgaatctgaacctttcattagacatctctgctctgagggaccatctgtggggtgagaagaaattgggctcagtgcttaccatgtggaaagggaggaagggctctccacatgggacacaagggacagccatgaaggacagaggctgacgagacctcccagggtgagctccttccagcactggctggtacctgttgcttctgcaaatgttccccagaccctctgcactctcgcaggtcagagtaaaaaaaggttggattctttcattttaaaaaaagtttgagacagggggtgaggttagaactgacatgcagaagtggcaagtcct

SEQ ID NO: 5244 - DNA, 735 bp, Homo sapiens
ggagggagagggcaggaaggaggcagagctgtccgtgggaggtggaggccgaggacattttcctgaagggcaggggttggcaacttttcaacatggagtgccaaactgctaacccgtcttctagtgtgtgagaatagggaccaaggtggtggcgtgaccttaactctcagaagcagaggaggcaggtgggtggagggggatgctgggagttcacctgcctcttgctttttgtgggtggctgctgccaccaccgccgctgctatatagtttaggtttctgagggtctgcaagtgcagacagcagctggggccaaagaggtgttaggttcaaaggctgcgaagagaataggctactggaaaaccaaacccaacagaattcacgtccaaaaatccacattctccatcgcttctcagccttttggctaagattaagtattaaaaaaaaaccaggctctgccaggcgcagtggctcatgcctataatcccggcactttgggagtctgtggcaggaggattgcttgaggccaggagtttgagaccagcctgggcaacatagcgagaccccatctctacaaaagattaaaaattagctgcgtgtagtagcatatgcctttcaacgtagctactcaggaggctgaggtgggaggatcccttgagccgaggagtttgagtctgcagtgagctatgatcgcaccactgcattccagaccccatctcgaaaaaaaaaaaaaaaaaa

SEQ ID NO: 5245 - DNA, 3886 bp, Homo sapiens
agggcttgcctgtggagaggctggagtcagccgtcagcgcggaactcctggtcttcccactgccacctctgcagcccccaccagagatatcagaaaacatcagctccagcctgcagcccagacacttgaagtcaccttggctgcccctcctcacacccgtgcccacgtcagcaaaaccagggccggcttgttaaccgtgtccagaacccacccttcccaccctgcccaggccacctccctcagtggcccagggggctccaagttgaagagcccaagacaggtcagagatgggctgggcggcctctgccactcacctccggagagggcagggagcagaggcctcagtcatgaggtggggctgtcctcggcgtgggcctcgagactgggagccactgcccatacccaagagacctctgcgagcactggggtgcagagccagctctgagaaaccaggaggctgggattttgaagaggacgccggtaaacaggctcagctgtgggccaaggaacgcgaaggacacagggcagagcgcccacaggacggacgacgacaagcgacacgaggcccagcgctgccccctcccgcctcctgacagcccggaccagtctctgcagtgccagggccaccacacagatgcctcctccacacactctggtccgagggtttccgggccctctgcccaggcgccgaggctggagagctcctcccgggctacaactggtcactggcgtggtctctatccgcctcgggcttgacggtttggccaggagaaggggcgtggggcgggtgggccacagggggcaggccgtgggacagggacatggcgctggggacgataccttccacagcagctgggatgccagtgggggccacgcccaccacgcccggagggtacctgctgggagagggtccatccgtgaggcccacctgtaggcggcctggccaggccccacctgccctcctagcatcggcagcaccgagggggcctctccaggaggaccagcagtcagggccccgtgcccatggcactcctgtgtccactgagccctgaaggccaccccagcccaggctccttccaagaggccctggttctcatgggcctttcagctgcagatgtcagaggccgacctgagcacagccctttccagctgcagatgtcagaggccgacctgagcacagcccgttccagctgcagatgtgaaacctgaacctggcagcacggaagtcacaagggccgacccaacgcccccagaagtagagtcctgtgtccccggctccacgcacctgcttgacggtgaagtcgttgatgaggtggtggttgtgctcgttgaggccgcagtgcagggtcacgcagtcgctgtggaagagcaggtcctgcagggtgctgacacgctgcagccccagcgcccgctccacgccatccgacaagtaagggtcgtagaagagcacgttgaagccgaaggccttggcccgcagcgccactgcctgccccacgcgacctggtggcgtcaagacacagtgtgagacccttgctcacccgtggccgggaggccggccccgaaagccagggtcggagtggcctctgtgcctcagtttgaccatctgccaaggatgacaccagctgtggtcaagccaaggtgcccacgcacgctccacacgagcgctccacgtccgctccaacgcgcccactgccaaggcggaggagatgcacaggggtggaaagggtacactagcccctcggcccacaccagctgccagccacaccactcccctgcagcctgtccacaggacgtgacatgaaccactcagtgtcaaacggactggtcagtgggtctccacccacccaacacatgtcctccgtgcccaggcccctccgctggcctttcgatccacccatcaatgtttccggcatctcaattccagccaccactacgtggagacggcaaagggggcaggagggaaacttccagaccagggaggccccgctgggctcaggtcctgaccccttcgagtggagcggcagagaaagccatcccaggcagacgtgcctgcccccaccccagcagtccaaggctggcacgggtcccagcacaggagccgtggagcttgagccaccgtgtctggctggggccggctcctcctcggggaagggtctgcagagtgctcgtgcccactgtgagccaacagcatggctgcaaaggacacaggaccccaagcccgcgaacgtggtgtctcctgcattgcctcagagggaaccgctacacaggaaggaagcaggttgagcgccggggcgggtgggaagtgggcgcagtttcaaaggcggcagccagggcaggcctccctgagaagaccaagcttgctggagacataaggggacaggaagggagccagagagctggaacaacacgtgcgaggggcccgcggcggcctgagggccaaggagaccagaccgccaggcacacagggtggccggacgtggcccaaacgcccaggggacccccagtcactctgggaagaggactgggggaggctgggaggccagtcagaagagctgaggaccgtctaaacgcactacatcctagaaagggaggcgcctgttctacgagaaggaacatggtggctccttccatccccagggacgaggctgctgcaggagggaggagggctcggcaggcggaggtgggagcagcagttctgagggttgcagccacggccggagtacccgggcagctccccaggtgcagaacagcccgtctgtcaacgccccctgccagggatcccaccaaatggggaggaagagaacacaggcagacacagagaaaggcgtctcccacagcgcagaaggcggacgacacgctgtttcccactgcgcacaacacaaagccccggaagtcgggctgccggtggcgaaaaccagctaaagccgcgggccggcgccggccacgcctgacacgggagagcagcggctgttcggggcgagaccattcttcacttctgtctctgccattctcttccacatgatgtctggcttaggataagaaattatgatgatgcaggtgaagagacaggaggatgtagtttctaattagaacaaaacactggaagcggacagacgcacagatgaccgaggctggaatcagccagcaaaacctcttaataactactataaacatgctcagagatgacaacaagtgtggatgtaaacagcagaaaaatggaggcttccggaagatgaatggtaactctataaagaaccacatagaaattccagaacgaaaacatccctctgaaacggaactccctggacaaagctaactgcaagaaaaggatcgggagcttgaagggaggggctcaaagtcagcagatggcatccaaacagaagcagagagaaaagaatttaaaaaataaattttaaagaacaggccttggtggctgacgcctgtaatcccagcactctgggaggctgaggtgggcggatcacaaggtcaggagttcgagaccagcctggccaacatggtgaaaccccgtctctactaaaaatacaaaaattagccggacgtggtggcgggcgcctgtagtccaagctactcgggaggctgaggcaggagaatggcgtgaacctgggaagcagaggctgcagtgagccgagatcgcgccactgcactccagactgggcgacagagcgagactaccttccacaaaaaaaaaaaaggcaacacattttcggacaaagaaaagcaaaaggaatcggtcactggtgagccacatttctaagacagtctttaggctacaggaacgtgacgcccgaggacagccagaatcggggggcgtaaacaaggcagaaagggtggatgtgtcggttgatattcaaaagaaaaattactg

SEQ ID NO: 5246 - DNA, 569 bp, Homo sapiens
actgtgaaaatctttcttttattactgtctcatgtggcaaaataacattttatacaaataatagaaactgtcccacctgggcctctgtcaaagagagaagggattgttgttacgcttgacaggaacatgcaaatcccatttgaggagccacaatgagaaacagaaggtgaggagacagtgctaacagccctggcatctttctgccagtgaggaggtgggaacaatggcaatgcagctttcccctgcagcataagggacagagccacacgtaaggcacctggatttacagtggacgccagttctgagagtggccggtctggtgataaggaacccactccacaggaggaatggtctctcccctctctcggggctgaatccaaggccagcacacaggggtaagctaggaccttctcagtgagaaagctgccagcatgtggcattgccaagactctggcctgggacaaagcactgggccaaggttcggggccactcgccctaaagcccacacagggagcagcactggtggtggatggacaggaatttctgtggccacacactgtctcttccat

SEQ ID NO: 5247 - DNA, 955 bp, Homo sapiens
cttcaggtggagtctgttagtttttgagaaagagttagggcgagtttaaggcactgtggcagctgtgagataaagtctggttcctccccagctggctcaggaaatgttcgcggatacaacggcggccccctctgggcatacctgcctgtggagcggagagtggacggtgtgagggggaccgggagaggcaccaaatctggcctgggggcccgagaagcttcctctcagtgaccacaatatgaatgggaacagcaagatggcaaaagcttgctgagtggtacagcgccagcctgggtagtggcctccccagcaagttgcatgtcactagcttcctgtggctgtcactcctgggcccaggcacctccgaagatcagcacctcctcatgggctcaagcgaggacaggagcccgtcacccatgagctctcaagggcagagccactgtcctgtctcgatggctccaccgtgactccagtggactttggacagtggggagcaggcccaacagggccactcggatgtggtcactctggatttgggtggatcagcaccaagctagactcatccccagcccccaggtgctgttgctgctcctgcgtgaggccccatccacagctgcagctgtggcagggtggctagtggtggccagcatggccctgctgcagctccacgctgtggggggcgtggccctgaccagcagccacccctccatgtgggccacaggggaggagcttaggaagccgccttggcaaggttccgcaggctctgcgtctggtgtggaagagctcacggggaagcactcctgcccaggacccgaggagccggccaccgttcagaaggccccagcttgaaggcctggagagccgcccagcagcacaacacagggaagcttggggaggtgagccccacttcctgctcccgcacaggctcttctccctggggcactggctgggcggg

SEQ ID NO: 5248 - DNA, 5737 bp, Homo sapiens
gcttcggccagcccaccctgggtccctctgagctgtgagtgtcttggctgtgccccacagttggccacagctctgcacccagcattttgaacagttcctgcagagccctgaggcggaggcagggcctgcatgaacagaagcttctggagcagaagatgctgcttctgtcccttgactgtgatcttgagaccctatctagctcaggtctgggcatggggcttgagcaccttggtgctgggacacaggcccacttcccagctgggctggcagaggctgcattaactgaaccctcccctactcctatgtccccacccccataggaggcttcccctctgaaaaccatttggcaatttctaataaatacacgcttatgcatatcaagcaaaccctactcctgggtttttatccaaatggaatgaaaacttatgttcaaacaaaaatttgaatgcaaatatttatactggttttattcaccactggcaagaagcagaaacatctggtttgacccaccacacacacatatgcacacacgtggaaacaacccaattgtcattcaactggtgaatggctaaacaaagtgtcataccttcataaatggaatcaggctcggcaataataggggaacaaactattgatccataaggcaactgggatgaattgcaacattgttacactgaactcaggaagccaggctcagaaggttacatacttagactcctagtcagcattaaaaaggaaaaaactacgttgcaattgagccacctggaggaacacccagaaaactatgctgagtgggagaaagccagtccccagaggtcacatactgtatgattccatgtgcagaacattcttgaaataacaaaattatacaagtggagaccaaattagtagttgccaggggctaaggaggggtttgggacagtgggaagtgagtgttcctgtgaaagggcaacatgagggatgtttgggagggaagcattcccttcttgctgtatcaatgtcagtatcctggctctgatccattactgtagctgcaaggtcctacccttgagggaactggccagagtacctaggattcctctgtattattcctcacagctgcatgagaagctacaataatctcaaaataaaaagtttaatttaaaaaacggtcacattgagagatgacagcgtgctggcagccctcgctcactctcggcacctccttggccttggcgcccactctgaccacgcttgaggaacccttcagcccactgctgcactgtgtgagcccctctctgggctggccgaggctggaactgactccctctgcttgcggggaggtgtggagggagaggcgcgggcgggaaccagagctgctcgcggtgctcacaggccagcatgcgttctgggtgggcgtgggctcagtgggtccgacactcagagtggcagtgaggggcttagcacccaggccagcacctgtggagggtgcactgggtcccacagcactgccggcccatccacaccacactcaaattcttgccaggcctcagccacctccccacagggcagggctcgggacctgcagcccaccatgcccaaggcatgctccccagcactgtgggctccctcacggcccaagcttccccgacaggcgacgccccctgctctgcggtgcccagtcccatcgactgcccaagggctgaggggtgcatgcacacgcacaggactggcgggcagctccgcccgtgtggccctggtgtgggatccacgaggtgaagccagctggactcctgaatctggtgggggcttggagaacttttatatgtctacccagaggatggtatatgcaccaatcagcattctgtgtctagctcggggttcgtggatgcaccaatcagcacactgtatctagctaatctggtggggacttggagaacttttctgtctagctaaaggattgtaaatgcacggatcagtgctctatgtctagctcaagtttgtaaacgcaccaatcagcaccctgtgtctagctcaaggtttgtaaaagcactaatccgtgctgtgtctagctcatctagtggagacttggagaacttttgtgtctagctaaaggtttataaatgcaccaatcagcaccctgtcaaaatggaccaatctgctactctttggctccacactgcctttatgagctgtaacactcactgcaaaggtccgcagcttcattcctgaagccagcgagaccacaaacccaccagaaggaagaaactccgaacacgtccaaacatcagaaggaacaaactctggacacaccatctttaagaacactcaccacagaggtccgcggcttcattcttgaagtcagtgagaccaagaacccaccaatttcagacacaacatcctttacgtttgcatttctgtgatattctgtaaaaatcaacagtatagggtcagaaagagaccagtggttgccatggttggggtacagaaagggtttgaatgtaaaaggaacgtaagggctgagagcaggggctcacccctgtaatcccagcactgtgggaggctgaggcaggtgggtcacccctgtaatcccagcactgtgggaggctgagagcagcggctcacccctgtaatcccagcactgtgggaggctgaggcaggtgggtcacccctgtaatcccagcactgtgggaggctgagagcagcggctcacccctgtaatcccagcactgtgggaggctgagagcagcggctcacccctgtaatcccagcactgtgggaggctgagagcaggggctcacccctgtaatcccagcactgtgggaggctgagagcaggggctcacccctgtaatcccagcactgtgggaggctgaggcagcagctcacccctgtaatcccagcactgtgggaggctgagagcaggggctcacccctgtaatcccagcactgtgggaggctgaggcaggtgggtcacccctgtaatcccagcactgtgggaggctgagagcagcggctcacccctgtaatcccagcactgtgggaggctgaggcaggtgggtcacccctgtaatcccagcactgtgggaggctgagagcagcggctcacccctgtaatcccagcactgtgggaggctgagagcaggggctcaccccagtaatcccagcactgtgggaggctgagagcaggggctcacccctgtaatcccagcactgtgggaggctgaggcagatgggtcacttggggccaggaatttgagaccagcctggccaacatggcgaaaccctgtctctactaaaaatacaaaaattacccgggtgtggtgaccacacttgtaattccagctacttgagaggctgaggcaagagaatcacttgaatccaggaggtggagtttgcagtgagccgagattgcacctctgcacaccagcctgggtgacagagtgagactgtgtttctaaaaaaggggtgcttagagaaatttgggggtggtggtggaaatattctgtatttcaattgtgatagttacatgagtcaataatttttagaaaattatactaggttttattagcttcaccaaaaagagtaaactttactgtaaataaaaatagaaatgtttgaaatgtttaaatgttttaaaatgtttattatgggaggtggagccaagatggctgaataggaacagctccagtctacagctcccagcgtgagtggcgcagaagacaaatgatttctgcatttccaactgaggtaccgggttcatctcactggggattgtcggacagcaggtgcagcgcaccgagcgtgagccgaagcagggcgaggcatcgcctcacccaggaagtgcatggggtcagggaattccctttcctagccaaggaaagggatgacagatggcacctggaaaatcgggtgactctcaccctaatactgcacttttccaaaggtcttagcaaatggcacaccaggagactgtatcccgcaccttgcttggagggtcctacgcccacgaagcctcgctcattgctagcacagcagtctgagatcaaactgcaaggtggcagtgaggctaggggaggggcgcccgccattgccgagtcttcagtaggtaaacaaagcagccaggaagctcgaactgggtggagtccaccgcagctcaaggaggcccacctgcctctgtggactccacctctgggggcaaggtatagccaaacaaaaggcagcagaaacctctgcagacttaattgtccctgtctgacagctttgaagagagtagtggttctcccagcatgcagctggagatctgagaatggacagactgcctcctcaagtgggtccctgacccccgagtagcccaactgggaggcaccccccagtaggggcagactgacacctcaaacggctgggtactcctctgagacaaaacttccagaggaacgatcaggcagcaacatttgctgttcaccaatatccgctttctgcagcccccactgctgatacccaggcaaacaggttctggagtggacctccagcaaactccaacagacctgcagctgagggtcctgactgttagaaggaaaactaacaaaacagaaaggacatccacagcaaaaccccatctgtacgtcaccatcatcaaagaccaaagatagataaaaccacaaagatggggaaaaaacggagcagaaaaactgaaaagtctaaaaatcagagtgcctctcctgctccaaaggaatgcagctcctcaccagcaatggaacaaagctggatggagaatgacgagttgagagaagaaggcttcagatgatcaaactactcggagctaaaggaggaagttcgaacccatggcaaagaagttaaaaaccttgaaaaaagattagatgaatggctaactagaataaccaatgcagagaagtccttaaaggacctgatggagctgaaaaccacagcacgagaactacgtgacgaatgcacaagcctcagtagccaattcgatcaactggaacaaagggtatcagtgatggaagatcaaatgaatgaaatgaagcgagaagagaagtttagagaaaaaagaataaaaagaaatgaacaaagcctccaagaaatttgggactatgtgaaaagaccaaatctacgtctgattggtgtacctgaaagtgatggggagaatggaaccaagttggaaaacactctgtaggatattatccaggagaacttccccaatctagcaaggcaagccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccgcaaagggaagcccatcagactaacagctgatctctcagcagaaattctacaagccagaagagagtgggggccaatattcaacattcttaaagaaaagaattttcaatccagaatttcatatccagccaaattaagcttcataagtgaaggagaaataaaatccttcactgacaagcaagtgctgagagattttgtcaccaccaggcctgccctaaaagagctcctgaaggaagcactaaacatggaaaggaacaactggtaccagctactgcaaaaacatgtcaaattgtaaagactatcgaggctaggaagaaactgcatcaactaacgagcaaaataaccagctaacatcataatgacaggatcaaattcac

SEQ ID NO: 5249 - DNA, 663 bp, Homo sapiens
tttgaaaagcaacttttattgaagaatttggagggaagggggagggctttcctgtcacaaagattaaaaacccccaaaatgcatttgaacaacataatacacaataacaaatttaaaccttgctcctctgtcccactgggtaaaccctggcccatcccccatccctggtcccatcccaggggcccagcctccgatgacgtcctcagagacacggccttagtgctggggggctgctgtgtgcctgccacccccaggagagggtgctggccagcataccatagtgaggttgcatctggtgccaccaggttgaactgaggcccagggccccagagagatgacagatagctggtgacagacagcccagggcggctggctgacagagtgaggggacacatgggcaggacctgcccggccccccaatgccacattgcgcatagctgcagaagtccttaacatttccctacgtgaatcggattgttctgagggctgaggccacacccggagaacaaactggatgaaataaattaaaacccgcaggatagttttcttccctaccccgctgcgggggagggtgctgcccacagcacaaaaacgtctttccatctgggctcgagaggacagcgtggcttctctcaaatgcacccgagaaataaaaaccattaa

SEQ ID NO: 5250 - DNA, 773 bp, Homo sapiens
ttggcttcctgaagacctcttcatcctgcagaaggtgcaactccacagcatcctgagaggttggacacaaggggggatgtgacagtcctcatggaagactcgtggacaagtaccgcagcagagaagttgtcccccttgacagcacacctcgcattcatccgagtttttccgctgcaagggcagataacgtgggcaccgctaggaccatggagacccacgaatgctgaccctgtggggttctagaacacatcatttttgtgtgtgccagagtggatatccaaacccaatttttgatggggggagctgatgccacctccctgggggaaattgcaagacaaatggcacaacaagcagagagtctgggtggtgaccgccgccaccaggacttttcttctctggctgtggcttgccaacaggttctgctgcgttttgagctgtgctgctgcctgctggcaagcttgtgctttgagctgggccactctgggcgcatttgctgagcccaccaggcctctattaatagatctgactgaccaaagtaagaaatgatgataactggcatttgggtgcaggagtatgggaactgttgttcctggtgccttgcctaactgccccatggtcgtaacataacatggccctaaaatgttccacagtgggcatggatgctatgacccagtaaataacacattaaaataattaaaattaagttacctttggcacttacaattggctttacaaaatggaactctatggaccttctctgttaaaatatttaa

SEQ ID NO: 5251 - DNA, 19858 bp, Homo sapiens
agagttcgtatatgactccagtcctggcgctggatgctgctgctgttccagcttcctaggtgtggaaactgaaggaccaagagattaaacaggtgtgctgagtaaactcacaggctgagattcgaattatcctcccccgacgaggatggagccttcgctgtcttccttgatcgccacgtttctttgcgagccgatgaaggaaagcgtgaggaatgataaggccctggagactggagaacgcgagcttatcgctgtctcacatgcgcacggcttagacgttgagagctcacaggcccacttgcataaccactttcttgatagcggggttacagcttgagagcatggggctttgtgcacggccagacctaaagactactcctgggtctgctactggccattgtgacaccttaagtcatttcccctattctgagactccgtttccccgtctgtaaggtggaaagaatagtatctgtttcataggatcacagtgagtattaaatgaaataatgcaattaaagaactcagcaggccgggcgcggtggctcacgcctgtaatcccagcactttgggaggccgaggcgggcggatcacgaggtcaaaagatcgagaccatcctagccaacatgatgaaaccccgtctctactaaaaatacaaaaattagctaggcgtggtggcgcgagcctgtagtcccagctactcgggaggctgaagcaggagaatcgcttgaacccgggaggcagaggttgcagtgagccgacatcgcgccactgcactccagcctggcgacagagcaagactctgtctcaaaaagaaaaaaaaagaaaaaactcagcaaatggctgacacatgatgggcattcagtagccgatggttattacggtcaaatccaaccacagcaacttactagctgcgtggccttgggcaagtgacttgatcttctgagactcagtttaccccctgtgaagtgaagggattggactagatgatctctgcgtttcctcccccatgtgatatttcaaagtactttttttcgaacagctggttgtggcctgtcaataggttttaaaatccgtttatagagaattgtgatcaacatttaaaaaaaaaatagaatacaaaaaaaaaaaaacccagaatgtatcacacatttcaagtctcaattgatgaaacttttgtttcagttttgagtttgtattcagacacaatatgatgtgtttttcatattgtgggttgagatcaaaataattaaaagtcactgtttagaggtgaaataatcttgttttcaggatagaatgttttcctactccctggtggggaaaagacaggatacagaaagagagttatgggataccctggctaccctcttcccttcacatctggctctggagtgctcagtggggctggtgaagtatagaccaaaatatccattttttcaagttccattcagaaatattttctgggccacatgcagtgcctcatgcctgtaatctcagcacttttgggaggccaaggtgggaggatcacttgagcccaggagtttgagactagcctgggcaacatagggagaccccatctttacaaaaataattaaaaatattagcccagcatggtggctcatgcctgtggtcccagctatttgggaggctgaagtggaaggatctcctgagcctgggagggtgaggctgtagtgagctgtaatcataccactgcactccaacctgggtgtcagagcaagactgtctcaaaaaaataaaaacaagaaaaatattttgatgtcctattttagttacttgtgcaataagcaagcttggttctgtttcaaaatagctcagtgccgtgaattattcctgcttttaggtcacagtttcaggtaagggacctggaatgtggcaaacagtaaatgtttacttgactgatatacttggtagcctttctttggtaagagtgtccttttgaagaaccaactcaggccttaccccggagatctactcattttggctttttcctgttgccttcattaatgatttatttgagcactgtgtgctaagcacattatgtagttcatctcaattaattgtcacatgaactttaagagctaggtacagccaggtgtggtggctcacacctgtaacactttgggaggccgaggcgggtagatcacttgaggtcaggagtttgagaccagcctggccagcatggtgaaaccccgtctctactaaaaatagaaaaattagccaggcatcgtagcgtgtgcctgtaatcccagctactcgggaggctgaggcaggagaatcgcttgaacccaggaggcagaggttgcagtgagccgagattgtgccactgcactccagcctgagcgacagagcgagactccatctcaaaaaaaaaaaaaagagagctaggtgctattacctactgttatctccaatttgaagatgaggaaaactgaggctgaaagaggcaaactaacttgtctgagactaggtaaagttaggaggtaaccaggctttgaacacatcctgtagtgttcttgtaacacatcagtagtttcctggttagggtggggaggttgaggcgggaggtgcacacaaagtaaatatgctgtatcaattagcttatgctgtgtaacagattaccctaaaactttgatagctttaaacaacaaacattgattaattcgcatgatcctgtggattagcttttctgggccagttcagcttgggctggaaagtttgggatggtctcactctcgtctgcttgatgctggctgttagctgggatgatgggaccacgtgtctccagcagacaagcctagctaaattacatggtgataattgcagagttcccaggagcaagagagggcaagactcaattgcacaagcacttttttttttttttttttttttgagatggagtcttgctctgtcacctaagctggagtgcagtggcacaatctccgctcactgcaacctccccctcccgggttcaagcgattctcctgcctcagccttccgagtagctgggattacaggcgcctgccaccacgcctggctaatttttgtatttttagtagagatggggtttcaccatgttgggcaggctggtctcaaacttctgacctcaggtgatctgcccacctcggcctcccaaagtgctaggattacaggcatgagccactgcgccctgccagcacaagcactttttaagccttacatctataatctttctataatgacccatcagccaaatccaaattctagagtggagagctagactgtagacttcacctcctgattggaagaactgcaaaatactgtggctcctcccctcccagtaggtctgtattagttgtcttttgttgtgtaacaaattattcccaaacttaatggcttaaaactgtagcaggacaagctgcagataaaacctgtcagacaccaggttaaagaaggaagagactttattcggccaggagcgttggcagagttgtgtctcaagaaccaagctctccaaagaaaaagttcctggcccttttaagggcttataactctaagggggtccacgtgaaagggttgtgatagattgagcaagtgatctataggtaacacatgtggttagggtgggggcgttaatctttaacctcaggcctggtaagtggcatcagttggtcttgccactgacttcattcctgttgtttttcagcttttacttcttccttctcttcagagacagtaagagaaatggcctctctcctcaaaacaacaattaacatttatcatctcacagtttctgtgagttaggaatttgagagcgtcctagctgggtggttctggcttggggtctctcatgagcctgaaatcatatgaaggcttggccagggctggagaagccccggctggcaagtttgtgcaggctcttggcaggaggccccagttccttaacacatggacctctcaatagtactgtttgagtgtcctcatgatacagcagctggttttcagcagaacaagtgatctaagggcaaggtagaaaccaccaatgtcttttatgacctagccacagaagtcccatattgtcaattttgcaacatcccatggtttcacaggtcagccatattcagtgtgtgcgggaacttcataagagtgcagataccaggaggtagaaatcattagaggccaccttagtggctggctaccatgctgccatacatgttaagtggcactgaaaatggctttattctactgtacttaattagtagtttggctgtggatagaattctttcataattgtgaagaaattgctctggttttcttctggctttgataaatacaatgctgttctgaatcctgattctttttatgggttttccccccaccccaccccgttttctggaagcttttaagatcttctcttggtattctagaatgtgatgatttttgttgtgcttttcaatttagaacccctagaacaaagtgtgagcacacaggttaggacctctgcatgcgtggacacaaggcccttccaggcacacagatttagagatatggagagaatggggcagggctagggtcctgttctctgcctctcaccaccttctagtacagaactctgagaggcccaaaaatgtgaatgtggtcttccaggtcattgtgaaggtttatttattgacatagcagaatagattgtcttttatttaatagttcattagggtcatttataactttttaagtatgcattcagctgtattcttgctcctgtcctgcaaatattaggtttggcctgctaggcaaattgcttaacctctctaggtctcagatttttttcttttttctttttatttatttatttttctaggcctcagatttgtcttacataaaatgggaatcataacagtacctatgttgtggagtgctatgacagtaatgtgaaataacacatgaaagtgtttggtataacatctggtccacagggaaaggctattactgtagccgcccccctcccctgcccctgactcggttttgctttctgtggtttcagttacatgcagtcaaccactgtccaaaaatattaaatggaaattttcagaaataaaccatctgtaaattttaaattgcatgctgtcctgagtagcgtgatgaagtcttgtgctgtcccgctctgtccacctggggaacctgaatcgtccctttgtctagtgcctccacgctgtatacactccctgttcgttagtcacttactaagtaagtgccctgttcgttatcggatcgactgccgtgatattgcaatgcttgtgttcaagtcacccttatttgacttaataatggccccaaagtgcaagagtagtcatgctagcaatttggatatggcaaagagaagccataaagttctttctttaaatgaaaaggtaaaagttataataaggaaagaaaaaataaagtgtgctgaggtcgctaagatctgtagtaagaacgaatcttctatctgtgaaattatgaagaaggaaaaagaaatacctgctagttttgctgccacacatgaaactgcaaaagttatgagcacagtgcctgataactgtattacatcatattgctataattgttccattttattattagttgtttaatctcatcgtgcctaatttataaattaaatgtaatcataggtatgtatgtatagaaaaaagcatagtactgtatatatagcgttcagtactatttcagtcatcccctgagggtcttggaacatatcgcccacagataaggggggactgcggataatccccagtttatggtggttcgacttatgactttgtgactttacagtggtgcaaaagtggtaagaattcagcattctcctcgacaagtggacgagcatctactgtgctttcacagcggctatcactattgccagcagcaagactgtcagctcggcgccctcgtctggttggatgggaaactgcagttgctaagggagctgggtttgtaaggagccggccagggttgcagggtggcttagctgtgatttgggagtaatgccttgtgcctctgcttactgtctcctctcttgcactcctatgttgcaggaatctctgaggacaaatgggaattctcactgatttctaggactaccctggggcaggtaagaaaagcatccaagttttttcccattgctccatttataaacttttttttttttttggagatagggtctcactctgccacccaggctggagtgcagtggcacagtcttggctcactgcaacttctgcctcctgggctcaaccagtcctcccacttcagcctcctgagtagctgggactacaggtgcatgccaccatgcccaggtaatttttgtattttttgtagagatggagtttcatcacattgcctaggctggtctcgaaatcctggactcaagtgatctgctggcctcagcctccctaactgctgggactagaggcctgagcgaccacccctggctgtaaacattttcttagctcaaggattgctgaatttgtatccattttcttctctcctatctcaattgggtgggtgaaatgatactgttaattattttctgttacttttgaatgcttctttgtggcgaactgagggcatagtaatactgtagcagctaacaaccatatgggtcccgagggctttactaatgttattttttaattttcctaattgcaggtgttttattattagcttcattttatagatgagaaaactgggcacagagaggctgagttacttgctcaagttcatacaggtggtcagtagtagagctaggatttgaacccggcagtcagcctcgggagttcatgttatttttatttatttattttttgagacaaggtcttgctctgccacgcagactggagtgcagtgtcgtgatctcagctcactgcagccttgacacccccaggcttaagtgatcctcctgcctcagcctcttgagtagctgggactacaggcacacatcaccatgcctggctaatttttgtatattttgtagagacggagttttgccatgttgccgaggctggtctcaaactcctgggatcaaaggatgcgcccctgttagcctcccaaaatgctgggattataggtgtgagctaccgagtctatgttcttttttttttttttttgaggcagagtctcgctctgtcccccaggctggagtgcagtggcgcgatctcagctcactgcaagctccgcctcccgggttcacgccattctcctgcgtcagcctccagagtagctgggactacaggcacccgccaccacgccgggctaattttttctatttttagtagagacggggtttcgccgtgtcagccaggatggtctcgatctcctgacctcgtgatctgcccgcctcaggctcccaaagtgctaggattacaggtgtgagccaccgtgcctggcctgagtccatgttcttaaccacactgaacctcctccaaatattatttaatatttatgatttacgatgtgccaggctgagaccccagagcttaggctcttctccaccatgctgcacttaccagctgtgttaccttggacaagtcattttcctcagagcttaggttataacaacaactgtttactaaatgcccactccgtgattggcgcctggcctaatccatcatcatcatcatcctggctaacatgtcctgagctgtttctgtgtgccaggcactgttctaagcattttaacactgcaaggttgatttattttcccttgtttttttttttttttttttttttgagatggagcctcgctctgtcacccaggctgagtgcagtggcacaatctcagctcactgcaacctccacctcctgggttcaagtgattcttctgcttcagcctcctgagtacctgggactacaggcgcacaccaccatacccagctaattattattattattattttaattaattaattttttttttttgagacagagtctcactctgtcgcccaggctagagtgcagtggcatgatctcggctcactgcaagctccatctcccgggttcacgccattctcctgcctcagcctcccgagtagctgggaccacaggtgcccaccaccacgcccagctaattttttgtatttttattagagacagggttagtagagatggtcttgatctcctgacctcgtgatccgcccaccttggcctcccaaagtgctgggattacaggcgtgagccacagcacccagacttttttttttttttttttttttgtgagatggagtctcactctgtcacctaggctggagtgcagtggcgtaatctcggctcactgcgacttccaccttccaggttcaagcaattctcctgcctcttcctcctgagtaactggaattacaggctcacaccaccacacctggctaatttttgtatttttaataaagacagggtttcaccatgatggtcaggctggtctcgaactcctgacctcgtgacccgccttccttgacctcccaaagtgctgggattacaagcgtgggccaccacgtctggcctaatttttgtatttttagtagataccgggtttcaccatattggccaggctggtctcgagctcctgacctcgtgatccgcctgcctgggcctcccaaagtgctgggattacaggtgtgagccaccacgcccagcctattttcctcatttttagagaaagaaactgagagattaagtgacatgctcaagtccacatggctagaaagtgtggggtttgaagccaagtctgacgtctgactccacagcctgtgcccttagctgcccttctctgagccttgtggattacctagagcccaggctgtcatgattacctttggaggtttttttgttttttttggtcagcatacatttttctctggatttttagttttttccaataagttttgggggaacaggtggtgtttggttacatgaataagttctttagtggtgatctctgaggttttggtgcacccaacctttggaatctttaatgctgttagcaaatattcccaattctctgcatccaggaacatggatggattgtgcttccttgaccccatgaattaaggtgcagccaatgcaatatgatggcaatgatagatgtcacttctagacaaaacttaacagttatatcaatattgtaattaatattattttttattattataattaatgttaataatatattaatattctctacttgcctcgaagatcttacaagcatgggaatggcacctcccttagcctgggcccctgagtgaggatgacataaagcagatccctgtcagactcacaatggacaggcggtgagacctctgttgttgcaagccactgagatttgagggttgttgctgcaacagaaccatgtccaaggcttctcaaccttggctctatttacattttcggccagataattctttgttgggggaggggcgctgtcttgtgcattgtagcatggatagcagcatccgtggcctctgcccactagatgcccatagctccccaacaacagcgacaaccaaaatgtctccagatgttgccaagtgtcatactgggaacaaagtcacctctagttgagaactactgctgagcctattcctttttcctttttttttttttttttttttttgagacagggtctcactttgtcacccaggctggagctttgtcactcagtgcaaactttgcttcccaggttcaagagattttcccacctcagcctcccaagtagctgggactgcaggcatacgccaccacacctggctaatttttgtatattttggtagagacggagtttcaccatgttggcaggctggtcacaaactcctgacctcaagtgatccacctgcctcacctccaaagttctgggattacaggcatgagccaccgcacctggccggccattttctttaaatccagaagaggtggcaacactgggccctgtcttcaacccggaagcaataaagtggagctgtgtgaatagctccattttctttctgttcccatcacagcctgctgtcacataccaaacccctggtatttgagtttgtggccgtaagaaattaggtggtcttcctttttagtggttgttagaagctgcagtttaagggacccgaaaaaattagaatggggccccaaaacagaaaagtcaaactaactctgaggaagcaggcactaagatttcatttatcaggaaggacttgttgacctcaaaatagttcttagcttgtgaccctgaagtttgaattcccatcagtaaaaaacaaaacctttttctttcattccacatttagagggaaagaaggagggacactaaaatgtggctccccttctgtcattgaatccttataagaattcctgcagagtgtcataattcccattttaccaatgaggaaactgaggctcagagaggtgtgggagtggtggaggcaggatttgaacctgggtctcatcccaaaggtcatgcatgctttttccactacactagacattcccaaaccaggccgctcatcgagttcattgggggaagcctacaaaagcgtacctgtttccagatcctacctttgacctattcaaccatatttcttcagtagggcccagaaacctgtactttaaagaattatttgtggccgggcgccgtggctcacgcctgtaatcccagcactcttggaggccgaggtgggtggatcacgaggtcaggagatcaagaccatcctggctaacacggtgaaactccgtctctactaaaaatacaaaaaattagccgagcgtggtggcgagagcctgtagtcccaactactcgggaggctgaggcaggagaatggcgtgaaccgggaggtggagcttgcagtgagcggagatcgcgccactgcactccagccctggtgacagagtgagactccgtctcaaaaaaaaaaaaaaaaaaaaaaaaaaaagccaggcgcggtggctcacgcctgtaatcccagcactttgggaggccgaggcgggcagatcacgaggtcaagagatcgagaccatcctggccaacatggtaaaaccccgtgtctaccaaaaatacagaaattagctgggcatggtggcgcacactcgtagtcccagcttctcgggagcctgaggcaggagaattgcttgaatccgggaagcggaggttgcagtgagccaagatcgcgccactgcactccagcctgccaatagagcaagactttgtctcaaaaaaaaaaaaaaaaaaaagaattatttgtgcagttatttgataactgtctccctactagatgaaagcttcatgagggcaagggccatgtctcttttttttttttttttttttttgagacggagttttgctcttgtccagactggagtgcagtggcacaatttcggctcaccgcaacctccacctcctgggttcaagcgattctcctgcctcagcctcccaagtagctgggattacaggcatgcaccaccacgcccagctaattttgtatttttagtaaagacggagtttctccatgtgggtcaggctggtctcgaactcctggcctcaggtgattcatctgccttgacctcccaaagtgctgggattacaggcatgagccaccatgcctggccttttttttttttttcttttttcttttttgagacagggtcttgctctttcacccgggctggtgcgcagtgggatgatcttggctcactgcagcctcaacctccccgagttcaagcaatcctcccacctcagcctcctgagtagctagaactacaggttcatgccaccatgcccaactaatattttattttattttgttttatttttattttattttgaatggcatgatcttggctcacttcaacctccacctcccaggttcaaggtattctcctgcttcagcctcccgagtagctgggattataggcatgtgccaccacacccggctaattttgtatttttagtagagatggggtttctccatgttggtcaggctggtcttgatctcctgacctcaggtgatctgcccgcctcagcctcccaaagtgctgggattacaggcatgagccaccgcgcctggcctaatattttatttttttagagacaagatctcactatgttgcccaggctagtttcaacctcctggactcaagtaatctctcaccttggccccccaaagtgctgggattacagctgtgagccactgtccccagcctgccatgtctgacttagtcagtgacacagagtgggaagcaatgcaagtatttgcttactactaaatcaacaagcttcctagtcctgacctagggacctgctgtgaagagctattccactgtggcaaattctctggagcagttctcaaacttcagtgtacattttaagaattgcttagtgtcggccgggcgtggtggctcatgactgtaatcccagcactttgggaggcagaggcgggtggatcatttgaggtcaggagttcaagactagcctggccaacatggtgaaaccccgtctctactaaaaatacaaaaattagccgggttgtagtgatgcatgcctataatcccagctacttgggagactgaggcaggagaatcgcttgagcctgggaggcggaggttgcagtgagctgagatcacgccactgcactccagtctggggaacagagcaagactccatccccccaaaaaaaaaatgcttagtgtcaggccaggcacaatggctcatgcctgtaatcccagcactttgggaggtcgaggcaggtggatctcacctgatctcacctgaggtcaggagttcaagaccagcctagccaacatggtgaaacccatctctactaaaaatacaaaagttggtggtgcacgcctgtagtcccagctactagggaggctgaagcaggagaatcacatgaacccgggaggcagaggttgcagtgagccgagagtgatcaagctactgcattccagcctgggtgacagagtgagacttcacctcaaaaaaaaaaaaaaaaaaaaaaaaaaaaaaaaaaaaaaaaaaaaaatcgcttagtgtctcagtcatttcaggctactgtaacaacttaccatagactgactggcttaggcaacaaacatttacttctcacagttccagaggctggaagtccaagatcaaggcgctggccaattctgtgtctggtgagggccctcttcttggtttgcagactgccgtcctctcatttcctcacatggtggagaacaaggagcaagagcaactctcatttctcttatgagggagaatcctattcatgaagcctctacccacgtgacctaattacctccaaaggcctatctaatactgtcacactgggtcttaggatttcagcataggcattttggggggacacaaacatttagtccataacacttgagttgcatctttttaaatgcatattctgaggccccaacccaagactctgtgcttgagaaacagatacagtgatataaaattttgatggctggaactttccttagtctttgaaaagagttgagacaatagacatcatagagaagttcagggggccgggcgaggtgcctcatgcctgtaatccctgcactttggaggccaaggtagagtgattaagctcaagagttcaagaccagcctgggcaacacggcaaaactccatctcccaaaaaaataccaaaaaattatctgggagtggtggtgcacatctgtagtcacagctacttgggaggctgaggtgggaggaatacttgagcctgggaggttgacgctgcagtgagccaagatcccaccgctgcactccagcctgggtgacagagtgagactgtctcaaaaagagtgagagaaagaagttcaggggcctctgaagacaaactgtttcaccatttagcaaataaccaggaagagatgaaagtggatgagaaaccctgtgatgggggcatctgtcaagttgataagccaggtaggattctgctgggcatcagttacatgaagcagacaaaagatatcattcttagaaatgactgttgaacttgaggataaagaatttttaggctgggcacggtggctcacacctgtaatcccagcactttgggaggccaaagcgggcagatggcttgaggttgggagttgcagaccagcctggccaacgtggtgaaaccctgtctctactaaaaatataaaaattagctgggcgtggtggcacatgtctgtaatcccagctactcgcgaggctgaggctgcagtgagccgagatcgtgcaactgcacaccagcctgggcaacagagcgagactccatcacaaaaaaagaatttaaaaaaaaaaaacagaaacgactctggccttggctcaggcatcttttgttttggaggtcagctttgcttcagaggccaaattgggtatgcatgtcagtgtatgagatggtaaatgtgactgagagcatgtgttttggagtcaggccaatacatagcaccactgctcactgattctgtgaacttaggcaagttcttcatctctctgtgcttcggtttttctcattttcattaaaacaattttttaaaatttatttctacagacactatggtgacttaagttctcatttttattttttaatcccctggatttaccaggattaagttgtcatttttaaaatggggccatgactgtttacctcacaggatcattgtgataacagaggcagtgtacagaagaaggaatggtggcacctagtaggtgcataatcaataaagtcagttactcctccctaactgttaagtgtcagagtctattactccatatcctaaggtctaatacaggtcctggctcagcaaatgtttaattaatcgataaaggacagatttgtatgtttgatggaaggtccaatccacttgctgtatgcagggttgaagccaaatccatggctccattagcaagtgctaaagctcctgcaggtcagccagagccaccacagcaggttctcattaagtctttgctggcacgactttcctgcattcatgttccttctgtactcattagaacgcccgtgtaagctgagacctactggtccctcacagcccgtggaaactgaaaggcagagtggcacaaaccttgcagttagagaatcacggtgtcaaatccttccttttgccactttattagctacgcaacttggccatgttaatttcactcctttcccccccctccccgtttgttttttatttttttggagacagggtcttgctctgtcgcccatgctggactgcagtggcaatcatggcttattgcagcctcaacctcctgggctcaagccatcctcccacctctacctcccgagtggctgggaccaaaggtgtgtgccaccacacccagctagttttgtatcttttgtagagatagagttttgccatgttgccaaggctggtctcaaactcttgaactccagcaatccaccctccttggcctcccaaagtgttgggattacaggcatgagccacagtccctcctaaccccctacccctgttttttttttgagacaaaaaaagagatggggttttgccatgttgcccaggctggtcttgctctgtcacctagactggagtgcagtagcataatcacagctcactgtagcctcgacctcccaagctcaagtgatcctcccacctcagcctttcacatagctgggactataggtgcaccatcacacctggctaatttttaatctttttctagagacagggtctcaatatgttgctcaggctggtcttgaactcttgggctcaagcaatcctgcctccgcccttcagtgttgggattacagatatgaaccaccatgcccggccccatttcacccctttgaaccagtttctaattttaagatggggttaccagggttccaagtataataagggacagtgcctgttccccacaaatgctgagttcccgccctttgctcacagaattctttccgtctgaaattcctcttactactaaattcggcatcgtttaaggcccagcccaaggatgctgattaagatctctgccttaggagggtgcggtgagctgagattgcctcctccatctcaaaaaaaaaaacaaaaaaaaaaactctgccttaaacagtccaagaatcaggcattttctaacttctttccactgatgctataagtaaggaagacacagtatatggagtttgttttttatttagacatggaattttccttttcatataacttatctaattaaaatattcatctcggtagttaccacaaaaaagtaacatagaaaattgtatttacattttgggaccaaaatacaaatgaagagcaggatgacaccttgctcctttccctcccgcttcccagaaagaaaaagccccaaagaaactgctcagtacaccaaggatcacaaaagggtaatttgtaatttggtgatttgtatgtagtgtagcacagaaaaaaaattgcacaagtttttccataaatgagaccaaaggttcaaattcatcctgtgtcaggttcaaattcatcctgtgtctgctctgcagccattttagtaagctgggcaaggaggtcatttagaaattgggtttttcctctttcccctgactcttcgcaccaagtcacatccctgatgtagatactcttgggggaggggaaaacatctggctctatgcaaacagggctcatcaaaaatctttatgtgccaaaatggatactgacattgctatgaacaaatctgttttttcttccctccctgcctaaagactcctaataagggacattaaatcatacacaactgaatctaagatatgaaaaactagtttcaatgacaaagacttgaacacacagttaagagataaattcaaggtggtagacacctagaaaaagctattctaggcagcagacatctggcacctgacccaaatgttcatttggtttcagttaagaggcttcctaatattagatttgtggggcaggctagggataggggtggaatggtggtacaagtaaccaagagaagtaaagtaatgctttacccattcaaaaatatagcaaattaaaacatagtaacatttgtgtcctgtcacaataggcaccctgcacagcaatacacactgaacaatgtcgagtttctgctgaatagacttcctacgttgctctggaattcgaagttggcctaactgaggtctccagttacagaaaacactggctctgtatcctgggctttgagaaaacttatcaggctgtcacacttaccatcccttcagtctgcttgtcaggttccttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaattttcaatcagaaactggaaattgtaaaagtgggaggtggggagttctgtgcaaatcaatctcccaaggttctgcgtcctctagtgagcctcaaagaaaaaaaaaaaaacaaaaaggtggggactcgcaaaaaggatgagggaaaggctccagacctacagagcacctcccttaataaataccagttagtaagaaagagatgcacctgcacaggaatgcacagcaacagtggggagggcctgaggtggagtccgccgagcaccctgtcgccccactgaggctcccttggggacaggcggtctagtgctcattccttgccctacgtgcagcaggtactgtgcaggctctggagatgcccagtcctctgtctggaccagagtccacacagagctgagctggggcaggagactggctttcactaggctttcatctgattttaataaggacctggaagataaaaggctaaatgtgtggtagaggacaaaaaacaaaaacaaacctgggggataatataaatacaatctgggggcaatatttattaattaaaactacgtcttatagtttacaaagatgctaatgaacaacaaaagtataattgacctttaaaatcctcagtgagacagaggcttcacatcttcagaattctaaagtgtgctccaggcagggaggcggggctgtggcacgcaggttcccaggggcagcacctgcagactgcaggactcggagaccaaaaggatccacaaagcaagactccagtctcctgtagaattccattccccaacccccactgtccttgtattcctgcctccccagattccatttccaaggcaagtcctcagtttatcgtcgggagaatctgttcttgaaagctttaattgtcttggccatcattggggcaatttctgtgaaaagagaaacaaggcagctgtctcagatctgtggcggcttagacacacccccagtagtttacagtcaaagccagctctgctattcttggctgtgcaccaccaggcagagatacaagtagtaactatctcctctgttcacaatgcaataaaagcaacagcacagagcagacactttcggaggacctgccaggggcatgaccaccactctctctaaccacctgcaccaaggctcagagagcctggccaacttgcccatggttgtacagtaaggtacagaattacaattcaatctctgtcagactttcttgtttttatttttgtaaggaaagagtctcactctgtcaccctggctagggtgcattggcacaatcacagcacactgtagcctctacctcctagactccagagtagctgagactacaggagtgtgccaccatgcctggctaatttttttttattttctgtagagtcagggtctcactatgttgctcaggctggtctcgatctcctgggctcaagcaccctcctaccccagcctcccaaagtgctgggattacaggtgtgtgtgaaccactgtgccccggcccttgccagactctaaaggccatactcagtcataacttaactttgcctcacaaatagccaaaccagtaaacagcacgtctacccccaatctgtccagtgtagaaacaggtctaaggtggctatgcaagtactgcctaaggaaggccagcctgcctcctgaatggttcatctgagcatagctgtagctcaagccaggactcccaccctcccatgggccctgcaattaatacagaataagacttaagttaggacatccccttaggatactggggatagtctatggtaataaagttaacaaaatacaaaatagacgcaactagatataaagaataaatatttggaagacccggccaggcatggtggttcacgctggtaatcccaggactttgggaggctgaggcgggcgaatcacaaggtcaggggttcgagaccagcctggccaacatggtgaaaccccgtgtctactaaaaatacaaaaaattagctgggcttagtggcgggcacctgtaatcccagctacttgggaggctga

SEQ ID NO: 5252 - DNA, 2590 bp, Homo sapiens
cttctcctcgatgtccacgagcttggtgatgaagtccttcagctgcgccacgccctggcgcacggtgggctgcagcggctccatccaagcctccttggccctggaagccggcgtgtccatgttgcccacgttctggactgcctggaggtgacagcaggaaggaccaggttctgctaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctggcagccccctccccttaggctccgtccctgaccctcgccgggacacagcctccctggtcctccccagcgctccctggttccccaccgctcttcgcccgcccctcgccccagcccagtccaacccggcccagcctagcccagcgggtggagggcgcacctcgtgctgggcgccggggaagcgctcgcgcacgcgccggaagagctggcggaaggtggcgcgcaccacggcggggcacgcgggaaccgagcggctgagcgcgctcagcagggcccccaggtgggcgcgcagcgtctgcgcgctctgctccagcacctcggcctcggtctgcgggcggtgcagcccggaacacctgcgtggaacggggcgggttggcagaggaggtcacggtcagcgccagggccacgacaggaacagtggctctcacagcagccgggacacggacacaggggacaatacacgggtgggcagaagcacaaacacacatgctgacagggcctgatcccaacccgctgccgctgcgccccgcacccccccggagttacccccggcctcaccctacatccttaacttccactttgctggggtccagctccacgtacttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcaccgtttgcctgccgtatccgcccaggagggggacaggtacacaagcagggcaaactgtttattcatgaatgaatgaatgagtgagtgaatgaatgactagaattcttagcccttgtaatcctagcactttgggaggccgaggcaggaggatcacttgaggccaggagtttgagaccagcctgggcaacatagtgagactgtctctaacttaaattttaatcacacacacattcttttggggggggggggtgcggggcacggagtctagcacggggcccaggctagagtgcagtggcgtgagctcactacaatctctggcttctggttcaagtgagtctcctgcctcagcctccccagtagctgggatcacaggtgcccaccaccatgccaggctaatttttgtatttttagtagagatggggtttcgccatgttggccaggctggtctcgaactcctgaccttaagtgatccgcccgcctcagcctcccaaagtgctggaattacaggcatgagccactatgcccagccacattcttaaccttaaagggctctcaatatggagatagaacactggagtcgaagtcccagccccctctgtcgctctctctgaagctcagtgttgtcatttgcaagatgaggacaatatagcatgcaacctcaccttcagaaaagactccatggactttgaggccagagagttgctccggaacagggtgttggtcttttgttacttggtcataagtaggcgttttccttttgatttggttctaggaggttagtgtgcattggcgttctgttgcctgcttccagcccctattctcctgcctcaggttcattagaaaagactgagtttggggccgggcagggtggctcacacctgtaatcccagtactttgggaggccaaggtgggcagatcacgaggtcaagagatcgagaccatcctggccaacatggtgaaaccctatctctactaaaaatacaaaaattatctgggcatggtggcacgtgcctgtagtcccagctactcaggaggctgaggcaggagaattacttgaacttgggaggcagaggtttcagtgagccgagttcgtggtcactgcactccagcctggctacagagtgagattccatctc

SEQ ID NO: 5253 - DNA, 3413 bp, Homo sapiens
ttgccccatccctcccctgccgattccctttccccctgaggaagccctctgggagtgatcctgagggcctctgatgcacggagcccttttccgcctgcatggacaggctgggcaccggcagagacgcccacctgccctgacctgcctctgtggcctcacccgagaaggtgctgacagagtcctttctgcggaggtcaaagcacttcatgaagccatcctgggagccactgagcagcacgtgggcttcggtggggtggaagcagactttgtttaccgtgcgcttgtgttctgtgaacagctggtcctgcttgttgcgggatggccggcccaggttccacgtgaccaccacgccattggtggctgctgtggccagcaggttctcatccatctggtgccagaccacgtcagcacagctcaggttaagcgaaggcttgcgccccacacgcaggttcagcttttccacgaactgttcctcctcgatggcatagatcttgaagatgctacggcctgccacgaccacctgggctgcgtcgcggcacacactgatggcattggcgggagcatccaggtggcagtgcatggtgcggcctgtcagcacgctgccacccagggctgtggtcacacgggacatcttctccatggctgcacaggtgatgaggtcaggggtcaggaggtcagtgaggtgggctggcctggtcagcctgggtgggtcatcagttcagaccttccacccaggttgggaccccagaactgcttggtcccgggctggtcagtcttagtgagccaatccagggctgtctatcagccaatcagcctgacaggcaagctcaaattcactggagtctgtcagtccagcccatcaccctggctgagcggtgaggggacttcctagcttcccttaggcctgtcagtttcatgtctgacttccacggaagactctagctggacattcccggcccaggccacctctcggtacccccatcagccagatctgggcagtcactaaacgctcggtcagtcaatcccagcaggggagcgaggagactcccgccgtccacactgtcagccctgagggcggcggggctctagggaggaacaaaagaggggagggaacagagggctagaggggcccggggactcaggcgatagacgcgggaagggcccagagggacgtcaaggaccgagctacttaaggagctcgaggtgtctggcgggaccggaggcaggagagaagccggcgaccccggagtacagggttcctgggagcggcgcagtggcgcgggggagcggacgctgcgggacgagaaccagagggcccggggcagcccttctcccccgcgcgaaccccaatcttttactaaaagcgcacggttgtccggaaccgccgcgccggaagccgctgtctttcccgtccctcgccggaagtggtcctcttcttacccatccctctcaggaagtgggcacaaactctcgcccgacaccacgaaagttccgggtcagggagctgcgttggcagaggccaggaggggcccgggattggggtctgcgggccgccctgggcgttgccattgcgctgcggtgctgtgcttgtgtgattggtttatttatttatttatttaaacggagtctcgctctgtcgcccaggctggagtacagtggcgcgaccttggctcattgcaacctccacctcccaggttcaagcgattctcccgcctcagcctcccaagtagctggcactacaggcgcccgccaccacgcccggctaatttggctaattttgtatttttggtagacacggggtttcaccgtgttggccaggctggtcttaaaactactgaactcaagcgatcctctggcgtcagcctcctgaagtgctgggaatgcaggtgtgagccaccgcgcctggcctgttttttaagtctcaatttcagtattttaatgccatcacctattttaatccccaggtccatcatgacatctggtcatccctagacaagttccgagtgcccccagtcttcccctccttcctcactcctcgacctcgggagcagcctcccaacggctttcctgggtccgtctttcccctttgatcagaaacccgcacagaagtcaggcaccaggtcttctgcctgaggcctctggcagctcccactatgctgtgaatgaaccccaactcctggcctccgccttcccctgcccacctccagccatggcagcctccacccccattcccagcccaccaagccctttcctgcctcagggacattgtacgtgcgtgcgatgcctcctccacagagcggacctccctgaccactgccctaatgggcttctccatcactgtggcctccacggcacttgtcaccacccattcgtttgtttactggttgttgtcggtcacatacgagtgtgaattccaccaaggcaggaatcacattctggctcaatccccaccgaatgcccagtgcctgacacacctgttcaaccagttgctctcgttcttttttttaaaaaactttttgagacggagtttcgctcttgttgcccaggctggagtgcaatggtgcaatcttggctcaccgcaacctccgcctcctgggttcaagcgattctcctgcctcagcttcccgagtagctgggattacaggcatgggccaccatactgggctaattttgtatttttagtagagatggagtttttccatgttggtcaggctggtctcgaactcccaacctcaggtgatccactcgccttggcctcccaaagtgctaggattacaggtgtgagccaccgcacccggtctctttaaaattttttgagacggagttttgctctttcgcccaggttggagtgaggtggcgcagtctcggctcatagcaacctccaccccctaggttcaagcgattcagcctcagcctccctagtagctgggattataggcaaccaccaccacaccctgttaattttttgtatttttagtagagacagggtttcaccatgttggccaggctggtcttgaacgcctgacctcaggtgatccacccgcttcggcctaagtgctaggattacaggcgtgagccactgtgcccagcctcagttgcctttttcgacctctctgtctctcctgggtgtgagccattgtctgctattggtgcattttgtaatcttttgcgacatccttgtccttgcctgttactgtgtatagaacagggtttatttctgcctctctggaagggtgggctagagtctggatatgttggagggaatattatgtgtagtgacttcagtgttgtctctccctttaaggaatgggaggtcctctgccttccatgtagtcactgctgtttccattctaccatgtcggcatccagcctctacccctttgttgcaagaaagaataaatctgataagaggt

SEQ ID NO: 5254 - DNA, 1469 bp, Homo sapiens
ccaccttggaaaatttctctggcactagaggaaagaaactcagcttctggtttcccccctcagtccccgagcctctgcccacattgtggctctgcatccttttctagaggatctgcgtgctatttaaaatgctttgtcataaagcagaactcttccctcctttctgtcactctgtaggaggggagaggagtccctccctccattttgactctgaagttttctgacttgcactatgccagcctttctacccaattgcccaagcatttctcagctaaagtgatccttagtagcttgaattcttgtcacaatgtgttcaggctgctataacaaaataccataggctgggtggtttataaacaaaggaaatttatttcttagagttctggaggctgttcggaagtctaaggtcaggaatgcagtaggttcggtgtctggtgagtgtctgcttcgtggttcatagatggctgtcttcttgctgcacagtcacttggcagaaagggtgaggggttctctctctggggccactaatccctttcatgagggctccctccccctcatgacttcattgagagtccctgtggacctaactgtgcattgctggtgtcatggaaagactgtgggctctgaagatggacagtcttgctcaagtcctgagtctactaattactggctttgtgtcttccagcaaatgatttaatctccagtctcagtttcctcaactataaaatggagattatactacctattgtttatacgaagcttgcacatagtggataatcagcaaatattaaaaatcctctgctctctctcattctacaattccttgagaagttgaagcacagtgggagaagaaataagctcccacccaagcttttgctcatctgtgaggagtcggtctgtggtatcgtcagaggagtgtgaaaggaggaattttcttgagacattctccatgtagtctccatctttcagactacgatcatgtaaaggaagccaagggttttcacatacaccatcaccactccacacatcacctaccgttcttgtcttgaaaggttgatgtgtgttgcccagtggatgttgagccaatcagagatagaaggagaaaccttaggcaaccacctcttttttccctcactacttatatgggatgagatctgcgagcatcccagaacaaacctcgaagtgtaaacagtattttgtacatccagagagaagggtttcaagatagctgactagcgacacctggcacttctgcacaaagaaggaccaaaactgaacaatcacataacaagtggagcttctaagagaacaatggaattcatcagagaagtgacagggaacatctgaggcttggaaggagagggaagcaaagcagctggtccccccagtgcagagagaaggtaagcaagagatcttcagcagtctacattgccacactgactcttacagtcctagccacaggagagccc

SEQ ID NO: 5255 - DNA, 867 bp, Homo sapiens
tcaaagagatattccgccaagctagattcgggtgctcccatcttgcacaagttggtcatgtggtcacccaattctttgatggctttgacctgctcattcagcccgctctcccagtcatcacagtccggtttcttgatatcctgaaggaagattcggccacctccttggttctgcagcttcatcagtttctcagcatgttccctctcctcatgagattggtgaagaaagtatttggcaaagttcttcaaagccacatcatcgcggtcaaagtagtaagacatggacaggtaaacgcaggaggcgtagagctccaggttgatctggcggttgatggcggcctttagtcctggtggtagtcctggcgcacctgtgaggtggacgcggtcgtcatggcggcgactaaggagaggcggctgcgttcgcggtggtgactgcgcagtgctggagcggcggcgggggccttggggcagtccgagggcgcggtgaggaggtgacggagggctggctatgggcagccggccggtgtgggggacgagcgccaggttctgtccaagcactgttgaagcaggaaaccccgacgactctcgtggaagaacgtccatctctctacttttaagctaagttgaagcagtctgttatcctcactgatactcacttccatcaccactattttccccactgtgaaatgactaaaataccatccaccactcctgctctgagaattaaaagataacctacacagagcctggcacataggaagcattcagtgaactttttttccttttccttctcttgtccttaaaaatatacaacatgaaattaaataggatgtagtcacactattgaaataaattttcttgtagcaaa

SEQ ID NO: 5256 - DNA, 2019 bp, Homo sapiens
gcgtgaacccaggaggcggagcttgcagtgagctgatatcgtgtcactgcactccagcctgggcaacagagcaagactccgtctcaaaaataaataaataaataaataaataatggtatgtgggctgggtgcagtggctcacacctgtaattccagtgtgatttgggaggccaaagtgggaggatcacttgagtctaggagtttgagaccagccctggcaacacagcaacagcctacctctataggaaacaaacgaacgaacaaacaaaaaagtcttaaaattggtgttgtctgagattcgatggaatacaacagatgcccgacctgggctctttttatttctccatcaccaaaggaactcagagtaaaaatgctgagagaggtgcagggccgcccacgtagacgctggacggagggatgtcgctctccacctgccgacttttggcagaagcaccctcccgtcacgtgcaaagctgacgtgtttctgaaatgatgctctttcccagatctgtgcaggctccaggctctcccctgcttggcagccacacaagggcgtactccttttcctgctgtcttcaggagttcatgcccattctgcagctgagctggacatggggcgagttgattagggcagaggggcgcaggtcccagctcatttgtccatcctggttgccagagagcaggctcctctgtttcaaaaaccttccatcaacagattgcagcagcaggaggtccccactcatcaggactgcctgactttttcttttccttctctctttttttttttttttttaagagacagggcctcactctgtcacccaggctggagtgcagtggtgtgctcacagctcactgcagcctcaaactcccaggctgaagtgatcttcccacttcagcttcccaagtagctgggacttacaggtgcacaccaccatgcctgcctaatttttttataaaatgttttgtagagatggggtctcgctatgttgaccaggctggtcttgaactcctaggcgcaggtgatcctcctgccctggcctcccaaagctctgggattacaggtgtgagtgactgtgcctggcctccctgcctttcttatacgcattacgtttaaggctctggaaaggcaccaaaaggtctgttactcccaagagcagcctgtcgtgccagcctgagctcggcgatgcccagatgaccagcaccctgcagagtagggtggcagagcccagagtgcacggagggcgtggaacgcatagtgacttgcagcctcatcgtggagcgcacagtgactcggcctccatcgtggtatgagaaaaggactgcctcacggtctcgtgggaaagcagactcctggccagtgccctctagccaacaggatgggcggatgcgcaggccacagagtccctggttggtgaggaagctgccaatcctggtcatctcttggagccgggcgggggtcagagtgtggctggagcacgattcacagcctcccaaaggtggaaagcaccaagcaggggcccattagggcaaacaggtgagcacaacgtggtctgtccatgcaacgggcactactcagcagtgaaaagccaggaggcactgacacgctgcagctgggatggaccttgaagatgtgatgcaacgttaaagaagccaggcagaaaaggcccattgctgtgaaacgtctggaacaggcaaatctacagagacagagcatggatttgtggttgcctggggctggggacgaggggcagacaaagcgactgctcatgggcacggggtttccttttgggggtgaagacgatgtgactgtcaacaccgagcatgctaagacccactggactgtacaccgtaagtgaatgaattacacagtgtggaaatcacatctcaatagagctactgaacagcacagaccttgctcagagttagggctgctgttctgggtgggacctgcgttcaagtccgagctctcaccgtcatctcaccctccctgacctcagttttttttttgagacagagtcc

SEQ ID NO: 5257 - DNA, 3733 bp, Homo sapiens
gcaggtggtgaagatataattaaacaggtaattaaacaagcaataaagacgggtcatttggggtagaatcagtgtttttctgctgtatcaaggaaccagtttcccatctttcagggacatggttttctggctgagctggcccagggcaagcaggcagtcatcctgcatttatctccttctagaaagttctggattttactgggactgtgcgctactccctgttcctcagaatcccagggtttttccaagttgccataggggctctccaaatatttcacttgatactgaattttacaatgtttatagctattgaaacacttgtaattaaacacataaccaaatgtattctgtggaaactccccttgttaaaagacattgaactgagggaggcttacccttaggcagattgtctcagcagacatgtagtaaagatgtacagatcaggagaacacagaaacgcctgccctgtcggggaagcttcgaagccagacctggagaggccggctgccagcgacaggcctctgcattcaacctgactttgcatccgtcctggggctggctccttcccaccgcgggcctgggcgtttccatgtgctgccaccgaggtgtgtaggtgctaggggtgtgctcactgcacacagacgtgcataccgcgggcgtcctggggtgtcgggcatgccctgctgtgctgtgggagccggagtgtgttagcggaaagcggcattttcacagggctcagagttgaagacacacctgtcttcctgacgtgtggactcgggtccctagtgtgattactgcgttgagcagatgctgaagtagcaccctgcccggtgctgacctcctggtgacaacgccactacccccagtggacagcgaggaagcagggtcagccactggcccggctgtgcagcgattgtccgtaggccctggagttcagccctgcccttcattcacgccactgtgcagcctgcgtatcctggacacccggttcacatctgggcagcggcgttctcgggccgtgacggctcctgggaggaccgaggctgcccgaggtggtcggggatgcctgacactgacactgagcttcccctcagcacagatgtcactcccaggaatggctgaaatctggacgagtaaaagcttatgtgacaggagtttccggcctaagcagcgggacctgggtgccatgttcttggtgtgtaggggcagtgccggccgcccatgggtgccggtgcctcctgcagtcaggcctgctgctgtctgtgtgcgcaataaggaaaccgaacccaagagtgggcaccatgcccaggctcaccggaacagagggcagagcagcctggccagaatccctcactgttttatggcaggaacccccagggtcgtgcgtcgacgttgtggcccggcgttccctgcggaagattgaggccctcactggtcaaccctgcagtacgggggcgtgtgtggcaaacagctggtctggagcctcgtcagccaggccggctccttgatgctttgaaatccccctcccagggggcctggccaggtccgtccatgggcggccacaggcagctggggctggactcctggaatttccagcagccctgtgtctgttacagcgccagtggtagagctggattccctgacaagacgggggaaggacagccttgcaggtgctactgaagacaccctaggctagagctgcccaccctgggtgggttctcctggactgaactgacgttggtttgctattgatgagagtcacatagtatatgtacacaatgcattttaactgcctcagaattaaggtgttatctggaaacagtgtaattacagttggtcagaattgggttgatagcagttcactgcagagaactttctggaagctgtgacaggtggaagtagtggggctcagggttggtgggccacaccttagctgtgtggccttggccaagttgctcatcaagaccttcctgtcactgatgaggtgagagtgaccgctgggccgtcctgaggctgacatgggattccttgcctgtgcacacttcccagaaggcggaccaaggacacacccgcctgggagacggctcgcaggcagccacggagtatatatatctgaacgtcggaaaggacctttcctttgaagctcaaacatttatgagatattgttacaattcggaagggatctgtaggtgaaatgtgacatgaagactgggtaacgttggcatttgcagactgactttatgtgtggcacttttcgtgggtgccatggcgtcggcgcagagacactcctgagggatttcgtctgtcggtccatgtgtttgtgggggccgagtcctggacaggcctaggagggaaccgccccggccagggccggctgctcggcgcctgcacagggcatgagtgctgggggctttgggacacacgctccctgctgcctctggggcagatgtccacctgcactgcttgcagtgagaggctggggccccagtggacgagccgtggtgcctgaactgctcccgctgtgtccccgccacgtgaggcatctcttcctgaccgtggtcctgagaccacctggcctctgccttcccagggttaactgtacttgttctctccgtggctgccgacacccttctggccttcagacttagccctcatcactcgtggactcctgaccccacccagggctgaccaccggagccctgctctctgcttcctttgcggctgatattgtccccattccagtgttgttcttgtgcctgtctcccctctagctccttgcagtcagggagaggactttctttatacctctatcccttgtcttctaggggcatctcctgctcagtgaaatgtgctgacccgtagcaggtggtctctaccagggcttagtgtcagcatgggacacttttccagccattaccccttctttcccctctacccacctccagccccgaggtgcggcccagcaggacagatactgccacagccctcccttggttgtgttcatacttcctgggctgctcatgccttcctgtttgctggtggattctctttttgctggagtgtatccccaagcagcttttccagaaaggaccaacttgcccggatctctaattctccatcaaagccactttccctcagagctttgcagcattgaggaggcatcttcaagcatctgactcttcttctccctggaagcttctaaagtctcagtgccttgccctcctgctctccacctttgctctctgttctggttatttatcgaggagtctctgaggctcttttttttgctctcttgtagtggccttggtgagctcttcagcctcaaggcttgtccttggctctggatgaggctcttctggcctctccccaatctgcccatgtgttccaaacaccgcatgccccagctgggttccaaacagggcgggtgggggccactctcctgtctagcttcgtagcgtgggctgaaacctgggaaagtctctccatgaagctgaatggagaagaacatggcttccgcgaggccctaggagccaagcaccacacagaacccaccgcttggctgtgatcccgagtgacggggacagcctggactgcagaaggaatgcccaacgctggcgggaacggaggggcttttcttgctcgtctttccagttccacattgtcacattggagtcctgggctcactgagattatgttgaaaatccgacctctaggggatctccatgctagtttt

SEQ ID NO: 5258 - DNA, 2326 bp, Homo sapiens
tcctggtgacatgcaagagtggggttcctaggcaagaatgggggtctagaggcttcagggccagctcaccgcagctgaaaaggccagggccccaacaccccgctcgaaggcccccagtccaatctcctgcagtttcaacagcgtctctgagtcccagatgtgaaccacaggctgcaggggctggtggaggaagagtcacaagtgtgaagcaaaattggagtgcaattccagcatgtctgcctgctccctgactttggccttacctttccatccttatccactccagctgtctgtcccgaggctacccgaacaccatcagggtgaacagcaaggctaaggcagggggaagacactctagggaaagggtctctcaagaccatccaagacaccttctccaagcttgcagagcagcaaggcaactcttttctcctgcttctccatccccccagaccctcttcctgccaagcccaccagccccggactcctcaccatcgaacgcagtctgtgtgcccccggtaatgtctctggccgccacctccaggaccccctgggcctcctccaggccggtacagcaccaccacacaggcgataaagtagaccacctccccagagcgcaacacaaacagattagagcgggagtcacgacccctgtacccataactggggtggagatcacggtcaaggaaagggttagatcaagggcaggaggaggaagaggggagaaagacagagcttctggctggcagggcctagagcagaatgatggtaggagaggatctagaaggctccttgtccccacagacccaggaggaaatgggccactcggcagctcctcaaggctgcggatgccagacgggatgtacatggtaatggggcgccctcgaaggaacatcttcactgagatgccttctacagagaaaaggggtggtgtcaactacccccttccaggaaagacagagcagaaccctacccaccacacctacccaaaatagctcctggggctacagcccaaatcctaaccctgccatccaagttttcctctctgtccctctttacatacccaaattgtaattgctcctccgagatccagggcccccagggctggagagggggtcttttcccccacggctgttgggaagagagaaagcacagggattggggtcaggtcccaagacctaagcggggaggggcaggacacaagaaaagaggtcactgcagaaaccacagtcacttctgcaagcctgtagtttgcttcgtgagtatcagggccctagtagatggagacttctagttccatttaagagataagaagattgaggctgaaggggctgagcgcacagcacaaggccacaaagcttggaagaggcagtgcagggtccttttcatttccccatccgtaaaatgggaccaaagggagtcgagaatgtacaccagctccgcctctcagggatccgggaggcaagcaagaaagtccacatctctccagagattcctgtcgttagataacagtaaagtgatactgtctcttcagagaataaagcatgcccggtacacagcaggcgccccagaagtgtttgtttctttattcctgttgggcaatcaggtccccccaccccaaccagggatgtgaggtgagggatatggaaagtcgagagcctgcgcctggggcggggtgggttgaggggaagcctcacccacctctctgtgctcccggaccgcactaacaggttggcggaggagattgccttcctggagagcttctgccgaggccgctctgagggggatgaggaggaggaagaatttcttcgcggcctggtgggggcatagtgaaggtcattccctccaactgtactctgcaatcctaccacccctcccagcttccgccacagggccacaggacacctacgtgtcagcacgctgtgggggctgcaagggcctgaggaggggtccaggggatgacttgagctccacctctgtctccgtctgggtgcctcggctcaccaaggaaggggtgcacgtgggtggcagtcctgggggggctgcaagactgctggagagatgttgaattaacctgaagccccagaggccccaaggaggaggaaaaatggggtgtgatgacatgcatacctgtcccccggaggagctggtgtgccagagccctgcagggaggaagggggcacctgcagccgcagcaggcgaagggcttctgccagggctcaggcagccccaggcttgaatgctcgtccagaggggaggagacggtggtaaaggatcaagggcctccttctggcagggcaggcgagaaacctggcaaagctcccttcct

SEQ ID NO: 5259 - DNA, 3671 bp, Homo sapiens
tcttttgtgctgtgaatcaccccacgttcgcctggccagggtttctaacccaggttcgcaaggcccatgtggacacgtctgcagccacacatgctttcacggggcacatgggaacgtacacgcgaagggtaatgcgtgcacacctgtgcagccaggtgtgcatgagcgtttctgcacaggccaggtgatgaggggagggcagagctctcagcagaagggtctcagcggcgcctcctccctgggaaggatagaagcctctctgaaggggaagggactcgccccaagtaacctcaacccttcctcctgccccttcctcccgccccactcacttttggtcaaaaccagcctccacagcccaccgcaaagccagagaggagagttcaaggtaaagacccaattgaaacaagagaaaaggggaaaaccagccaaccaggctggggtggccactcaagggagagggtttgggccttccaatgctcctttaactcccagaaccagctgctgcgtcactagaggagaatgataatggtggtgtcccgggcaggtgatcctgtccccatcctgccctgggggtggtaccccaactcccagagcaactctctccatccccagcctgaggcctcgtggtaaacgtccctcagagaaagggcaggtggtgggagagtagtgggatcttctccccttttgctgctcggtatttttttaaataaaataattaccccgcccccaacccatccctatctctggaagtcccaccccaagcccaaaagaaaacagtttaagaagagtaaaaacggtgattcagaacttcccactgcggtctcggaagaagccctcagctgcctgggcctcgcggaaggtgacggtgatggagttggcggtgatgtcggtcacggtcacctcacttgaggggagcgcaggtgtccagggagggggcccctcggccaggtcggcatctgctgcagcgtcagacacacagatgggggcagcgttgacaaggtgggaagccatgcagaccacccaacccgaccccaactccagctcctcctctctgtgtcttcagtcagctcagggcctcacacagggctggacacttgggaggagggcactgggtgcatcctccccacctagacaagagctcagccagagcgggacgacaggaggagccctgggctagtgttgggccctgagcccagacccgactggccccacaaagcactacaggccctctttggacattgaaccagctggaccttatgacccatagggccctttccagctctgagggtctctgggctggggccgccttaccctcctcttcagggggctgcgcagcaggctcccactcgccagccgcctgcaggacgtctggggccggtggctcctgcaggaagagctcccgtcgatggctgtggctctccaggttgggcccgcggggcgggaacttcttgcgcgagagccgcaggtacttgtgggcctttcggggcttgcggagcgggaagggcagggtgggcaccaaggggcccttgtccaccagctcaggtgcccccgccttgaccaccccctcagggctcccgctgccgagtgggcacgtcagggagaagcagagcttctccttgcccttggccttgtgggagctccgcaggtccatgctgtacagccgctgcgggggcaagccagggcagcgcgggtcagccccaccctcccacccgccacacctttgctcatgctgttcctcccacccggaatgcccttcccatgccatgtctacccactcaactccttcccatgccacggctggccatcaccccaccccaccccagcccagagagtgcgccccgggcaaccccagggtcggccagctcagccctgcctctgggccccacagagcactcgcgtcccagcgtttactcctttgatacccagcagagaagcatacaagaaggacaaactgaaaactggccaagagaaacaaatctggatgcattaaggagttagccttcgttttaggaaaggcatctttgcttgccagagcacctccaaaactgacactgccagctcacccgggagatggtgcaggcagagggccaaggtgtgctcttggagttgcttggggcaaagccaggccagcagcacacacagccccggatgcccatgctatccagccaaagggacagggctccacctggcctgcagatgcaccccgacccctccagggggctcctgggctctgtgattgcagcccgctctgctgattgcccgcgacacatctggagctggagggcaagtctgtccacccctggagtttgtaatgtcgggatttatcttatttacttggggagaatttacatgaatctacaaaagattcatggtgccaagatgttgggagactctggatcactgggacagtaccttctcctgccacctgctaccagaggtcaggagctcccaggaagatagtgcagccatcagatgggacctgtgaggtcaaacacctccaagctgagggaagggatgacacacgcaggtcccactcacagtcgtgcctgttaacggcatcacatgtccccaggtgccggctgctgcagtgatgggaggagggctaaactgggaggggactgggaaaatactgcagtgcctgggaggcacatctggtaggcagctgactcaaaacccactcctcccagcgggctcacaggccatcagaagcctagtatgggccaggcacagtggctcacgcctgtaatcccaacactttaggaggccgaggcagctggatcaccagaggtcaggagttcaaggccagcctggccaacatggcgaaaccccatctctactaaaaatacaaaaattagccgggtgtggtggcaggtgcctgtaatcccagctacttgggaggctaaggcaggacaatcatttgaacccagaaggcagagcttgcagtgagcagagatcgcaccactgtattccagcctgggcgacagagcgagactctgtctgggaaaaaaaaaaaaaaaaaaaaagaagcccagtacattctaccattctgcaaggcagggtcttctacgtccttggcaacctcatcacgagagaactacagctactaaagggacgcgggtgccaacagtcaggtcctgggtaagctaccggcctccctgggcctcagtttctttctcagcgaaacaatgaagagactgtaggagccagcctccgaggagggccccaaccacacccacctcctggaattcacacctatgcgccgtccattcccacacccagtgctgtgttgtgtgacttcccaggctagggcataaaagacactgtggcttcttccctgctctctctctcaggtcacccactctgggaagctggtggctgcactgtaaggacactcaagcaaccctctggagaggtccacatggtgaggaccagtccctgtcaacgtccagccctgactcgatggcacgtgagcagccccctcggaggcagatcccgcagccctggtcgagcctgcagatgactgcagcccagccaacaccttgactgcagcccagactagaaccactgaagaaccagctagcacaattccaaattcctgacccccagaagccatgtgaaataatcaatgtttattgctttgagttgccatgttagaggggaagagataacga

SEQ ID NO: 5260 - DNA, 3055 bp, Homo sapiens
gacatgagatgatgaacctcaagtaccaccccagacaacaaggctgcttcatcaggacacaaacctgcctgtaccaggacctctgacctgtgtgcagcagagacactgaggataccattggcatcaatgtcaaaagtgacttcaatctgaggaacaccttggggttcaggaggtatgcccgtgaattcaaacttgccaagcaggttgttatccttggacatggcacgctcaccttcataaacctgaataagcacaccaggctggttgtcagaataggtaatgaaggtctgtgtctgcttggtaggaatggtggtattacagttgatgaggatggtcatgactccactagcagtttcaataccaagggaaagaggagtgacgtccaagagcagcaaatcttgaacattttcagacttgtctccagacaggatggctgcctggacagccataagcaacagcttcatcatggctgatgctcttattcagttcttttccattgaagaagtcttggagaagcttctgaatcttggggatactaatagaaccaccaaccaggacaatatcatgaatttgtgacttgtctggtttggcatctcgaagggctttctctactgggtccagggtgccacagaacaggtcagcattcaattcttcaaactgggcacaggtaatggaggtatagaagtcaattcctacatagagagaatcgatctcaatactgacttgggtgctggaagagagagtacgcttagcatgttcacaagcagtacggaggcatcttacagctctcttgctctcactgatgtccttcttatgcttgcgcttgagctcagcaataaaatggttgaccattcggttgtcaaaatcttctccacccaagtggttgtctctggctgtagacttgacctcaaagattccatcctcaatagtgaggattgacacaccgaaagtgccaccccccaggtcaaagataagcacgtttctttgtgctccaacctttttgtctgaacttttgtaaacaatagcagcaacagttggctcattaataattctaagtacattgagaccagcaatagttccagcatctttggtaacctgaaactgagagtcattaaagtaagctggcactgtgaccacagcactggtaacagtcttcccaaggtaggcttctgcaatttccttcatctttgtcagaacaatagaggatacctcctctggatagaagcttttggtctctcccttgtattctacttggacctggggcctgtcagcatcattcactaccatgaagggccaatgcttcatatcagactggacaacagcatcatcaaatctgcgtccaatcagacgtttggcatcaaaaactgtgttggtggggttcattgcaacttgatgctttgcggcatcaccaatcaactgtttagtgtccataaaggcgacatagcttggagtggttcagtttccctgatcattggcaattatctctacttttccgtgctggaaaacacccacgtaagagtaggtggtgctaagatcaataccaactgcaggtcccttggacatggttgctggcatgtagccctggctccgataaagaagaaagccacaggaacccgagagctgcaggcgagttcaatgagctaggatttcttaatatatatgtgataatgttttaactttgataattgacttttataatgacttgagtagtcttaaattgtctttcatttaaaacttttgttcttttaaaaaagcaccaagtctatgctactaacaaaaatttccttttaccatgtagactacttgggatgaaaataacttttcataattactatcatgaagggaggagagtggaaagttgccagatactgcagcaagatataaagatgaattcttcaaatgaggaagcaaactttatcaagtggttgaatttcttagatcaccttgttggacataatttcttgtaaacaaattatgcagtcagtgtcacgttcatgcagagtcttttaacttaaaattcattacaggtaacactttcaaaaagaagttctgtagtcttgcatactatttaccacaccatatttactgcacttagcttcattatggaggaaagaacaatagtaaactatcaataactgagacaataatcatattcattagtgatgagtcaaacaggttatacttattttttaaaataaaaacatttgtaaatttttctctacgtttttaaaacaacagtttaacaatagcagttctgttattttagctttaattttttgtaccaacagttaatttgctcatgcccaaagatttacatttataaaaaatgttctgccatgcaagttttaagagatttttgaattgttgacaatactcagcacagtcacatgtctctcataaatccacccagacttaagaaccaattttcagtgcaactcatgaagacaaagaatagccattataaacacattgttgaaaatcatttaaaaaatcattaaatttttttgcatttaatattttttcagctttcttaagatataattaacaaaaattgtatatattcaagttgtgttatgtgaggttttgatacatgtatacatagtaaaataattaccacagttaagctaattatactatacatagtaaaataattaccacaatcaagctaattaatatatttattatcacacataattctttttcttgttgtggtgagaatacttaagatctactctcttagaaaatttcaggtatataatacattattattaaccatagttgccatgctatacattagggctccagaacttattcatttcataacttcaagttataaaagtcacgataaaagtttgtgccttttgcaagtttgtaccttttgatgaacatcttcccatatcttcccattttcctcagtcccctgcacctggaaaccacccttctaaactgtttatatgagttcaccttttttcagattccacatataagtgagatcatgcagtgcttgtgtttctgtgtctggcttatttcacttagcataaagtcttccaagttc

SEQ ID NO: 5261 - DNA, 362 bp, Homo sapiens
agggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaa

SEQ ID NO: 5262 - DNA, 2408 bp, Homo sapiens
gtcatttctttaatatagaattttatttctggttatagaaacaaatgctaagaggagaaacaaaacttccccatccacatacaacaatttaatagataaaagaacagttaaaataaatgaaaaacaaaaagtagaaattttaaactttgttatagctttaaaacattaacgtctgatacaattagaaatcacattcagatctcaaactcttaaaaaaaagtatggctccttattaaaaaaatactgtatcccacttgaaatgaaaacacaggttgcctgctgttgacatgggtggggctgtcccttcctctggtgtcgtgcgtgccccctcccggtgctggggtgcagccacacccccccgccgggcgcccaccttcactcctccagggtgagacacgcaaggtgacatgaccagaacttcacatccaatgctctagaactgacatttccacttcataggacactgctgctttttaaagcactgattatcaaacatgttgtgaaaaatactttagacaggcgccactgtaaaaaaaaaaatacacacacacacacacacacacacacacacacacacaccgaacaacacccgcccctcccaaattatttttacaggagaataatcgttcagattaaaacaacaagaacaaaaactcaatattggctttaacccctcctgcacgtgtgctgagctgccggcctttgtcatctgcagggcacgtgcagcccaagtgtctggactcagcgacatctcaggacagactctggaacacggctgttgtctctcctcccgccccccttttcctgaaacagaaatcaagccacatacatgaaggtattctaggtatccaaaaagcctttcttgaaaaaaagaagagccaaacttaaaatacttgatttgattattatttttgagacagagtgacttggagaccgcttcagtcacctttggcagcctctggtggcctgaaatctggacgatggaacttaagacgcaactgggtcactggggcctgaagcgggatgggggcggggggccctccgcagccagtgttcagcagcttcaccaaagcaaataaatacattcacggcttctccctggccccggtatttttcttttcaacgcattttccccatggcgagaatgacagggcaggtgcaaagagtgactaagattcttccgaggggtttctccctggacagaaagaaagatgcctaaaaataaactgactgccctcttagtgatattctctgatactccgggcagccaaaaccagccattaggatgagtagaagaaacaaaaaatttccaaagcctcaccaattcagaggaggaacgctcacttcagccctgcacaaaaatacaaggaaaatgccagtcttggtgacccacagagcttccaggtcacactcaggcctcccgggaatggctggccccgagggaaggcctccactcactgaccctcagggtttcattctccaaggactgggctgtttctcagggcaggagtctgacctcccagcagctggcacagacttggatgtgacagacaggcacggcgaggttcatcagtcagagacgaatcctcctcaccactctccccgctcctctctctctcgtggccttctgatttgcccggagagccttctcacccacctccaggaaaagccagcccaacttcacacacccaggtagcacccctgctcatggtgcatggcaggcctagccctgggccctccaccctgcccaccttcccggagggggttgaaatgttccatccagcagcagagctgagggctgcagcctctgcctgaggaggagctgggacggggccggaaaagcccagcagagacagggtcccatgcccgtgggctcacaagacaacccaagactgaaactattttccctaaagaagtcagtgaaatgggtctgtttttaaaatttcagtccagagggaaatgtgtgtggttgtatccccaaaatcccattcttctaagcagctgtgacttcggggtttgggtgacagggaggacagaggaaaggacgcagcagctctaatgggacaatcctttccacagattcaactccgacagaattcaagccgcacggtgtgggtaagggcccccttctcgaggcacggaccccactcgccaccctgcgaggggccgcggtacccaccgagatcccctgcaaagcacagattccaaaccctccctctggtcaccaaacgtagcagcttttcgtatcaaaacccaaccaaaaaaacagtaagtatgtgatgaaaaccgtgtcctgagcactgaaaaacaggcctggagaaaggaactttgaaaagaaaaggaaattgtaagatgcaggaaaacaatctaaaaataagggacagaaccgggcgagagaccatttgtta

SEQ ID NO: 5263 - DNA, 1360 bp, Homo sapiens
tttgcattatcaactggggactcctggaaatgggggtgtctccaagagatatatttgatacacgtccagagaattcctgaaggaaagaatctggggttgtcaggctgatatcatgaaccccacatttaacacattaagtgaagagaggggacaaaggccaggcttgggaaggaaggagggatcaacaaagcccttacccaggacagataaaaatgatagaatggcagtaaccccatttggagcccccatttgtagtcagcaagcaaagtactggtcctttttacaccttatctaaccatcgagacacgcccctgtggttggtatcattatctcagtgtttgagcagggaaacgtcacttcccagaggacccacagccagtactcggcagagctggaaatcaaacccggtccatccaaagctaaagccagatgtctctttactggacctctctggaaatgcttctcaactttgatgatggctccagtgacaggcagcagccaccaggactgtgatctccctgggatttaaagtgggaggttaaaccaggctccacgccactgcggaattgtgcaattgtaagtcaagtctcaattgtgagccaagcttctcccagggtcagaggtggagttagaaaggccccatgtgaccctgagcaagtctctctccttccctggtcctcagtttccccatctctattggggaagggttaggtatctattctagttgattaattgccagggcctgagctctgatggtccaggattctgtaagtctaacgttaggtcccacggcttgccctgctcagcacctaataaggccattagctctggctccttctctctggggtggcagcagggacagaaaacaacagagatacattctcttggcagcacagaactcagctcaagggttctggggatggggccttccctcctgccagggaggccatctcgagaggctgactgctcacacctgggcagcactctgtctcctcccctcctgcctgggtcccagctctgttcaccaccccaaagcacatcaccacaaggtcagttgcaaaggcccggtatcacaggcttaaatacagagggctaggagggaggtgggaggtgggagaggaaggtggagtactaacaaaggtgttgaattatcactgcccatcaggacacggttatttccccttactctgggacaccaaagattctacacaatcttcctataatcctgaaccacaaaagggaggcacagcctccaaaaaaaagtaggagaggggaggggggaagtacttttattttgaaatgtgttcatttttctttgttttattttctatcttgatgaaaagaatatatttttaaacct

SEQ ID NO: 5264 - DNA, 1411 bp, Homo sapiens
acaggagaactcactggttgaggaatttgacatgagcccagttatctccccagtgagtagaaaaagccccttctatgtgaattaggtagaatgccaggtttggttcactttcagtgactttatggtattaatattttaatgagttcccagcattttgggggaagcagatctgctttcattctaggcctaaacttgtctgagagcaatttaaccctttgctctgtgccagtctcccttcccacccgatccctggttcccaagggaagctgcaccagaggtggttggtcacccagcagccgctcagagtgccagtgagtgtgcacatgcccctcggtgtctgacctttttctgtaaacaatgaggggtagaatttttgtgtatcttcacgtctgagcatggctcttcgaattcatacgtaaagaggcaggcacagataatgttaactggcttgtcgaaaagcccgcagagagccagccccagaaagcagtctcctgatttcctgtcctggtgcctgttaccctggcacaggcccgtggggcattggtgcccctcattttctctggctggtcttgaaggaattcttatctccagctcagtggttggggggcactaggggaggagaggccctctctttccttctctccacattctccctgccccgctagttgtgtctcctgtggaactgtctgctttccaatgtctttctgaggaaaagtgccatgtttggcagaggctcaggaaaaagcttcaaggggcagaaaagctctgtttgaatcgactcaccgggacaggcagctgaggaaggagcgccatggaagccacagatgggatgactctgctgaagcaggaatgcacccagccgggaggccgccagccctgccagccgtcagcacacaaaggcaccgctgtctgctggggaggttgggagcaggccctgtgtgcctaaatgtgcctgtggaggcagcgtgggctctccaagatggggcgtgttctgtgtctgcacctgctggtctctctgtgctggctgagctgagcacctactgtgtgtgtgccgggcactctgcagagagtgtacagacagcaggctggggcctgcctggaggaggtgactgtttcgtgctcagagacaggcaaatcagcttcaagatgagagccagagactagcacagaggaggggcgccccaccgagcctcgagagcttctggggtgggtacgggcctttgatagatgacacagcacttctatagggcaccaaaaaggggctgctgggcctgtctcagccttagacttgggaatagtgccacgtattgcctttgagcaagaggaagtgtgtcgtggaggagagactgtgggttttggactagacagagcaggaatctgcctctttagcttcctaactgcaacctggctg

SEQ ID NO: 5265 - DNA, 7731 bp, Homo sapiens
atctctaagaccggagtgggcagggacccgggcctctgaggggctcaggctccaggccggaaactgcacgcggtgctggcgtcaggcccgaggcccagctacgcctcccacggcctccctaatcgccattcggggcttgcgggagcacctgggaggctccacccggagccagacactgcctgcccccacgcccctccaggaccctcgaaggagaaggaaatcgggactggcccagcgtcccgtgctctagaaggcgggctactgccccgtcccaagcaggggaggaggacgagcgagggcgtcactcattctgtcccccgcggaaggtgggctagccgcggaggggggcgcgcaggggaggggggcgcgccgaggggaggggaggggaggggtccaccccgcccttagggcctccagccatcgcccgagatcagagctcaggaatgcgcagccagaccctggagggtgaggaaacacccctccgggattcctcgcagcgcacccgactctccgggccacacccagcccctcagtgtcctccctcgtccactccagacgccacacccatcgctcacgctgagaatcgggccccggaaccccagcttcggctctcggcacccagaggtgcgggacgcagccctgtcttctcctcctttcccagctccttctgcacttcggaagcacggggctggatcttaacacccccctccctcggcctttcaggagcccaaagttccgattctgtctgtcccctggatggggaggggtcagtaattctgaattccttccattctcattcccaaacccaggacacctaaccctaagcgcttcccctcctaaaggacctccacgtaccagattccagcctccaactagggcacctacgagtccccatctctctactcccgcagacccagcccctcctccctcagactcaggagtccaggcccagctcctcctccctcagacccaggagtccaggccctcagcccctcctccctcggacccaggagtccagaccccccagcccctcctgcctcggacccgggagtccagacccccagcccctcctccctcagaccccggagtccaggtccccttccccactcttccagacgtatgacctccacagtccaggtcctcagccctctcctctgcagaaccccaagaatcctggcccagccccagtctttctagggacccagacattctgagacccagcccattcctctctctggccataaagaccctagactgttgcttatgccctctggggtccccacaacctcacctcaggcagccagtggcgactgcggctgaagcaaagacgacagcggcagctggaagggtctgagggctgggtggggttggagggctggggagccagcgcgggcgggacgggggcggggccggggcggggcgcagctccggctagggcggtggacagggacttccccgagtctgggctatcccagccccgccccgaggcggggccaagagcagaccacgccccccagagtaaaagtagcgtggagctcccgccccaccccagtgagcagggtggagggctgaggtcacggttgccgtggtgacaaaacaggaagacacaacagctggcggcgtggagactcctgggggctgccctcctcgacacagccctagaggagtctcccgggtaggccagggaagaccgttaccatagaaaccccgcatgtttagggtttgtttagtgcagagccccccagctcaggtccccgcccccgtctcacctcactcctttcttccgctcccttcctaccccctccttcctggtctgttccgcccccaccccttccttgccggatgaaaccttagacacctgggtcgcagcggattgggggaccaggcccctcagttcaatgggggggctaggatctctgtctcttggagccctgagggagagcagaattgagagcagtattcctgggctttaggtggttctgggctacgatccctgactgatgggtctccccaagaaacagaggctagattcctgtatttaaggacttgaaggggcggcaaaatgctcccctagtacccactggcaccgggcgccgcagggtaagggactcgggctggacgcaggtctcagatatcacagtggataggggtggggtgtgttgggggcaaaattcctgggagctagcgcggtagcagttgggggcccggattcctgggctccacaggatgcctaggctgaggcccagattcttggctcaaaagaacaatcaggcctgggcgcggtggctcacgcctgtaatcccagcatttcgggaggctgaggagggaggatcccttgagcccaggagttcgagaccagcctgggcaacataaggagactctgctctattaaaaataaatcatcatgatcatcataatagaaccattaaagctcagactcgggttttccgagcaggtgttgcaagcctagccgcctgggtctggaaggcagcgatatttttggcctacattcctgactcctggatggagggagggactcagaattttaatgaggatggggctggggctggggcttggggctctggattcacggatcctgcaagaggggaagggatccaaggggctggtgggcccgaagccccagggcagggaagggatgcagggtgtgtttttaaaaggcggctctgcggccctaaaacggactgccggagccaaaagaaaaagagggagctgagggtcgggatgtcgggcccccggggaggggcagggcggggacctgggacgcctgagtccctccctctggccgcgttcactcaccgcgctctgcagtcgtcccgggcgcggcctggctggctgcggccgctgggcggggcctggtggcggctgcggatgctcagcgacgctgagctaacggggcgcgtctggcgctgccgccgctgggcaccttccagggccgacaactgaggaggctttgaggccaagcccaggggtggaggccgagtccaggagtggaagccgcgcgagtggcgaagggagcagtcggaaggggtccgggagctggggatccgggtctacgtgccctacggagcagggaggggccggagggggacctgcaggaaggcgggggtctgcaggagtggagagggggttgggtagaggaaggtagagcctgtgtgcgggcttgatgtgcttctgcaaagggaaggggacacagaccctctttgtcactctgggccctgcataggggagggaggtctcagtgcacccagatcaggccttgtccttgtccaaggagggagggctgtggacagatagggagtcgggacatggtgttagttggagactcccctgggacgcctctaggttctattcacaggcctccttggccccaagtgtagcagcaaatctttccccttcctgcctaaattagtcactgcctaaccccatagtgacacactcaaggtaccccaaacggcccagaggtggtctccacttacacaacttactgtgttattcctcgtggtggcagcggttcccttgtagacactagaacccctcaacagcagggttcagggtagcaggaacaggaagcaaacatttgaagagtgaaggccggtcacggtggctcacctctgtaatcctagcactttgggaggccaaggcaggcagatcacctgaggtcgggaattcaagaccagcgtggccaacatgatgaaaccccgtctctattaaaaatacaaaaaaattaatcaggcgttgtggcgccgcctgtaatcccagctactccagaggctgaggcaggagaatggcttgaacccgggaggtggaggttgcagtgagccaagattgccactgcactccagcctgggtgactgagcgaaactctgtctcaaaacaaaaaataacaacaaaacaaataaaaatttgaagagtgagtcatcgggtgtggtcctaagaaatggcactcttggccgatgcagcaactcatgtctgtaattccagcactttgggagggaggccgaggtgggtggatcacctgaggtcaggagttcgagatcagcctggccaacatggtgaaaccccgtctctactaaaaatacaaaaaattagccgggcggggtggcatgtgcctgtaatcccagctacttgggaggctgaggcaggagaatcgcttgaacccaggaggcagaggttgcagtgagctgagatcatgccattgcacttcagcctgggtaacaagagcaaaactccgtctcaaaaaaaaaagagagagaaaaataaaagaaagaaatggcactcttgagttcacaggtctttgtaatctgggatcatctggcatgtacccctggttcagagtggttacccatcctgtaacagcaccccgaccccaaagatgatgactccaaactggccctgtaacccagtctcaaacaggccgtgctgttccatgaggctggctgctttggggtaatggggtacatggactgccccccactgacttcctaatatatggagctccttgatcagaagcaatactgtgcgggttaacatgagggtgaatagggccattcagtgcatacacagatgctgctgttggcagaagtgcaaagggcaagaaaagcaaataacaagcccagagttgtttactcgagggaggaaaaactccctgcccagcccaggatgaaagggctccagtgtaatcctcacgggcccaggtatttggctttttggtcttcctaggaaactgtaccacactgggggatcagcacttgctactgccagctaggtgggcattcatcagtgacgtaggtggtgtagtccacctcggccactttgctcctgaacctatggagcaagccctgaggatgccagggaaggaggctgatccagatcctcagagtggtcatctgatctaccacatggcatcatagcattccctgtaatagaggttttagggggagagttcacttgggataaagattacgaagtggtttccactcgcaacacgtctgacaccaatgtgtgtgttttttcttttcttttttttgagacggagtctcgctcttgtcatccaggctggagtgcaaagaggtggtcttggctcattgcaacttctgcctcccaggttcaagcgattctcctgcctcagtctccccagtagctgggattacaggcacccaccaccacacgcagctaaatttttttgtatttttagtagaggcggggttttcaccatgttggtcaggctggtctcaaactccccacctcaggtgacccacctgcctcggcctcccaaagtgctgggattacaggcatgagccaccgcgtccagccacctggctacatttctaggactgtcctctaaaaacaaataagttgtttttttcatctcaggtcaattcttttctttttatttatttatttatgttttaagatggagtctcactctgtcacccaggctggggtgcagtggtgcgatctctgctcactgcaacctctgcctcctgggttcaagcaattctcctgcctcagcctcccgaatagctgggactacaggcatgggccaccacgtccggctaattttgtatttttagtagagatggggtttcactctgttagccaggctggtctcaaactcctgacctcaggtgatccacctgcctcggcctcccaaagtgctgggattacaggcgtgagccaccgtgcccagccgtcaattcttttcctctttttcatctctaaagacattcttctcataaccttactattgctgttacaattcttctctttttgatagtcaatgttcctactcaaagaatatttcgttggatttaaaatacacacacacacatatcatatatatgcatatatatgtgtgcatttattatctcacagtttctatggagcttagcacagtttagccaggttctctgtgaggctgtaatcaaggtattggccaggactgagttttgggtttgtttgtttgtttgtttgtttttgtgttttttgtttgttggtttgtttgtttttgagatggagtctcaccttgtcgcccaggttggagtgcagtagcacgatttcggctcgctgcaacctctgcctcacaggttcaagcgattctcctgcctcagtctcctgagtagctgggattacaggtacatgccatcaccccggctaattttcatatgtttagtagagacagggtttcaccacattggccaggctggtcttgaactcctgacctcaagtgatctgcccaccttggcttcccaaagtgctgggattacaggcgtgagccaccacgcccggcccggcactgagttttgatctgaaggctccgctgggaaaggacgtgcttctaaattcactcagcttgctgcagaatttgtttccttgtgactttagaactcatcaggggctgggcacggtggctcacacctgtaaccccagcactttggaaggctaaggagggcagattgttttgagctcaggagaccagcctgggcaacatagcaaaaccacatctctataaaaatacaaaaattagccaggtattggtggtacctgcagtcccagctactggggagactgaggctggagaatcacttgagcctgggaagcagaggttggagtgagccgagatcacgccactgcactccagcccctggatgacagagtaaaaccctgtctcaaaaaaaaaaaaaaaaaagaactcagccgggcacagtggctcacgcctgtaatcccagtactttgggaggctgagacaggcacatcacgaggtcaggagatcgagaccatcctgactaacacggtgaaaccccgtctctactaaaaatacaaaaaattagccgggcgtggtggtgggcacctgtagtcccagctacttgggaggctgaggcagaagaatggcgtgaacctgggagacggagcttgcagtgagccaagatcgcaccactgcactccaggctgggagacagagcgagactccatctcaaaaaaaaacaaaaaaacaaacaaaaaaccctcatcaactcatcagtgcatgctccttcaaagtcagtgatgagagactctagggtgtgtcagctagcaagaaatcttctacaacatataagcaccacctttgccatgccgtattggttagaagaaagtaacacgttcctcccacactcaagggatggggatgatacaagtgtagaagatttctttttaggaggaagaaaattttctggacacacaaagtagtgattggccaggtgcagtggttcacgcctgttatcccagtactttgcgaggttgaggcaggcggatcacttgaggccaggagttcaagaccagcctggccaacatggtgaaaccctgtctctactaaaaatacaaaaattagccaggtatggtggtgcatgcctgtaatcccagctactcaggaggatgaggcagaagaattacttgaacctgggagtcagagtttgcagtgacctgagatcacaccactgcattccagcctgggcgacagagtgactgagactctctctcaaaaaacaaacaaacaaacaaaaaataataaccacctagcagcaaagcctgtgaatgcatttctgcttcctttttttttttttttttgaaacagggtctcgctctgccgcccaggctggagtagtgcagtggcgtgatctcggctcactgcagcctcgacgtccagagctcaagcaatcctcctgcctcagc

SEQ ID NO: 5266 - DNA, 1478 bp, Homo sapiens
ggaagtcccgctggactgcctcctggtagggaagtctctccggcgtcaggaagctggagagcacagccacagggcagctggccccaaaaagcctgcgtgggacgggccggtgggcacatgctggaggccgccccgtttccgcctgggggccagctggccggtggggccgcactttccctggatcctccgccaagagggctgcctggccgctccgcggcacagtccattccctaccccctcctccccggcccctgccctgcccgcggcgggcactttgtcccgcggcccgggtggctgcagcttaggtttctccccggaaggaaagcttgaggcgcacggttgcggtcggccggctgcgggggaccaggggccacacctgccgcggaggttacagtcggtaaagtagagcggcgacacgaacttctccacccgctccagcgtggtgcgccagtgcttcaaggccggcgcagccgccatcgccgggctctcgctcctctttccggaaggcccctggcgctaccgttccgctccacggcaggaaaccaaaggttccggcgtccagagggcgcctcccagtcccgggcagcttttcttggaacaccggcggctctcggaagcccagctgctgtctgaactttgagccgagttggaagctagaaactgtttttgaggctctcctatgttgtccgaaatagtgggccgcagggaaaatctcaaaataaaatgggaaatttgacgattagaactctcgaaagtctcaagacagagacttaggccattcggcaagacaggcgggagcctcagctgctgcagacccagcctcagaagcagcaaccgggagacctctggctctagctgtcggtgaacacggaaagtggtgtttgcttaacgtggagccagactacccggaataggtgttttcataccggacggagatcagggtgttagtgagcagggtggtagagctttacgcccaagttactacgacttactcgattacacgctttactgaatgtatattgctaactcttgcacatcaccagaaactctggagtttgaggtggcagaacagtcatggcattgacgatcccaatggaaaaatgtatttcaccatacaggactgtagagtcccgggaagccataataccagaaacagacctccagtttcattctcatccctagtactccactgacagctttattttttttctcctggggttgccaagagtctttgtctataaaatcattaggaacaaaaaaaaatacacaagattagccctgatattttaatggaaatactgaccaagtttacaacatttcaaatgcagatcacacggaaaggtgactaagtacagaataacaaatgtgatttaaaacaaagataacctgctgctgcatataatacaggttgggtttagagcttggagctcagatgtcagacagcaggaggaataaaaatgctacttgtgaaaacccag

SEQ ID NO: 5267 - DNA, 7236 bp, Homo sapiens
agacggaaccagcacccgggacccagggaaacgtcacctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacggcatctcggcccgccaggaccgccccactccacgtcgcccggagctgaggcctgggagggggtcctgggcggagcgggcgggtggtcgggccaggccacgccccaggccacgccccaggccacaccccaggccacaccccaggccgcgcccgcgcctgcgcctcagccccggcttcatcttccctgtcttgttcctgggcgcagagggctcctccggcgccgccgagctgcgcccgctgccttcacaccccggacatccgcgccacactgatggatcctagaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaaggagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccagctctgagattctgcaacatccacttttgctctctgagccttgcaaaacctgcacaatcagtccctaacttatatcccctctgtttgaaatacctagtgtggtttctatttcctgacttgactctgactggtgtggtacttggtataaagaaggttccctggccaggtgcggtggctcacgcctataatcccaacgctttgggaggctgaggcaggaggatcacttgagcccaggagttttgagacccgcctaggcaacatggtgagacactgtccttacaaaaaattttaaaattagccaggtgtagtgacgcaagtctgtcatcccagctgcttgggaggctgaggtgggaggatcacctgagcctaagaagtcgcggctgcaataaacagtgattgcaccactgcactccagcctgggtgacagagtgaaaccctgccccctcccccaaaaaagaaaagtcccatgaaacagacctacacaggtgagattctgagattgatctggttctgacctcggtcaggaatgcagtgctgagcttcttgccaacagaatatgagacactagaaagccatagcatgcggtttcatcatgtttaactgtcacctgtggttgcctgagatgaagtgctgactgaagcgagcaccttaggagacacagtggccactgcactgagcagctggtagcagcagtggtgaccatgtggactggggggtgggttggctgcttttgacagtgccagagaactcaaagaaatagccacacctgtcggagaccccagttcttgcccacctctgcatggacgaacctctcgccgaagtggagcctgccgccctccctggggtaagagcccatcctacatgtccccagacaggcctgggtggccggtggactatcgtcaaagggactgtgcagccagggttctccacacccaaggccgcccctgcactcccagcaggagggcgcccgcaccggcggcccgaaaaagtctgggccagcagacagcgcactcacgcccgagaccccgcaatgccgtgtgtccgcgacctcccgctcagggcgtcctcgggtcagggcgcagcgcggcccccgtgccgcttctggtgctcgttgaggttgcaacggtggctgaaaggcttcccgcactcgccgcaagcgtagggcctctcgcccgtgtgcgtgcgccggtggcttaagagctccgacttgcgcacgaaggccttgctgcagtgggcgcagacgaacggcctctcgccagagtgcaggcgctggtgctggcgcagctcggagctgccgcggaaggccttgccgcattctgcgcaggcgaagggtcgctctcccgtgtgcgaaagccggtggtgcgccaggccggaactgccgcggaaggccttgccgcagtcggcgcaggcgaagggcttggcgcccgagtgcgtgcgccggtggctcagtaggttggagcgctggctgaaggccttgccgcactgggcgcacgcatgaggcttctcgcccgtgtgcacgcgccggtgctccgccaggtaggagcccatgacgaaagcctggccgcactcggcgcactcgaagggccgctcaccagtgtgcgtgcgctggtgctgcaggagctgcgagctctcgcggaaagcctttccgcactcggcgcaggggaagggcttctcgctgctgtgcgtgcgccggtgctgccgcagccccgccacacgcacgaaggccttgccgcagtcgggacaggcgtgtggccgtgcgcccgcgtggatcttcaggtgctcggccaggttggagctctggctgaaggccttgccacagtcccggcaggcgtgcggccgcgcgcccgtgtgcacgcgccggtgctccaggaaattggagttccagctgaaggccttgccgcactccgggcactcgtagggcttctcgcccgtgtgcgtgcgtcggtgctgcaccagcgtggtgcttcggccgaaggacttgccgcagtccgggcagcggaagggcttcaggccgctgtgtgtctcctggtggtggatgagctgcgagtgcgcgcggaaggccttgccgcactccctgcaagcgtagggcttctcgccgctgtggatgcgctggtgctggctgaggttggagctccaggcgaaggccttgccgcactcggggcacgtgtacggcttctcgcctgtgtgcacgcgccgatgctgcagcaagtaagagccctggctgaacgccttgccgcactccccgcaccggcagcccggctcctctgggagaggcgaagggcgcaacgcccggtctgcaggctcgctcctgggcccagccccgtcccgcccaccgtctgcggggcccagctccctgccggggcctccctgttcgtccgccgcccccagtgtggcttgctgccgctggccgtcccctgcctccctcggaacctccgtggagttttcccaggccccccagcctccagacacagccccctcagagaggcccctcgtggcagtcttcacattgcagaggacctggccttcctctggggccacctgcagggtccaccctcttggggactccatctcgcgcctgtgacctaaaacaggagagaaaagggtggggccccaagtgtcaagaaggtggagactccagtttgtgaggaacacgatggacccgtctccattcctgaaggctggaggacaccgcctgacccaaacacagctatgtctgcctcacccactccaccctggccggatccctgggtagtcccctccacacagtatgggcagcatgtccaggctggaggatctcagtggctgttacccaggcaatgtccacaccaggcctctgtgcaggtcagaccaggtggtccaaggcatggggtggctgtgcagcccagatccctgagagagagagaggccaagggtgggagggcctccttggtcctaaggccatgcctgcctgtccagccgatccttcccacagcgaagtctctacagcgagcaaaacccatcctcatttgccctgagcaccttatcatccttgtgtagtctccagccccgctgccaaggcagggcagggacaagtgtgtagatggtgccatacctggaggtggggcctggaaggggcccaggggagcctcttgctcctctccctcctctgtcctggggaccagctcctcttggggcctgggggctggcacctggggacaggaaggcagcagggcagggtgaggtgttcagcctagcagatctgagaaaacaaggggcatgcggtggcatgacccacccttctctgcaccttcagttctcaggacacaatgcggagcacacaggtgtggactggagatctctgactctgccgtccaagccaagaccaccaaactcccacctgtcaccatcactttcccacagcccccaggccctctcagccaccaacccacgactggccccagtgctggctcagctggggtcgtgagcaggggaagcacacccagcccccagaccagcccccactcatctggagtcctggcccagctgactcctgctgtagccgctctgccagggcagtggcctcctcagggctgcctagccactgctcctgcgtgtaggcctggatctctgggagcagtgtgcccaataactgctccagcaccaagagctccagcatctgctccttggagcaggcctcaggcatcagccactggcaacacagctcacgcagctgagccagggcccctcggggccctgctgccttctcatagcagaacccccagaagcactggccagggctcttggagctgggctcacccaccatcagttccagtggactcgggaagacctggggggccagggctgatgcctcactcatctgggcagccatcctgcccctttcctgggaggggagtgcagctgcatggcccagggtactttctctgcagctggaaacacaaaggtgagcctgtgagcacagcaaggccacgaaggtcccctccttgggaccacctgagactgagtaaaaatggaagaatgggggtatcggcgtttctggcccccagtgtcagcatctttgcccacctgtgtgtccaggtgcctgagggacacactgaggtgccatggctgcttgtaccatcccttccccccgcctccccgcttttcttgagggtccctgccctgccctgtctccttggcacccttcatcccacacacagaacaactaagacagagactgtgaacaggacacccagagtcagaccagcagatgggtcctgtttgtcccctccaggaagtgttttaaaaatttaagttaggccaagtgcggtggctgacggctgtagtcctagcactttgggaggccgaggtgggtggatcacgaggtcagcaattccaagaccagcctggccaacatggtgaaaccccgtctctactaaaaatacaaaaattagccaggcgtggtggcaggcgcctgtaatcccagctactcgggaggctgaggcagagaactgcttgaacccgggaggtggaggttgcagtgagccgagatcgcgccactgcactccagcctgggtgacaaagtgagactctgtctcaaaaaaaaaaaaaagagaataaatactgatacatactacaagatggatgaatcttgaaaatattatgctaagtgtaaatgaaaaaattcagacacaaaagacttcatattatgttattccatttatgtgaaatgtccagaacagataagtctgtaagagacagaaagtagatcagcggttgccaggatctgcagggaagagagaaatgggagatacagccgtgggagtgatgaaaatattctggaattagtggtgatgactgtgcaacactgaatataccaaaaaccactgaattacacactttaaaaggatgaattgtatggtatttatgttttttaaaaaagttaccacccaatcccaaaagcttaaaaactgtatgactccatttctttttctttttctttttttttttcttttgacagggtctggctctgtcatccaggctagggtgcagtggtgcaatctcatctcccaggctcaagccatcttcccacctcagcctccgaaggagctgggacatcaagtgcgtgccaccatacccagctaatttttttattttttatttttctatttttgagacggagtttcgctctttcacccaggctggaatgaagtggcgcaatctcggctcactgcaacctctgcccccaggattcaagcgattctcctgcctcagcctccccagtagctgggattacagatgcctgccatcaggcctggcttattttattttattttattttattttttagtagagatggggtttcaccatgttggcc

SEQ ID NO: 5268 - DNA, 2276 bp, Homo sapiens
cctcctcctggcagcccagcaacaagcggccaccgcccccaccccggggcgggcaggtgagtccccccccgacccgcccccagcccagagggccgccctgcgctctcgcccccggcccctggccgcgcgtgccccaggtcccccagtagcgccccagcgccgctgctgctcagacacaccgaaataggaatgatttaatccaacgacacctcccagggctgcccagtcccggttccgccggctcctgagattggggaggggcagaattgggtggaactcgggctggggggcggaaatggcccgagtgggagggaaggcgcggagtcggacgctaccttgtaaccgagttagatttctgcagaagaggaggacgaaggtcgcccacggaccctcgggtgacctcggtgcggcctggtggccgggcacacccgcgcatggacgaggtccctcccaggggtctccctgcaggggtctccggggaggtagtgggcacgtgggtccttaacctctccattgcatcatccccatcccggtgggtacagaagcgcagcaaccccgcggtgctcccggaagacaccgcgtctccaacatttacacggagatgctgctcggctcaggtcgggtccgtacgcttcccgaggtgcgtactacgcgagccacacacatcactaccgatattcctgagaaagtcggtgccacaggccggtgacgcgctgtgcccgtgaatacgcccattgtgcgggtcagacgcagccagggcgcagcgttcaggaggcgggtgggcagccgaactttcactggccacgagcgcttcaccttctagaatttgccagggactaggcatcaactcccagtgagaaaatcacatgtgaagttggaagacacatgctgcccttcacttttctacggagttcacatcagtttcagcaatccgcgttctcagttcgctttgcccgggcgagtgggttccatcatcacctgaaccaaaaacgcaccagggcgcgcgtgcccaggcaccaaggccagagaaaccgcacgtttcgagtccccagttgctgagaaacaatcacagccctcctcttttctcccccttctgcaggttccgacctgaatctgaaagtgcttctaaaccccatgcttcacagaacgttcggagggggaggcgctccgtgggggctgctgcgtgcccatgtagccgaactgactcgaataaaagcgtgtccacgtctacatcacacatctgtgtaaatgcagaagcctgcggatgcgcggggctggccagacttcacagtgtgcagacacatgggctcatgcacgcgcacgcgcgcgctcacacacacaccccaaattacctccgggatggagaaagccgctgcggattggccagcagagccgtcactcacgcccagggggcagggagacttcgcaaagctgtttccttttttttttttcctcctctcctccctaccgtttcatttaatggtaaaacaacagcagagctctgaaagttagccatctgcgcagagtttgccttctttaaggagggaggcgtcagacgatatccatttaaatatattttgtacttccacaaaggatggaaagggaaattcacgaagggagtggaggcggaaagggagctccgagaaagaaggaggggtcattccgcggggggcgggggggggggcgggggccgacgcaggggaaagagttgctctctacaccgaaaagggactttgaccttccattgatctcgaaattcaaaaacgtttcttcacaggtcagattgtaacaaacactcgttcctaatttatgaactcgccgttttgattttattatttaagcatgcgccagcaatcgtgtttccttaagaaagaactgacctatttttggctggagataaacgatcatgttaacagatgttaatcttgtaatctgtttttcctgtaagcactttacctagccgggtttcagaccttaaaaataacatcttttccaaaaagacctgacgtcacaattcactccctgaaaaatcacactccccctccagtttcttcccctgcaatgatttcaaagacattaaatcttttccactttataaatgctgatctgttctgcctctactcccacaggctcttatttgcatttcaaattccacaggttacaccagtcgccttttcaaaaaatgtaaaccaacaatgcagcagcaaatggctttttgtgcatctggattaaataaagcacagaatgaatatatttaaaaagagggctgcgcaagt

SEQ ID NO: 5269 - DNA, 1423 bp, Homo sapiens
cctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgg

SEQ ID NO: 5270 - DNA, 2621 bp, Homo sapiens
ttttgttgcagagatggtgaggatgtcttgctttgttacccaggttggtcttgaatttgtggctttaagtgatcctcccaccttggcctcccaaagtgctcgggttacaggcgtaagccaacgtgcctggcctgtattttattgtaattcctttttccattctcatctcaatgcatttccaaattagagaaggacatccttcttgtctcacactttaaaaaatagcagttttcatggcaagccaacattttaacatcttttctatggccagcaatgatagtcatcttgtggaaacgtgtctgaggcattctcctgtctataaagtcaaagatctcattaagtgctttggcatgttttgaggaaaccgaaaggtgacccaaaactttcattatgaaagctggtatcacaggtaagcaaattacacccctttgtgacagtgtcgggtacgaggtgtgaacatttagcaggtaagatgttttcattttcattggtaagaagcttatggactaaatgaaatttgctcaaattaactgtgtactgtctgccaaatatgtagataaatgagcaaagtctaggttgtatttggacaagagaacaacaatctcttacgtcttcagtggcttcactaaaatcttcacagaaatcgagaagacgatctgaaactccagttttcaaatcaacatacctaagagctagcggaaacctgtagccatgacttcaggcagcccttgacgcactcggaagcacgaatgctggaaggatcagacagggtcagcactactgtaaaggggcaatgcatctgttactgaaagtccctcgtcctttggttcacacacaggacttttagtttgtaacctccgaatcaggaaatgtaaccttcttggtttgcggtgcaatcaagggaacaagatgataatggcgtccattcaaggagtgcgcccaagctaattctgcgaccactgtttttgactgagaactgctgtctctttggaggtcaaaaaaaccttgatttagaaagatatgcctcagacttgagagactcaatgtccaatgtgcctccacctccccttctccatatgccatttctcacattcttttctgcacaccgcgcagtacattctgtttgggttctttcctccctaatccagttgtgtgtgtccttgcatctgtcattaaagtaacatggtcatttaaccttctttcccagtgatgcctgggtcacgctggtgctgtcattgtcaccgttctcattttcatcatctgaactcttaggaaatacagtcacaatattcatgatgtcaagactgaaaccagcaccgtctagacaaaaagcccaacactgaatctgcagcagactcctaggcaagtgctgctaacatgcatgactgcagcgtgcggagttgcagcctgagtgatgtgatccatggtgaatcacaagtcctgatgccagcatccacgtcaggcaacatggcgacagtgaccactcgaggcagatcatccacgccatttccatccgatgctacaaatggtgctgtcatccctctgtgtgggtttcatactttccacccaaccttctgcatcactgacaaaacccaggactttctgtgtcctgggattcctcaggatgtggggctttttagtgttaaaagccagatggttggtcacaccagtgaggaccctggcaacggaggcaggccagaaaccatccctcagagggctgctggatgtaggcaatatccagcacagggcagcccgcgctcggggtttaacacgtggggtgatccgggtgtcacctcaggaacggagccaacaaaaccagagtgccccaaaaggccctaccccctcaaccaggccaaagcctcgcactttagggccccaggcccactctctggctctacagtctgtagacctccttttcagaccctgagctcctggaggggcaaggctgaacaggttcacctgaggcctgcatggaggaggaagggaaggaactagaatggaagggttgcctgtggaggggaagcagatcaggccccgacctcgggcaacgccccctgggtgaggagacaggctgcagctgactaaccaagtcccatccagtgggtgcaggggacacaggaggaagtggggcaagcagtaatcagaaatggggaaatgtgagctgcaacatcacccaagggctgcaactctgagaggcaaagaagctgccaggtattgggagttccagagctcctggcagcagcacaggcaggcgggtcccccagcgagccctgtccccttgctgctggctccaccctcaactccatagccccagaaacagacccaggaggagagggattgcccgggccacagccagtttgctgggcagagaccaggccagaccccacctacagcatggcgcttcccccaccagcacggcaggaggtggcaagtcccagcagcacagcgggcaccctggctctaaccagagggtgggcatcgtcccaccccttcctctcccaccccctgccgcccatgaaatgggaactgagttgcccaagagttaatcacttttctgacggtttattttattcatctttggtaacaaatggctgaaatcaattaaacttgctttcccctca

SEQ ID NO: 5271 - DNA, 2469 bp, Homo sapiens
actcttcgctgccttttctgcattcctgacttctaaaagatgccttaaggcttaagggatgccatatttttgataaggcctctggtaggtaccacagccaagaggaccagagatcatggcccttccagtatgggggcgatagagacatcggggacctgggatttttgttttgtgcagagatctcctgcctgctgtcaccatgagaaacagtggagtggagtggatggatggcctgacttgaagaaagggccctggaaagttttctactttgctattttgaaatttttttcccttcttatagagactttgaaatacttttgtaaatgtgtgtagttgttaatggaactttgccttttgcaaagtcggaaagagtcggcttttccatgtgaggctcgcagagctgaaaggggagctacgtccaccagcctgtgggtcttttggttttttttttgttgttgttgttgtttttttaagatggagtttcactcttgttgcccaggctggagtgcaatggtacaatctccgctcactgcaacctccgcctctcgggttcaggtgattctcctgcctcagcctcctgagtagctgggattacaggcgcccaccaccactcccggctaatttttgtatttttagtagagacagggtttcatcatgttgtccagactggtctcgaactcctgatgttaggtgacccgcacacctcggcctcctgaagtgctgggattacaggcgtgagccaccactcttggcccagcctgtgggttttgatggggatgtcttggctgctgtcttggaggcacagtgtctccccatgtgtgtgtttcttggcccagagtgactcccagtattcctagtccttccccacaggatagtcacatccattatttacttttgttgtcagctgggaggggaaactgaagcctggacacgtctccccaagggctcagtgttcatgggtgtgtaagatccattgactggaccccagaaagcaccctgaggggcagtgcagagagagcccaggaagcccctccactagaggaggcccttggtctggctgaggaccacgtccaccctgggcctccaggcctgcttttcacattaaaggcggggcagtctcctctcaaaggagttctcccttgagcactttgggctctggggcagagttgggctaggagatctgggtgaatcctttagtcacagctagtctcatgttcctcttctgtcaaaggggtcatggccccagtgtgtcctacctcagagttgtcagggtcaaagtaacaggcactgggacaaatatgaagcctagctttgtgcttcctttcaaattcagggcctcctttctactccattccagcctttttttcctgtcagaatccctcaggaaggacctttatcttctggagtgagtggcagttccactgggttcagtgaaagagtcgcccatggggctctgttccccaggagtcctttgtattttggtgaacaaattcttaccaaagcatgagattcggactgtagaagttcagactgcctcagttcagactgcctcatggggcagtctggaggtcagctggcttctggtgtctctcatcacaccactgcggacgctgtctgtagagcagccttggtgtgggtgactctgaagctggagtgatgggaccccagctatccttgttttttaccgccttgtctggcactgtgaccacgcttcagggctgcttctgggggtcttggtccctggatgtgccatttccttgcccttctgaccctcacacttcttccaaagtcttgagcagagttgggggccaatggtagcattgctgtcatctctgggaggagagtgagtatacaagtcagtgacagttcagccaggctcccttgggtttgggaagaggcactgcccttctgtgctgtggatcctgcttgtctgctctggagtccccccacccttgccaggagcttcacaaaccagagacgggctgtcagcaagagctcagacaggatgtggtgcaagtgcaggtgcacgagtttaaccctcagctgcaggagctagtctcaggtgttctggggatgcctcaggctaagaattttgccgactttctgggcttggttggctaatgccaaatgcccctgcttaaatatcacaaggtgctgattctccttttttctttttttcataccaatgtgctcaaactttgagctaggtcttgtgagtttgcctagcactcagacctgtttaagtaacgttctttacattgaaacaagtcaaccgaagctttgtggtgcaggagctgagggtgccccagactcagtgggagccctggttgggccccaaactctcccagcagggtcctcggtttcctcatttgtgaaataaatgagtgggccacgacgttaataagcccaagagaactgtgaaggtggtagtcccttgccctaattggtgctcaataaagttgttggcat

SEQ ID NO: 5272 - DNA, 627 bp, Homo sapiens
ttgcactcctggagtctctctccagccctgaactgtggccagcacagtgtgtcagcctgtaccagctgccggtatgggtgacctgggcacaggcaaggccatcatcatcacacactgtgtgcaccagaactcctcttggcatctccaagccagttcaccattgtgtgaactgtgcactgaaggagctccactgggactcagaggccttggcacaactgcagctgtggaacattgcgatgaggaaagattgggaaaatgacaagagcccattgtctggaattcataggtgcattgattgtcttcagtatcaccagcccagccccatttgaagcagagccaaagtggaaaaatgatttggactaaacgttaactcatggcagaccagtttctgtggttctgttggccaagaaatgtgaccatgggaggatgaatgcagaaacagcagcctcaagatgggccagatctacatggaacatagttttgtaggataaattgaaacatcagcaaaagaaaatgtgaactttgatgaagcctccaggtgcctggatgccaaatagacaaatacagaatataagaaaacacaataagagtcattggccccgtgcctatttggcatcattgcaagaa

SEQ ID NO: 5273 - DNA, 1444 bp, Homo sapiens
gattatgggcaattctgagcttgaactgggacataagcttgtctctcccaaatataatagctgaaataagtgtatgtgctggcatatcacacacagccatctccttacagaataagaaatttagtagcatattcttcaaaacacagttgtgttgttgtagtatgtattttttgtgcgtacatactacttcttcaaaatccactctgtagtttacactaaagcacatctgaattcagaatagccacatttcaattccttagtagccaaacgtgaatagttcttactatattgcatgttgaaatggtcatatctaattttcttttgaagtttcaaggtactgtgttcactgccatattgtaaatatattcttatacagttgaccactgaaaagtaccagtttgaactctgctgatgcacttatgtggaattttttcaataaatacagtcagctctccttacctgtggattctgcatccactaccaaacacagatggaaaatatagtattcgtgggatgcaaacccttgtacatatttcctatggcatcggaccccaaagggctgactatggacttcagtatgtgtggatttgggtatgggtactgggggctggtcctggaaccaatctcatgtgtatacctagggacaattgtatttaatttttacaatttgggaaattaaaatgcatggattatatttccaataaaacaagcaaactgattttaagataatataatgtttttgatgagctatatagctcagttaaaattataatctagtacatttttacatgtaattgtgtataagctgccacaatagtaatgataactcagtggtattcagtaggctcttctcatgtgacaaaacaaaatgggagagaatagggataattatagctagcttaatgttacagatgtgcacagaatgaatacaggttattttgtttgcaatctcagcttttctcgatcttatttaggtaataatgatctatcttgtggtcataaagatattttcctgtattttatcataaaagttttagaattttacttttcatatgtaggcttttaatgtacctaaactttatttttgtgtattgcatcaaaagaacctagtttaattcatttctcttggataaccagttgtccccatgcttaatgagtagtgtatttttccccactgacttgtaatgccacgtttgtgtgtatccagtttctctgtgtgtgtggtcctatttctgtgccttctattttggtgccttaccttaattatcagtctgtgcactgattccacatagtattaatcattctagctctaaaataatgtttgatatctgatagggaaataccttcccatgtaattttgtcttcagaattgtcttgactattcttgtccctttgtcccttcacatgaatttagaattaatttttcttatttgaccaaaaaaaa

SEQ ID NO: 5274 - DNA, 3981 bp, Homo sapiens
gggactcttaacttttgggtacatggaaacatgctgaaaactgaacacaatcctgatcatcactcctgcctggctgtctcctgggaggctgccgggtgccacggagctgggacacagcagagcccgctaggtgttgcagggccctggaggccaaggccaccctgtgtggggtccctgttggcagccaggtccctacacaaacaagtaatcctgtttggcctcctaggttttgcatatgacctgcagcctaatttggggtgtaggggaagctctgctggcccctgctcctttgtatgttgggtgactttaatggctggccacatacccctttctcccagctactcattcactgacttgggtaagttctaagacagttcgcacttagaaaagaatgtgacacatcaacattaacttttcctgaaaagaagagtttgcctaacatggtcctaaagaagcttggaatttataagactttcctttataagatatagtgggggtttttttgggtggaggggggttgttttttgttttttgttttcaagacagagtctcgctctgttgtccaggctggagtgtagtggcatgatctcggctcactgcaacctctgcctcccaggttcatgccattctcctgcctcagcctcccgagtagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaattaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaacgttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcaccctttg

SEQ ID NO: 5275 - DNA, 2582 bp, Homo sapiens
caggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatcttgggccttcttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagtgagtttctactccaagggccatggagtcgccagttcacacagccctgctggaggcatccttccctttgggaagcctgacccacttccaacagtgctccctgccccagttccgggctgctccctgtggccagagaaggcggccttgaaggtgctgggtgaagaccacctgcccagctctccaggcttgctgatggtgggggaggacatgcagcccaaggatcctgcagctcttggatcaagtaggtcttctccacccagagctgccggccacaggtcccacaaaagaaaactgtcggggccaccgctgcagctgcaaccgacccctcccctgcaactgaggtgtgatagagacgagcggcccccaccggcaaagcttccatgtctatctcctgaggcactgttggtgggtcaggcttcccaaagagaaggacgcctccagcatggcaacatgcgtaagaacatgagagtgttaagtagaatatcaaaattcaggagactaagacagttgcttaggaggagaaagaagacacggcagggcaggcgtggtggctcatgcctgtaatccagcactttgggaggcccaggcgggcggatcaggagatcaagagattgagacctgaggagcatctctgcctgcaccatctgggaagtgaggagcgcctctgccctgctgctccaccatctgggaagtgaggagcgcctgtgcccggccaccgcaccatctgggcagtgaggagcgcctctgcccggcccccgccctgtctgggaagcgacaagagcctctgcccagcagcctcacagtctgggaagtgaggagcgcctctgcccaggccctgccccgtctgggcagtgaggagtgcctccgccaggccgccgccctgtctgggaagtgaggagcgcctctgcccagccaccgtcccgtctgcgaagcgaggagtgcctctgcccggcccccctacactctgggaagcgaggagtgcctctgcccggcccccctacactctgggaagtgaggagcgcctctgctcggccaccgccccgtccgggaagtgaggcgcgcctctgcccagccgcccactatctgggaattgaggaggagcgccgcctctgcctggcctccaccccatctgggaagtgaggagcacctctgcccagctgcctcacagtatgggaagtgagaagcgcctctgcccagccgccgccccatctgggaaacaaggagcgcctctgccccgccgccgtcctgtctgcgaagtaaggagtgcccctgcccggcctcctcaccgtgtgggaaatgaggagcgcctctgccccgccgccgccccgtctgcgaagcgaggagtgcctctgcccagcctcctcaccgtctgggaaatgaggagcgcctctgccctgccgccgtcccgtctgcgaagcgaggagtgcctctgcccggcctcctcaccgtctgggaaatgaggagtgcccctgccttgccgccgtcccgtctgcgaagcgaggagtgcctctgcccggcctcctcaccgtctgggaaatgaggagcgcctctgccctgctgccgtcctgtctgtgaagtgaggagtgcctctgcctggcctcctcaccgtctgggaaatgaggagcgcctctgcccggccaccgtcccatctgggaagtgaggagcgcccctgcccagccgccgccctgtctggaaagtgaggagcacctctgcccagccccctcaccatttgtaagggaggagtgcctctgcccagcccctgcaccgtctgggaagtgaggagtgcccccacccggccccctcaccatctgggaagtgaggagggtctctgcctggctgctgtgcaaccttccaagtgtgaagtgacagccttgtgtgtgatctttctgccctccccaggtttgcattttcgacattaaagtttactttttaattt

SEQ ID NO: 5276 - DNA, 1116 bp, Homo sapiens
ggaggtggggcgggtgccgccgaggtagccacgcagcccctgtgcgcctccggcccggcccagcgacctcctctcgggcctgccgttacccggtcccctcctgccaccacccgctacccggccaccccgagtccgcctggggtggccgaacgtatggagctgggctccagggtgcacggggatggggggtgaggagcggggcgttctccctcccagcaccccccagctgactctgtgcccggagggggtgtgtgagccggaacctccagcattcttggggatacgaacttccaacgctgggcagcctcttaaggcttctaggaattcgcatccccagcgccccagccagcagatcggttgcgagagggaccgttcgggtccgcggggccgggaatggaggtgggagggcggggccgaggcggcggccgcctgcggactggagacccgggaggacggacgcggacgcgggctgctcgtcttttacggcccttcaacgcccaccacgacccactcctcttggagaccccgggcgacggtggggctcttgggcattctgagactgcgcttggtggagaccccgggcgacggtggagctcttgggcattctgagactgcgcttggtggagccccctactggccagactggatttctcagcctgcgactcagccccaggctacacgaaagaagccagacctggcttttactgcctcctgaggccttcgtcttgttcacactgagtgtccagtccctccaaatccggctacactctactggcaaggagcacctgggccatgttttagagatcatccgaggactaaccccaaaagtttatgaagagaaagcagaggccgagctgaagagatggacccgggtcacacccaggtaaaggcaggatctaaactgaaactggtgtcagatctggttgccttgcacccctgatatcaggtgaagcaacactgggcaggatagagcagagtgaggtcagagtgtgaagatccagcctgatgcccaaactgacgcctcttcattctcccctgctccatctgtaaacgtcacggttaatccatctactttattgcattatatagagaaataaatgaaatgtcatagctgta

SEQ ID NO: 5277 - DNA, 1393 bp, Homo sapiens
ctctttacccgggacacgtccccattgcgacaggcctccagcagttcccgtagggccccgctcactgctgggacccctgtcccaggtcctgctgccccaggccccagtggtgctgtgctgctaactccggccgcctcggggctctccgccaagctcgatccaggggaggatggagaggaagatgaggaagaagtcggggaagaagaggacgacggtgaattgttactgccactgccggctgggttgggagcgaccccagcggcagatgaagtagaaaccgctgggaccacgggagcggcggcgacggtacagattgtgctggtggtactgcaacagctggtaccgtcaaccgggtccggggatcggggcctgtcgggcggatcccgactgccatccccctccggcagcgctaggccgtgccgcggggaggcgaagggggccaggccgctggccgtgggagaggctggggtggtccccggggccaggccagggctgagtgggggaggaggtggcggcggcggcgctgaagcccctggggcgggctggagctgttgttgatgatggtggtgatgatgctgagagcgacgcgacgccgccatcttcggactcccctagcactgtcactgcggcaacggcccccaccgcccgccctcacttccgactgtcggaccaatcagcatccagcgcacaggaaatgatgctaggcggggtagcaggggccaaagagaaggagggaagtattgggagctcagagaacagccaagggaacggggcggggctttgtcactgagaggcgggctttgtgacgtggtggcgggccggctggagagatttgaatgctggaaccagcttctgcctagatgggaaacatttcctgcatttctcactttcagtcggctttctttgccctgctccgctctgtttcccttagtctccctttgcttgctccagagccagctgttgagatgcagatcagagcaagcagggaatgtgtccgttatcatctattaagcgtccttgtctgaaaaatggaacttatagtaccaacctcacagaattattagcgggattaaaagagctaacagacaaagcgctctgccagtaaaacacaagtataattagcccgttggtaattttttaaattatagtatttcttttccaggtgtccccttgagctcttgtcccttccctataatttttctcaccctatgtgctttaattcctcgtttttaaatgctggttcagattgctaggattggcgttccagctctgccatttgttgtttatatatgtacttgctatttcatcactctatgcctgtttttctctgtaaaattgaaataacaatagtgcaataagtgtgaattattaaaattatgatttttttttccta

SEQ ID NO: 5278 - DNA, 1989 bp, Homo sapiens
cattcttgtaacccaggctggagtgcggtggcgtgatctccgctcactgcaacctctgcctactgggttcaagcgattctcctgcctgattctcccaagtagctgggattacaggtgctcactaccatgttggctaattttttgtatttttagtagagatggggctttaccatgttggtcaggctggtcttgaactcctgacctcaagtgatccgcccacctcggcctcccaaaatgctgagattacaggtgtgagccaccgtgcccagtctaaggcacacaatttgcaaaggaaattgaggctctcgcacaaatccagtccaccctgtacttacacccaacatgcaggaggtgttgactctcatcccttgactcaggacatgtgtgtaattgttaatgtcatcgcaaggccttttgacaagtgtaattgtgacatataccttggcctagcatctgagttatttgttgtttcctgggtccagctcacagtgccatatcactggatccagacccttggtaatgtgattctattctgccttgatacagcccacaggggtcattgtgacatcgctgggcattgcacctaggtgatttgagtctcctcttctgccttggtgctgcccacaggtgtattgtgacatattgctgggcgtatgttatgtgactcttgcttgtgccctaaacacataggccattgtaacattgctgagtgcaacacccaggtgatgtaacgcttcaccctggacctgtctacagagggcattgtaatatatgtcttcaccaatcacccaggaaatgtgactttttattcctccctgttctgtactcacagggggtattgggacatattgggcccagcacctagctgatgtgacttttctttattctaggttctgacaacaaaggagattgtgacatattgctgggcctaacactaaggtgatgttagttatttgctttggctgtgcccttggaaggcattgagacatactgctgtgcccagcaccaagatgatgtaacgtgactcttctgcttcaggcctgccaaaagaaaagattgtgacagatcactggacccagcacctaggtgatatgactctcctcatttgcctgagacctgcatattttagacattgtgatatacaactggaacaaacacctaggggttggaaggctcctgcctgagtccctcccacaggaggccttgtgatgtttttttgtttgttttttgttttctttgagatggagttttgttattgttgcccagactggcatgcggtggcgcaaccttggctcaccgcaacctccgcctcccgggttcaagcagttctcctgcctcaacctcccgagtagctgggattacaggcatctgccaccatgcccggctaattttctatttttaatagagacggggtttctccatgttggtcaggctggtctcaaactcctgaaatcaggtgatccacctgccttggcctcccaaaatgctgggattacagttgtgagccactgcacccagctttgtgatgtatttctgcatccatcatgcaggagataaaactctgtatttttgcctgcattctgcccacagggaagattttgacatattgttgggcccagcaaccagtcgttttgtctgtcatatctgggcccagcacccaagggatctcactcttctacctgtgccctgctttcaggagggattgtaacatccctggtcaagcccccagtgatgtgattctcctgtttgatgcctgccctcagggaggattgtgacatagccctggcccaacacacagttcatgtaactcttgaatttgctctttacatacaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacat

SEQ ID NO: 5279 - DNA, 2488 bp, Homo sapiens
aatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggtatgcaccaccatgcccagccaattttgtatttttagtagaggcagggtttcaccatgttggctaagctggtcttgaactcctgacctcaggtgatctacctgcttcagcctctcagagtgctgggattacaggcatgagccaccaagcccggcctgaaatacatttaaataaatgaagatggagaatcagacattactttcatttatctgaatctggtgtagtttaattaatctgtaattgtaagtctttgaatcatatgtcaatattctattttgttagtcatgatttctaagtgttacataactgtggccccagccactttatattttggtatcatgacagaagactctgattgtggttattttctacctatgcatttattcttagtgatatatgttggttaaattatggcatagttttaaaatacatgacaaaaatagctaacagtaaagaaatgtctttgtttctggttgaataaactgaccacgcaaggttccaatttaaaataaattctaaacgaatcatgttattttccaaaactgttcctcctctcagtaaatgaaatcaatatccacccggttaccccaagacagaaatctcaagatcatctgtgactccttcctcttcatctgccacaagaagagtagcttctatctccaaagctagtctctgatcagtctacttctcttcctatagcctctgctttagttcaaatctagaatcctgctgtggtggtgctgtggcttccaagttcatcttcttccaatccgttctctaaactacagtcttgctctttctaagactcagatcttataattttacttcccttcataggttgaatttaacctgctaaatcacataaaatttttctgaagataccagcctttctgccttaatcaaacacattagccaaatccatagcattactgggataaagcctgaagatcccaaattgataaggcatctggattccctttgataacagtattcaataacaatgaacacctactgagtatactattccaagcatttaaagtgtatcaactcttttcacaaaatcaacaataattattattgctaccatttattgagagtctactttaatccaggtgttacatattcatgtattcattattattacctttttttttgagacgaaatcttgctctgttgcccaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacaggtgagcccagcctattgttacctttaaaaccaccctgcagggtagctcttactgtctccatgaggaatatcagaaaagggaaaggacttcctggagggctggttctgcctcaagccaatcagctgacactaagcagtgaagccggaatctgaggtccctctgcctgccctggtctttgctcaccctgacaaccagacacctcactgtgtcctgagcagcatagatgccacacgcacagtgccacatagagaagggtgatgtaaatgaaaattaaaacactgtgacaaagtcaagcagggcatttgtttttgttgttgttaagttatttttggtagatacagggtctcactatgttgaccaggctggtcttgaactcctgggctcaagcaatctgcctgcctcagcctctcagaatgttgggattatagacatgaaccactgcacccggccagtgtcagtctttgttccctacaagtgaaatcaaaacagcctcacgcctgtaaacccagcagtttaggagcccaaggtggaaggatcgcttgagcccaggagtttgaaaccagtctaggcaacatagtgagaccctatctatacaaaaataaaaatagcctgggcagggtgactcatgcctataatcccagtactttgggaggccaaggtgggtgcatcacttgaggtcaggagttcgagaccagcctggctaacatggagaaaccctgtctctattaaaaatacgcctgtagtcccagttactcgggacgctgaggcaggactgcttgaacctgggaggtagaggttgcagtgagccgagatcgcgatactgcactctagagcctgagtgacagagtgagactccgtctc

SEQ ID NO: 5280 - DNA, 307 bp, Homo sapiens
gccgagcgcggtggcacatgcctgtagtcccagctactcaggaggctgaggtgggaggatagcttgagcccaggagttctgggctgtagtgcgctatgccgatcgggtgtccgcactaagttcggcatcaatatggcgacctcctgggagtgggggaccaccaggttgcctaaggaggggtgaaccagcccaggtcagaaaaaagaactatgttaaatctactctgtgatctatcagtgaagtaataaagcttgaatgacagcacatctgtttacagcatggtttactgactattttaagcccattg

SEQ ID NO: 5281 - DNA, 1867 bp, Homo sapiens
gtgccctcgagggcggggcgctcccggggacctggggctgctgctccccgagccgtgctttgcagaggcaagcgtctatgatttaaatgctagctttgccgcttactggctgaaagactttaaatgacaataacaaaaaatgaagaggatgatgatgatgatacaagataccattgcccgtgtgtaccagacatcatgctaagtgagtgctacccacatcatttttctttcttttcttttcttttcttttttcttttttttttttttttgatacagagtctcgctctgtcacccaggctgaagtgcagtggcgcaatcttgcctcactgcaacctccacctcttgggttcaagggatcctcccacctgagcctcctgagtaactgcgattacaggcatgtgccaccatgccccgctaattgttttgtgtttttaatggagatggggtcttaccatgttggccaggctggtctcaaactcctgacctcaagtgatcctcccaccttggtctcccaaagtgctgggattacaggtgtaagccaccacgcccagcctttacccacattatttcttttttctttttaggaacagggtcttgctctgtggcacaggctagagggcagtggcaaatcatagctaactgtagctttgaacacctgggctcaagcaatgctgccacctcagcctcccgagtagctaggattataggcgagtgccaccacacctggctaacttttaaacattttttttgtagagacgagggtctcactatattgcccagactcctgaactcaagggatcctcctgcctcagcctcccaaagcgctgagattacaggagtgagcttccgcgcccggccccacatcatttctttcacacaaactcaaatctttcttgacctcaaagggttgtcctgcaaatcaaaatcaaatgatgtctccaggagaaagagcttaattcccaccaccctgagagtgggctggatgtcacgactcgtgggcggatcgcttgaggccaggagttcgagaccagcctggccaacacggcgaaaccctgtctctactaaaaatacaaaaaattagccaggcatggtggcatacgcctgtaatcccagctactcgggaggctgagacaggagagtagcttgaacccaggaggtggaggttgcagtgagccaagattgtgccactgcactccagcctgggtgacacagcaagactccatctcaaaaaaaaaaaaataagtaaataagaaagaaagaaaggaaggaaggaaggaagggaggaaggaagaaggaaggaaggaaggaagaaaatgtagggtggatgcagtggctcacacctgtaatcccagcactttgggaggctgaggtgggtggatcgcttgagcccaggagttcaagaccaacttgggcaatgtgacaaaaccctgtttctacaaaaaaaaaaaaaaaaaaaaaaattatcctggtatgatggcatgcacttctagtcccagctacttgggaggctagggtgggaggattgcttgagcccaggaggcagaggttgtagtgaaccaagatcacgccactgcaccccagcctgggcaacagagcgagactctgtctcaaaaaaaaaaaaaaaattagcctggtgtggtgctacgagactgtagtccctgctactcgggaggctgaagtgggaggatctcttgagcccaagaagtcgaggctgcagtaagctgtgatcgtgccaccgcactccagcctgggcaacagagtgagactctgtctcaaaaaaattaaaaataacatgaggagaagctgggaaggagggcttaaagggactctctctgctttctttgtactttcctgtaaatataaaatt

SEQ ID NO: 5282 - DNA, 9771 bp, Homo sapiens
gaatggcgtcggggttggagggttggaaggtcgggaagtgaaggactcgcaggcatatttaacaacgcaaagttgctaggagttggtaccagcgtttgggaggtagaggtggcgctcatgcatatttgagacaacatctggatggttggggagaacggtgatgccacactcaatcagaaactatgctactgctgaagaggtatattgagccctgcctggttaacctccagtgaggttattagagaattgggagaggctcaaatcagcatcctgcacctagttatcaaaccattgtgaagtcttgattcctggatggccagaaaacttgtcattggtcaagagcaacattaagatctgcctgttactcatactgatgcttcctgcccagcaagttcatcagagggcgaggatgaattacggttgccatgaatgtccttgtgaggcagttgggaagccttggctggattgtgaaggatatttgaaaagtattttagagtccaccagatcatccatgtgagtgaccatgcagcaaaagaaggagggtcctctcagtgattaaggattatgaagtattaattcttccactgatatctcaaaaggtgatctggacaaaggaacaggtatctcagtagagacggggtttcaccatattggccaggctggtctcgaactcccgaccttgtgatccgcccacctcagcctaccaaagtgctgggattacaggcgtgagccaccgcacctagcgatgcttaaatcttctagtccacaaatatgagatgtctttccacatatgtagatattcctcaactcctctgacaaatattttgtgttattcacagttcatgctgaatttcactttatcccacagtattttgccttaataatattgtaaataaaaatgtttcaatgatgtcacttttgacttctttaataatatatagaaatacaactgatttttggattgtaatcttaaatcacaaaaacttgctgagatgatcttgttattggaatccaaatttattggatccactggggttgtgtatgtacaaaaccatgtcatctgcaaaaggttttgctgcttcctatttaaaaaattttatttccttccatatgcaatgcaattaatgtcacagatacttccagtacactgttgaacagaactggcaagaatgttttatcctgtccttgctcctcttcttacagagaaagcattctttaaatactaagtgtaacattagttttgagggttttgggttttctgttttgttttgctttttagagacagggtctcactctgttgttcagtcaggagtacagtggcatcatcatagctcattgtaaacatgaacctcagcttcccaagtagctaggcgtacaggcatgtgtcatcacatctggattttttttttttttttaagatacagagtatccttatattgcctaggctgatctcagacttctggcctcaagtaatcctgctttggcttccccaagtgctgggattacagccacggcaccaggttctagttgtgaattcttaaaatatgccctttactaggttgtggtttacttcttagtttaccaaatactttttccaccttctattttttttttctctctctttttttttaaacatagtcttgctgtgtcagccaggtccaagtgcagtggcacaatctccgctcactgcaacctccacctcctgggttcaagtgattctactgcctcagactcccgagtagctgggattacaggcacttgccaccatgcacaggtaattttagtatttttagtagagatggggtttcaccatgttggccaggctggtctcgaactcctgacctcaagtgatccgcccacctcagcctcccccagtgctaggattacaggcgtgagtcactgagcccagcccatggctattacaaagtcaaaaacaaacaaacaaacaaacaaaaaaacagattctggtgaagttacagagaaaaaggaatgcttatacactgttggtaggagtattaggattacaggcgtgagcctccacttccagccgtccacaatctattgagatgaccatgttgttttcttccttcagtctgttgcactaatcatttccagctgatgaaataacgttgcattccagggatacactgtactgggtactggtgtacattcctgtttatatgttactgtatttggtttgccaaaatttactaggaaatttcacagatccactcataagcgatattatcagagttttccctgtgtatgatgtttcactttggtatctagataacaatagcatcatagaaccagtaaaaaatattacatgctcttccaagtttttaagacatttttatcgaattggtaattttcatgtgtttggtataatatacaaaagaatacatttgaactgggaatttacatgtgtgtcaggggcaggggtgagagtttttaaattaccaatttattgtcttcactttgttcttgaatgagttgtggtagtcagtgtctttctaggaatttgtctacttccacaaagatatttgtcaaaatactaatcccttgtatggaataaggtcattaggaacatcacgttttacatttctcattttaataaagctttattttatgaataagtcaacgaagtgctgtgtttctcaattatttttaattctctatttccacactaaactttatatcctttctgctttgattttaatttgttctttttttactgtattttctaaagttggaaagttaggttagtaatttgaagtacttctcatttcattacaatgttcatagctattaatttcactgtaagcgttgctttcacacatctcacagaatttgatatgttgtttctgtattttcattcacctcaaagtattttctgatttccttataaattctcctttgacttgttggttacgtaactttttttttttttttttttttttgacagtctttgtcgcccaggctgcagtgcagtggtgtgatctcggctcactgccacctctgcctcctaggctcaagtgattctagtgcctcagccacccgagtagctgggactacaggcgcacaccaccacatctggctaattttctgtatttttagtagagacagggtttcaccatgttggccaggctggtctccaactcctgacttcaagtgatccaccctccccggcctcccaaagtgctgggattacaggtgtgagccaccacactcagcataactttttaaatttgcacaaatatgtatagttcctatctctgtgttatttctaatttcattaaattttagtcatagaacatattttgtataatttcaatatttttaaccttcatttggtttgttttgtatgatgttagtgcagacattccagtttttttgtggttgctacttggatatttctatttccatcctatttctttcaacacttttgtattttataaactgcctacaacagacaccttatagtttgattgttttttaaatatccacttggtcaatcagactggtttggattgcttgatccatcagtacagctggatttaaattttccattatacattttaaaattctatgtctatcttcttttacagaatccctcctatactactttttataagttaatattttctaaaataatgtattattatctttaacgatttttccctctattatatgaaaatcctttttagtggttgcagtagggcttttttttataattgacaagtaataattgtatataattccagggaactatctgatgtttttgtatgtatacatagtgtaataactaaatcaagcacattaacatatccataacttcacctacttttgttgtgacaactttaatatctacttataacaattttaaaatatacagtcagtgacaatggtcaccatgctgtgaaatatgtctaaaacttattcctcctaacagaaaattggtactctttgaccaacgtcttgcctttgcccatctctccaacacccacatcctggaaaccataacatccaactttctacttgtatgagttagcctttcttagattccacatacaaatataatgtagtatttgcctctctgtgcctgtcttacaacacttagcatagtatactacagattcatccatgttgtcacaaatgacaattttccttcttttccaaggataaaaaatattccaatatgtatatacaacacatcttctatgtccattcatctgttatgaaaacttaagtcttttccatttattagctttgtaaataatttcaaaataagggagtgcaagatctcaacatactgcttcaattcctttggatatatacctaagtagagattgctagatcatatagtaattgtacttttagtttcttaaggaaccaccatatagtttcctaaattggctatactaatttatattcccactaacagaatgttgggacttccttttatccacatccttgccagcacctgtctttcatccttttaataatagccattctaaaaggtgtaaggtaatatcttgcagttttgatttgcaactcactaatgattagagatgttgagcatttttttcatgtatcaatcaattggccactcatgtcttcctctgaaaaatttaagttgaggtccttttcccccttttaaagacagttgttttcttgctattgggcttgggtttcttaatacattttggatattagccccttatcagatatatgatttgaaaatggtttctcaaaacccgtgtcttcattctgttaactgtaccctttgcagtgcagatgctttttagtttgatgcaactcaagttgtctgttgcgggaagtcagggaccccaaacggagggactggctgaagccatggcggaagaacgtggatcgtgaagatttcatggacatttattagttccccaaattaatacttttataatttcttatgcctgtctttactgcaatctctaaacataaattgtgaagatttcatggacacttatcacttccccaatcaatacccttgtgatttcctatgcctgttttaatctcttaatcctgtcatctcgtaagccgaggaggacgtatgtcgcctcaggaccctgtgataattgtgttaagtgcagaaattgtagagcatgtgtgtttaaacaatatgaaatctaggcaccttgaaaaaagaacaggataacagcaatgttcagggaataagagagataaccttaaactctgaccgccggtgagccaggcggaacagagccatatttctcttctttcaaaagcaaatgggagaaatatcgccgaattctttttctcagcaaggaacatccctgagaaagagaatgtgcccctgagggtgggcctctaaaatggcccccttgggtgtagctgtcttctatggtcgagactgtagggatgaaataagccccagtctcccatagcgctcccaggcttattaggacgaggaaattcccacctaataaattttggtcagacaggttgctctcaaaccctgtctcctgataagatgttatcaatgacgatggtgcccgaaacttcattagcaattttaatttcaacccagtcctgtggtcctgtgatctcgccctgcctccatttgccttgtgatattctattaccttgtgaagcacgtgatctctgtgacccacctcctattcgtatactccctcccctttgaaaatccctaataaaaacttactggttttacggctcagggggcatcacggaacctaccgacatgtgatgtctccccaggatgcccagctttaaaatttctctcttttgtactctgtccctttatttctcaacccggccaatgcttagggaaaatagaaaagaacctatgtgactatctgggcaggttccctgatagttgtctggctgtttttgctgcccatgcttttaaggatgtatccaagaaatcattgcccagaacaacatcatagagcttttcccctatattttctactagtagttttacagtttcaaaggcaacatttcaggctttaatccattttgagttgatttttctatatgctatgagaaaatggttcaatttcacatatagatatacagatatctcaaaacaatttatttatttatttgtcctctccccattctgtgtgccacttttgtcaaaaatcaattggatggaaatgtatgagttatgtctgggctttcctgttccactggtcagtgaatctgtttttatgctggtaccacagttttttgataatggattacaaaatcaggtagagtgatgcctccagctgtgtccttgttgctcaagattactttgattatttaatgtcttttgtagttccatacaagttttagaattttttttgtatttctgtaaaaaaaataaaaataaaaaggacattgaaatattgattacacagaatctgtatgtttcttttggcagtatgaaaattataacaatataaatttcccaatccatgtacaaagaaaaatttctatttttgtaatcttcaattcgtttcatcaatgttttcactatacagatctttaacctacttggttaaattcattcataagtttgtttacttagtaaatagtgtaaatgtgattagtttcctgattacttttttggatagattgttgtttgttagtgtatagaaatgctacagacttaattgtcaattttgtacgtagcactttttatggaattcattttattagttctatagtttttttttttttaatggagtctttaaggttttctagctataagataagataatcaggagaggcaagttttttcttcttttcctacttagatgtcttttatttctcttgcctaaatgctcttgctatgacttccagtacaacactgaacagaaggagaaaaaatggcatccatgtcttgttcctgatcttagagaaaaagccttcaactcttcggtgttaagatttcagctctgggccggtcatatagggcctttaatgtgttgagacatcttccttttatacctaacttgttcaggtttttatcatgcaaagatgttaagtattgggccggggactgtggctcatgcctgtaatcccagcactttgggaggtcaaggagggtggatcacctgaggttaggggttcaagaccaacctagccaacatggtgaaaccctgtctcaactaaaaatacaaaagttagctaggcatggtggcagatgcctgtaatcccagctgctcgggaggctgaggcaggagaacccaggaggcagaggttcaagcgattctcctgcctcagcctccagagtagctggcattacaggcacataccaccacgcctggctaatttttgtatttttagtaaagacgatgttgtgccatgttggccaggctggtctcgaactcctgacctcaggtgatgtgcctgcctcggcctcccaaactgctaggattacaggcgtgagccaccgcacccagccaactatgtacttacttttatcagcgagttttatactcacgttttcatgtttctaattagcactcttttactacagcttgaaggactccctttagcaattcttcccgtgcaggtctagtggtggtaaactcccacatcttttgtttgagaactttatatttctccttaatttttgaaacacaggatagttggagatagtattcctggatggcagtgttttcctttcagctttttgtatatatcacgactgccttctggcgtgaaagttttctggtgaagtctgctgacagtcttccgtggatcattttgtatgtaagaagagactattcccttgctgctctgaagattgtctttaacctttatttaattacaatatggtttggtgtgagtctccttggattcatcatacctgatgttcgagattcttagatctaaatttctatttccttgccagaattatgaggttttctgacattatttcttcaaatatgttttctgtccttttccctctatcttctccatctggtaatgtataaattattcccctttgaggatgtctcaaaagtctcttaaactatcttcaatcttttttcttttttctcctcacattacatgatttccaatggcctatctacaagtttgatagccctttcttctgcttcatcgattcttctgttggacacattaaatttttgagtccagttattgtattcttcaactttatactttttgttatcttttatttctttatgaaaattctcagtttgttcatgcattgctcccatgagactctttatggttgctctttttaatttcctgtcaggttaatcacatatcttcatttcattagggttggtttctgaagacttatcttcttttatttagagtgtttctgtgtttcatttttcttgactcaatgtgttgatttctgtgaattagataagataacctcctctaccagtcttgttaaactggccttcggtaggagatgtttctctccaaataacccagtgaaagatctagatgcctctttgttcttctataacccacttttactggcctccagaggtgaggatgaactaagtcataattttgccttgagacaggtactggtccctcataatgcagctggaagggttagtgttatatgtgtgttccagttgcttctttcctttgaagaaactgagagacaaagtttacatcatactgattttgcaccacaccaagtagagaatttgtggtagatgtctgtaatctctttgagactactcaatctgaaactgaggcgataacttctgaatgtttccaagtttgaaaatcacctattcttgctggacgcggtggctcatgcctgtaatcccagcactttgggaggctgaggcgggcggatcacctgaggtcgggagttcgagaccagcctgaccaacatggagaaaccccgtctctagtgaaaatacaaaattagacgggcgtggtggtgcatgcttgtaatctcaggtattcaggaggctgaggcaggagaatcacttgaacacgggaggtgaaggttgcagagagccgagattgcgccactgcactccagcctgggcaacagtagtgaaactccatcaaaaaaagaaaagaaaaaagaaaagaaaagggggggaggggaggggaggggaggggagaggagaggagaggagagaaaactacctattctcagtggtacaggagactcaggaatgaagagctctttcaactccagagctgggtgatacaggagccagtaccttgaatgagggatgtaaaatatggggcagtcagtatgtgtacaaattactcccagggaaagtctgcagaaacgaattcatcaccagagcaggccaagtaggaaagcatgggaagtacccaatctcacaataaggcacagtaagtcacacaacctcctgccagtaaggatttggaagcctggacttattgctggagcaatctgaagaagaaattgcgaagaacattcatctccctttaaggcttcctgaagtctcacaaactcacttcacacagaatctccaggccaatatgttgttggaacaagactggtacataggaaggcaggtgaagtacagttcctcacatatagcataagagaggtctgtctcccagtctccttccagggagagattacaaggttatacatatctggagaaagctgggaaaaggcatggtgggttttgacccttccatttttgctcactgaggcctcaaatctctttcaagggaaactatagacctggattaatcactagagcaatccag

SEQ ID NO: 5283 - DNA, 3509 bp, Homo sapiens
gggggcggtgcccgaggaagccaataggaagaggagtcggccaagagcgacggctctgccgtccagtcggcgccggccattcggccccgcccatcaggaaacctgaggaaaacggattcttgggccctgagttgtgggccttacctttcctttcttctttccgtttccggggaagggaaaaggaagtgttgtttggatctgaggaagtttgcacagtagctggctgagtggtagctgtttgtcttgtagcaatctttaaaaagtgttctttggggtcgggcgcagtgtctcacgcctctaatcccagcaccttgggaggccgaggcgggcgaatcacctgaggtcgggagctcgagaccagtctgaccgacatggagaaaccccgtctctcctaaaaatacaaaattagccgggcgtggtggcgcatgcctgtaatactagctactcgggaggctgaggcaggagaaacgcttgaacccgggaggcggacgttgcagtgagccgagatcgagccattgcattccagcctgggcaacaagagcgaaactccgtctcaaaaaaaaaaaaaaaaaaaaaaaaaagtgttcattggtttcccagctaccttttgaagaaaaaggtaatggaaattgattcgcatttcttttttaaagattttcttcatttggcgtgaaaggtaggatcttgtacatctccagggtttggggtagggagaagaagagacgttaggagaagcactgaatatggagatgggatcggacggctagtgggatgaagaggctggggaaatagaatgaatagacagagaaaatgattgacttcaactatccaaaatataaaaaagacaagacagagaaaatgaggaagaaaaggaatgaacctggatgggatccatacagtattaagaacagggtattgtttcatttggattcacttactcaaaacaaaactacagagtactctgcgaacagaagataagtattcattatcgagcgagacaactacgatctctgcattcactgtagttacctagcacgtgaagatattgaacggacaatattgagaaaaataccatgatatgggaagtgcattggagcacatggtaggagtagctaattaaaagcccagaaggagtcaggaacaattttctaggaggaagagatgtttaaactgaaacccctgtgttgaatagatttaaaacaggccaagaggggtaaaattttccaggtagaaggtccaaatccgtgtaacagctgtgtaaaatgccaagcattgggtctgttattatgaagggcttagttggcccttagggcactggtcagatttgtattgaaagatctttggataaaggaggtaggattgggagggaagatatagagtcacaagatttgggagctgtttaggaaatccagttgagaaagaaatgatcatagccttgatacctcattattccattttggctaggtggagttaagaaaatggaagagaaaggcaattttttgtgcattataaataagaatttggggagtgactagagacagaagataaagagaacatagctcaacagttaacaatgatgtgtttgaagagtgtttaaaaatgtgaagatgactagcccagcacacacacctgtaatcccagctacttgtgaggctgagaaaaggaagattgtttgctgcagcctcgactatctgctctcaaccaaacctcccacctcagcttcctgagtagctgtgactgcaggcgcacaccaccatacccggctaatttttgtattttttgtagagtgggggtttcaccatattgctctggctggtctccaactccagagctcaagtgatccactcatctcggcctccaaaagtgttgggattacaggtgtgagccactgcacctggctgtttttttatatttctatgatgtcagtaaactccccttcattcctctccttctcacatcttgaaaaaaggcttctacagaccacagaggccttggtgtgagtggtgggtttggatgtagtttttatggtatatgtgtggaaaatagagggaaggagctgagttttgcttttaggttgacactaagataaaaacaaagagccataccttcagaatggagacacaggatttaggagcagcaggaagctgaagtcagaggggaccataaaatggcaactccccatgtattcacggaaattttgcgcagggcaagtagactgttccaaagggggaaatagaagctcaatactataagagtagaggcacaagcagctaattgggtaatagtttgaaatttagggactggcttttaaaaatctaatctatgaaacagggtgaattgaagactttttaaataccagtaaaataataatcagaattttttattgaagttagtaaacataaaattaacagaatagaaaaacaggttaacataagttggttagctggaatccaggcctgaaagggggaagccagtaagaagcctattcctttcacagaactccaggtggtagtctcaggaatacgttaaaagcagcatgggtctggtgcggtggctcatgcctataatcccagcactttgggaggccgaggcaggtggatcacttgaggtcaggagtgcaagaccagcctgaccaacatggtgaaactccgtttctactaagaatacaaaattagctgggcttggtggtgcatgcctgtaacctgagctacttgggaggccgaggcaggagaattgcttaaacccgggaggcggtgtctgcggtgagccgagatcatgccattgcactacagcctgggcaactatagcgaaactctgtctcaaaaaaagaaagaaaaagaaaaaaagcatgaagctgagactggaggattggttggaaaaaaaaatggagtatgaagctgagactgaagattggttgggagtcttgaaacaattagatgctagatctcctgtcatactttgtggaggaccaggagattataaggtgaaccgagaggatctagactctaccactaggcacaactgagagtagaaatgaggtcatactgaaatggggaggataagctcaggacctcgtcttacttggctcccagaacgctggcaatgagtcatatatcccctgggcattaaatttaaagactttttcaggcaagctaatcagaaaagagaggaggccccaattgaaaaagccagtttattaatatagacctacgctgacacctactagctgataagctagtccctgcacgctgagcttctgatcaattttagcattaccaaactttggaataaagcctcagctctgaaaaagaaaaaaaataaagcaggagcaaacatactatgtagaacccagagaaaaatttactcaaaactgtaataaactcttgacattttatatctattaaaaaaggaatgtaaaaaggaatgtgagtcatcaaatttagattctttaaggagaaaattcttaaagttttaattaatttttaaatagactgcagaatcaagatgat

SEQ ID NO: 5284 - DNA, 2149 bp, Homo sapiens
ggaaggtggggcagatcccaactggcccctgtccctgggctgcaagctgacagcaggccagggaagcagtgaggccttctgccctggccttggggagaaggagtgcatgtgtgaggctgggatacagtggccctggagtggggctagggctcatcgccagcaccaggcgcggggaggatttaaaaccagagtcctgtctctgagccaccccacagggacgcttgatccaagcctgttaaggccgtggaactcgagggtaggcagtgggctgggccaccgtgggttcaggatggaggtgtgggggctgccctggaggaacgttagtgtttctgagagcaccttagtgttgctctgcctcagccagctgggcaaggagttggggagcggggaggaggccggcgccatggagtggggaagggagccgtcactgttggggatcagccgctagtgtaaacgagcatctccacccacccagataagccccccacccaagtgtggagccctgctcagggagtacctcaagggccccggcctgggtggcgccagcaggcttggacactgccctggcagcaggggccccgtggaaggcaggatacccagcagggggtgccacccagtgtggatggaggggcagggcgggggcgcccctgagtcactgggcagaggcacgagcacgtccacatagctgagcaggaagaagcccgactggccgtccagcatgccctcgtatcagttctcgttcatctggttgatcagcatgaagacatcgccctcatggaagcccagctccctatctttctccggctccaagtcatacagcccttgcagctcggctggtctaggggcggcatgctcctgctaggagtccagatggacttgtcgtaagatcggaaagaggacgaagctgcgatcttggggactgtggtgcaggggaagccccggttggactgctcaggctttccgaggtcaaagcactcccggggcttgggcttatactcccgcctgggtcgtgaggaagcttcccggatcctgcacttgaacttctgggccagctggtccaggatctgcacggcctgccggtggtagtccagctgcgcctctgccaaggccgggagttgactcacctactggatgtcggtctccaggaggttgtgcatgctggtttctgccacctccttggactcctcaaacttctccagcgcctggtgcagctcctcttcggggatcttgccctgccgcttcttttagtcaaagtccaggcggcggccctccagcttctgcaggtggtgctggatctccttcaggtctttctcacataggttctggagggggtcaatgaagttatgcttgacctctatgtccagggagtccttcacctctgccaggtgcttcatgggctcgccggcatccagcagtgcatcgctgaagttggactcgtcgcgcagctccttcccatggcggatcaggcactcgcccaggagcccccctgactgcaggtagccggggttcttcacctggccccggatcttgcacgcggtgttgagcatggtcagtttagcctgcgaggctgggttgggctgcgggtactcgatggtcctggacagtacttacgtcaccgccttgctgatgacatccaccttctccatctcttcgaagtcatcatccagcttggtcccctcagcccctccgaccttctcactgaccagttggctcgccttgtagaactgcttcttcagcccggcaaccgacatgctgcctcctgccgcggaaccttccgcccagacccccctgcccagaccccgccagcgacaggctcccgggcaccaccaaccctctgcgcgcctcagcggcccccatcagcaccgcctccaccacccgcttgccagctcggcgcccgccccggcgccgcctcgagttcatgattctttagtctccttcaatctagatctgttcccaggattgtttaaaagcatactgacaaacctttgagactgtaaatgacctgaggtatacattatctttacttgagaatagtaatttttcaatatgcattaaagatcattacacatgagctaagacaaatgagctggtctacttactttgtatataaatgtgtaaactcctgaagacttccaataatgaactccaa

SEQ ID NO: 5285 - DNA, 947 bp, Homo sapiens
tcaagtgttttgtttgtttcccttggataaaagtgactccgatttttaatggctcctctcaaagattaacatctcttcactaaatacagaagaattccatatgtaatgaatttccagcctccatgaaaacaaaatggactctttcatgctgtctcaacatatgaatacattgctctgtcacctgggtgttattaccgacttaaatctgaaagaagctgggcacggcagtggtgtgtgggtgcctgcagtcctgaggagctgggactgtttcccgaacaatgcctttccaccacacacggtggttgtgagggccagctgaggcaaagccctcaggaagaccactcaagcccaggagtccagcctgcgcaagacactttttttaggcttctgtcaccacaaaatgttacttggaaaactagatcccagcagatgacctgtacttctctgctctctcccctactgcaaagaggcagtgagggcagcattagtaagcctgactcaggggaaggtaagtggcctgcagagaaatggtcctaggtccgcaaccgaggcgagtgaacttgtcggacagatgaagactctaactggaagaaacgatcagcgcattcacggatgcaccaccatccagaaatctcccggtggcttccatacaaaaactgatgtttctaaagatggaaagaacaggtctaggaggcagaagagtatctcctagcaaagtgttctgtagctcaaagggcagtcaggagcacgtctttgaattcctcgcagacgatgtatccatcagtcctgtggggacacaacgcgatgtcaaccctcgaacctgctgcctgctctgcctctcctccctccccagtttgtggaagacagtgggccacatctgagcactaggggtcctgaaggatgtcgcgggtcagccagtgtcccacatcctccgtgcagaaggcagg

SEQ ID NO: 5286 - DNA, 3562 bp, Homo sapiens
gattacaggcgtgagccactgcgcctggcctattgcttttatttttaaatttggagaaattatgtagctcaattcataaataagtagatgaacgaagcaactactttgttttcccaaatctttgtttcaaataagaagggaaatatcgtgattgagaggtctcttcccttcttttagtaaaaataatgcaataccgcgtttaagggcatataagtgaatgagagttagtattgaccttatgctactgtgatatatgtcaattaaaaaaatgctaatgtgtcaatttcgggaggataaagcaaaaagaaaaaaatgctaatgtgagaacaagcatgccagcaagccatggtcaccccacacccaataaaacaggtaaacaggaaaacacaaaaagtacctgtgagtatgaatagtatatataaaatattttcaaagaaacaagttactcttatgtatcttcaatagaaaggaaaaactattatttattcagcttatgtataattatgttttctgttgctgattcagttacttttgggaaaggcagtacaagtaaagccactcaatatggctttgtgttggacattcgtagtttcttagaacagctaacgaaaatgtagcttttatgccctttgttttttaacataaagaatctgagattgaagaggtagtgtgttcaggattacagaatgataaatggtggaatctagactcaaatgtaaagcagtattatttccaaagccagctacttttgtgttcagctatattgtttttgaattttcagtgatttattggtaggctttttgttatctgggaattccttctattaaaattatattgtcaagtgttgaaatatgcaggttttaactagttgcattgacacagcttgattttgtgtcactctaaaactcaccccctgctcccccagggagcaaaaacaaataaaaaccacatataaacatagctttctaggaacagtagtttcagatactgcttcctaaattgttcaaatatcttagcttttcagttctgtttgttccaaggtggtcatatattgttatttttcaataatcagatttagttgttttgccatttttgtttagggaattactattaattgttttttaatattaagcatgataaacttcagatgtttctctttttaaagacctggttttcgtatattgagtggtttcacttttgttaccttgccccaaagtaattgaatcagcaacagaagaaagcatgacattttaattgtctacgtcaaattacataatctagtgaagtatgaagactacactgttaaattattaatgacttttgtttattaaaccaagcagtgaaagagatggtatagggacattcccctcatattttataagtcatactactggctaaatagtatcaggattgtttttagctctgcattgctaactgagtgatctgtctaaaacttaaattagactatgtccctcctttgcttttaagtcttaaaaactgctgcttaccagtcaaagtctatattacttagtatggtatttaaagcttttaagttctagccccctgctgactaccctaacgtcattcctatatatttcaaagcctatcctaccgaagtttgtctgctggcaacactaactactatttttctgtatgtagagagattctacactttggtttatatattctattctgtcctatttgactgttttcccttaccaccagactatttggtctcctttttccccacatttgtaactttttatattctttttaagacgtgctcttgctcttttgctcagagttgagtgcagtcgtgaatcatagctcatcgtggccttgaactcctgggctcaagcaatcttcctgcctcagcctcccaagtgtagctggggctacagacgtacaccagcatgcctggctaattttatttttatttttatttttagagacagggtgttgttgtgttgcccaggctggtcttaaactcctggcctcaactcctgcctcagctgggattacaggtgtgagccactgggctgggtggctatcatgttttatctaaaattagaaactccttgaggcagggaccatttatctttgtatctttagtgttcagcacctagtagtaactcagcaaatgtttgttttctttctgacatatttgtcatatttgtatttgttgtatttagcatcagaaagccaaatatggtcattcaacgttaatttgactgattccttttgttattttagtccagaattgctaccaaagtgtttaggtttgacctttttgtgcccaggaagtctagtcgttttgatgataaatctaaattggttgaggtgtaatgaaaaagacaaccaggtgtctagaagtgactgtgacaattgcagatttatcttgtttgtgcatgctggtttttttttttttcagtgttcaaagcctgtattgcatcaggttttcaggtttagatttcctaaatttggaacacaaagttccctttttagaagaataggtattgagcccttgagcgtgggtagaaagatagagacagagtgatttgcaaaataatggaggatcatatttatatatgaattttcacttatttgaactttcagatatcagctcaaaagctttggtataagtaaagtatattaatgagactccttggatgaaagtaaccaaaaccagtaaaaataaggtaataaggatgtaatagtttcttatggacactcaacagctagaatgcagttagtctcagaaaagaattagaacaaataactggaaggccatcaggagtccaaaaccatcactcttttatattttatattttatttttctctcttcagatgagcattctctttctatgtccatatggtagaaggcggcagctccatagattatggcttcagatgttacagttccgctaaatgcagggacagacttgctatctttcagtcccacttacatatcctggggagagagcaaatgattgactggcttgagtcaggtgcccgttccctttccaatctgctccatctaggagggcagtgttacctggtaccaaaatagatgttagagggccacccctttcaaaagggagaatagctctcacaacagggcttctatgttgtgcaggttgcttattccacatgctgcttgccaagctgtatgcctataagggctgcagttttaaaatttgtacaaaggtgctttatggatttgtggtaaccttttctcagagaaaggaggagtcattgtgaattggggggctattccaagggggtctgctatgtcatttttgggggatatttattgtccatcttagtattgccagactcttagcattgaaatattagattgtctctcacccttgggccatggagttttattgcagcaaaaacaaaaatccatatgtatataagtgttttctcaataggtatattgacagtggacttactatgatgtggagctttgacatttgtggacctgctgcggtgtccttacactcattgagaaccattgatgttacgcaaatgctattaaactttgcatctaagactt

SEQ ID NO: 5287 - DNA, 830 bp, Homo sapiens
cagtactcacttgagcacatcccaaaagaataacatttcaaatgtaactagaaaaaagtatgctgaagttcgcaatacagaaataattattaataagatagctttaaagccctgctcagcttttgaatgttgggaattgacccagaggtggctgtaacctaagatggttccttcagtaatgaccattttttctttttcaagatgatgattattccccaccttctaagagacaaagaccaacgagccgccacagccaccagtcccagaacccgccaatgctggggaacggaaaatgagggagttcaactctggccctcacaatccagtggaggagacgcaactcatctgcctctgtccctctgggcacgcctcgtgccaggtgcatctgtggacaggggccatgctcctgggcttccaaagttggagaaagctgccaggctcaggtctgaaggccagaattctacagtaagtcctactgagtcaaggtgggagcagggtcggtagcttccgaggctctgcgggagaatctgtttcctggccgtagaggtggcctgcactcctcagcctgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatggtatgtctaaactggaaaagtcttgtaatcttatgttcatgggcgtttacacagtggagttactgttcatcatgggggtaccgtggacaagcccagggctgccgg

SEQ ID NO: 5288 - DNA, 910 bp, Homo sapiens
atgttcgttggaattaatattttctttctggtggtggcaacaagaggacttgtcttaggaatgctgggaaacgggctcattggactggtaaactgcattgagtgggccaagagttggaaggtctcatcagctgatttcatcctcaccagcttggctatagtcagaatcattcgactgtatttaatactatttgattcatttataatggtattgtcccctcatctatataccatccgtaaactagtaaaactgtttactattctttgggcattaattaatcagttaagtatctagtttgccacctgcctaagcattttctacttgcttaagatagccaatttctcccgcttattttttgcctggctgaagtggagaatgaacagagtggttcttgtgcttttcctgcggtctttgttcttatcgtttgtttacctttttatgtccaatgccattagtgagttgtgaaaaaaacatgactttgcactcagatacaagtaaaatagtctgtcttcaaggccttaggcttctcagcttgacatacgttattccctttcttctgactctgacctctttgctccttttatttatatccttagtgagacacaccaagaatttgcagctcaactctctgggctcaagggactccagcacagaggcccataaaagggccatgaaaatggtgatagccttcctcctccttttttttattaactttatttccactttaataggagattggatcttccttgaggtagagaattatcaggtcatgacgtttattatgatgattttacttgcctttccctcaggccactcatttattataattttgggaaacaacaagctaagacagagctccttgagactactgtggcatcttaaattctctctgaaaaaagcaaaaccttta

SEQ ID NO: 5289 - DNA, 753 bp, Homo sapiens
tggatatgcaggatatctgggtaaaaaaaaatatgtatacattatttgaggcatctcttaaatgtatacaaagacaaatactctaaggctgccattgtttagaagtctcaatcatattaaggaaaacactagaataaaaattaataaatgtagtgacactggagtctgataaacctgtatttgaatgaccctgagcaaccttatttttgttctttttcattgactctaaaatgtagatggtaatgcttaccttataaggttactgtgaggacttagtgaaataatacatggaaagtgcctaacctaggatcagaatcaaggtcagtcctccttccctcaaatgttagcttccttttctacctttttttctcttcacttcccttagtatctataaaaagtaggaaagaagaggatacttttttttttcatattcctacaaggctgttttaagtaatgttcttttagttgaatgacagtcacatcatttgagaggttagtctaataatagcactggagacttgaggatgacaaagtgcgaattttcagttgggtctggactccaatttatttatttatttgtttataatcaacatggatttatttgcacctgaccacttttgacagaattaaaaggagaaattgtagacttctacaattacattcacagatttgtgcactactgtctcagaaacttaggaagcaaaaaaaaaaaaaaaaaaatttatagagaatgtagtattacactaatgagat

SEQ ID NO: 5290 - DNA, 3283 bp, Homo sapiens
tgaagaacacaaacaaagtaaatataaagtatttttaataaataataatttacaacaaaagtataaaagacacctcaggccaggtggctcacgcctgtaattccagcattttgggaggctgaggcggaagatagtcacagtttccatacatggagaatgaatatagcccagagcatgaggtaactgcagactgcttaagaacatcagggttacacagtctttttttaaggtcacaatcacattgctgaaaggaaaagaatgagagggtcacaatttactggattccatttctgttttttaattattcattcagtaactcaatcaacattgtttcctttagtcaattagaaacattctttttctaacactgaggacgaagctcaaagcttcatgcaacaccactccaaggacaaccaaaacatttaaaatatcttcatgggtagtaaaaacatgtcatataagtataaatctgatttttgtaaagaggcatgagttactgagcccagcttctcacctgaagtgctgtgattacttggttatgagtagatcattttgccaagcattatctggttagattcagtgactaccattctctctgaggagggcaagattatctaaaattatgccgtgctccccagacataggctaaaacatgacttcattcttaaagttcaatactaacttaagatattgagcaggtgttataatacaagccatagttcacttctacgtatctctagagcactgtccttggacactgaaacccaaggttctatatacttgtttatagaaagcgtatagtcaacaatttcaatgtaaacatctaatttcaagcaacgtgttcacagatgttcttgtgagtatggtggtgactatccccacctgtcaagtaacatgcttttcttataatttcccatatatttacttttgtgaaaaggaactgataagaaaaaagaattgtcaaaaatatgggactactttttgttagatacgataaaatgtattaagtttacttaaactaaatgttaagatttgatcagttataattttatttctctaagccatttatggttttaaatatatatctttttaaagtaaatataaatcacaaaaatgcactgtagattttagactactattttaagaatttagcaaaacatatgctggtaaaattacataaagccaaagtactaaacaaaaacatatagcaagctgttttcaattagctttctattaatatagagataaatcatcagtgctgaaattcaaaacattaaaacagaaaaaaagtaacaacaagtgacattttagcctatgggtaaaagaataatctcactcctactgtcttattttaataagtctctatttttcatgctgttttactatttttcacttttctttgttctttcattcagaattttatattgtgcttgaagagttagtagtaattctgtattaaaagtacggtaaagtaatagactcttgaatgatttgggaaataacaaagtgaaaattaaatagacatgtaaaactacagattttcactttccctccagcccaattttctaaaaaacttcaatatagtcagcatgtctcaataatactctgactcaaaagaaataatatattactgcttgttgctttgatcaaaggcaatgcagcatactataattttaaaaacataaaagttgagacccaaaaataaaaggaccatattagaccttgtccaatcctggatttctaaagagcagcatcatggccacaagcgagttacacacgtgaccagagaattagaaaatgctaacttcaaataaaagtcatttattcaggatgtgggccttagtaattttgaagccattttatgtagaaataactacataaaataacttggtcgggcatggtagctcacacctgtagtcccagcgatatgggaggcagaggtgggatgatcgcttgagtgcaggagtttgagaccagccttggcaacatggtgaaaccccatctctattaaaaatacaaaaattagacgggtgtggtggcacgcacctgtaatcccagctacctaggaggctgaggcggaaggatggcttgaagttggggctgtagtgagctgagattgcacgactgcattccagactgggtgacagagtgaagactgtctcaaaaaaaaaaaaaaaaaaaaaaaaagctaacgactagttattcttcatctctactacagccaagaaataggacaacagatttaggctaactacaggaaagcatttctatagtgtgctaaacacgagaataggcttctaaaggagactggaattttcttgtgtcaaggactttaaaagtatacattctaatccttcaggaaaactttctttgaaggcaggagaaaggacgtgtgacagtccttctcatcttaaaatacaactcaccttgaatccatgtatttatctaatatcatgtcatgctttttgtatttatgtttcataatttacaatttatctaagaggagtatacaaataatgaagtattccagatttgatatggaagagcggtaataaaaacaatgagagtaatcatatgaatagggtgcagtactgcaagagaaaaggaataaaatatgaaaactcttaagaaaacaaaaatattataattctgtatcataacaactctttaggtaagttttaaaatatagcatcttctaataagacagtatgtatacagactatgaataataaacttcctaaaattgctgtagcagaatgatatgttttatttcatttattcacttaacttcactctgttgcttcaccatattaaacaagaccctgttgttttgttttgtttcccaaatgaggaagaaggaacatatatggagaaaataaagcacgtaatttattgaggaagaaacgtgggctttagaaatattaccactataaaaattatctttgcttagactgccaaatcagattttaattggaccttcatgaaatgatcaaagttaacattgccattaatggggcaaaccaacatcctgtgatttctgatatgatgtactaaacaggacatgataccacttttttggtattcctggcaaaaaagaaagaaagaaatacacaacctgattccaatcatgaagaaacattagacaaacccaaattgaggcacacagtataaaacaaccaggctataccttaaaaaatatcaaggtaatgaaagacaaataaaaactgagatactgctctatattaaaggaaacttaaaaagacatgacaactaactgcagtat

SEQ ID NO: 5291 - DNA, 4707 bp, Homo sapiens
ggtaatacacagtgtatttaagctgttgttgcttaattgcctcagactactcaaataacatcaacaacatttcttaagtaaaatttaaatattttagatgtaattttaaaaactgatccaaattttttattatacaactcactcatatatttgaaagtcttcactagcatagtagcatcaccttcatctaaatgtcatttaaattactgtccccctttttcctcccaaaaagacaatggatttgtaccaaaacacacacaaaaaaggcaaacaaaacatgataatctgcaaaagttcatgtatctacttcattgtgcataggaagtgtttacaggtaaaattaaaatcaaaaattgaaaaaacactcttcattttggctctcctttctgaattttttcagtttcctgtctctacccgccatcctttgagtgatactatatctgtattggaccaaatgtatttactggtttcattttgtttattgaatgactttaaatgtatttattatcattgtttaatttaatgttggatatatttgtatcattacaggaatctggtaataatgggcaaatttagattgatgaggcttagggatcggggatgctccaggattcaacatttcttccaattgttcatggtttgttctaaattaggacagattaagaactaataaaacattattacatttgaacttgactcaataaaaatattctgatctcctttatgaatattaggaatattctttgtgattagtgtaagtagtttggatcaaaacataaaaagaagacctatggtttatgctacttctagttatttgtagttcacagtaaaacatgcacagacatacacacaaacattttcatcaatttcgaatttgaattgtgaaaaatatataagaaaataaaaacaatttatacatttgagcaaattgagcaatcacatttattgcatttatttccctttttcccttttttcactcattgaaagtgtgggttttctaaataatattagacactaacactcaacagatttattcacaaatgacacaagtacacattttaagacttctttgtatttcttgcaattataaccaatcactagtcatgaaatatacctacataaaccaagtcctacactttcagtgaggaagaatgtaaggaaggtatgttgactgttttcaagtttcagaaaagatattttcatatgataggattgagtatcatgggtatagtttgatcttgacatatagtttgaaaatcatactcaaaagatttgcattcatgaaaccagtgaacaatagggtggaatggatgaaccatctccttggaagacagggcccaattttcaattttttctttggctatcaagttgctagtcacttattcaggattttcatccaaactgtgtttggactgactgtataagtcttactgccttttcagaaatctgctttcctttgtgtgatttttcttgtactgtatagcacggtttatgcacctctctttagatggtgtactttaaaaacaaaagtaaaatttagaaaatggttttaacactgcatacctaaaattagtagtgtgcagcattgactgcctttgatttgtagtagacaagtaaaaatgaatacgttcttgtagaatgctgtaaaagttattcaggaatgaatacggttttagtgccgtaatcatgaatctttttatatgaatgcactgtctaaaagtgctaaatgcattttcaaatttttaaaaattcctcagatgatatatttgaaatgtctaaaataatgctgtgcttgaaacattagtgtaaaaggaaaaaaaaaatagtgtcactgtgatgttggtcctccctgtgtggacacaagtagaaagaaaaaacttggcaagtcacctttgtgtacaatttgaggcagtggttatatacaataaattgacctttattatatcccccagacacacacattcttggtgagaaaagaacaaccatccagaaattgagatgagaacttttgtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaaatcaacttttctagtatcacaccatagtctctagaaaaggaggacaaatacatgggcctggatagacctatgtcataactgatttctgcacattgaaggtacctagattgcctttaaaaggtataaagaaagggttaagtttcttttttttttgtcttttttttcccaaaatgaatcaaaagatctcatttatttagctttagaaagtacaagtgtaagtaaagccttaggaagaaaggagttcgagtggattaagagaatctgaactctttgggggcagttaggctatttggagttagatcgctcataaaatattgtttgcgaatttcacacagggcataattttatctatgctccaaaactttaatacgttgtcaaaaaattatatatagatagaatggagagcaaagcacttgattttaagctcatctgtcaggagatgctatgactactgcttctgatatctctaaatgtcagtctgcttacaccattgctgattttgttcaagggaatctcttcgtgcacttgattccctctgttccctgcgtgatcgaacatgaaagcagtgttgtctgcagatgtgcttgcgctgccctagctgggtgcaaataagagtgtaacctattctgatgtctggtgaaaggacatccatagcatagtgcaagtatgccgtaaacgttgctttttaggcagtttaggaagtcagaccatgcaaattactcatgtgttaacatgcaatactcaaagggttttaatttaactctcttcttttgaattcttcatgatgatttactgtaaatgcttctcagtttgcatgccttgatcattgctgctagtgattttatgtgccagtagacctgagtttagtttaccaattttacttaaatagtaaaagccacttacaaagtgactgcctaggatttttttttcctttcatttgaaataattgataatatgtttttttaaaaagaaaaatgtgttttgtctcttcttttatttggttctggtttgattctttttctcccctctttcctttgttttttttttttaaataaattatgatgttgggattggaagccctgagtaatgaaaatctttggtaagaattgtttatgtagctcaataacgaggacaacaaatattctttagaagaattttgattctggggaggaaagaaaatataaaaactcccattgactgttgataaccaagtaaatttttccttcagtaaattagtatttttgaagaaacgatcgccttgttttaacttgctaaacaacaattttaaatgacccaataaagaatctattgaactttattcgtttaaaaagcatcttttgtaccaaagcaaatttttttctctactcatttccatcatcaatttggacctatggtggtgaccaatgcattggttacagaaactttaagtgagtgccttgagaaaacttggaaatttgtgcctgaggtggtaaacttttaattaggttaattgtagtgcttaccaatcagtaacttcactatcactcagggctttcgtaccttctaggtaaaacttctttcattgtgtttttttaagatactgtatttttttttaagtgccatcatttaaatttcacttagtaagtggcagattacattattcagtcccacaagcacagaaacatagtaacactaggagatatttgaacatttattttacaatcgactgaatatattatgtaaatgaggtaagcaacttttgtagagattgtatgtgtgagataatgtaatgttcttttccagtttttggactacagttgaataaactttttaattatttaaaaacatctttaccgaataacatgtgatggttttttgtataatgtatttgattttgtaaatacgtatttcctgatgtgatttttgtgagaaatgctaaatcttttagtatatcatgtcctctcaaaattggcaggagctaaataatagtttgtgggcgatttgtattgtgtactgtacaataactggggaacttttataattataaaaatatatattaacttttagtgtgttgtttaaacaaatgactggaacatactaaagatattagtaggatttttctgaatatttcagacttgaactcaggctagctttcttgtgtttttcaaaacaaaatggtgtcttgtcttttaaaatcaataaatttgtttccttgttac

SEQ ID NO: 5292 - DNA, 3833 bp, Homo sapiens
gggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagcattaaaaactctcccctatccagtgaaagagataagaatgccagttgtgagaaaattgaaggggaaacggagaatgtcagtgttaaagatatttgaactttttttttttatccatttgaaaggtattttttttgggtgaactatttgttaatattcttggtcctgtaaaaaaaaaattggtgtttggactttttcttattgtagacactcttcataaattaaggaaattcgcctttttttgttataatattgcagactttttttttttttgagatggagtcttgctctgtcgccaggctggagtgcagtggcacgatcttggctcactgcaacctccgcctcccaggttcaagcgattctcctgcctcagcctcccgcgtagctgggactacaggcgtgtggcaccatgcccagctaatttttgtatttttagtagagatggggttttaccatgttggccaggatggtctcgatctcttgaccttttgatccgcccgccttggcctccgaaagtggtgggattacaggcatgagccactgcacccggcctgcagatatttttttcagttagctacttttcttttcactttatagtatttttttacttaattgtggcacaatacacattagtgttttagccattttaaagtatacaatttagtggcatttcatacattcacagtgttgtgcatccatcactgctgtctagttccaacagattttaatcacttctaaaagaaaccctgtactcattccctttgccctctatcccatggctactaatttgctttctgtttatggatttgcctgttctgaatattgtatacaagtgggatcatatatagtagacccttgaggaatgggggggttagggtcaccaacccctcatacagtcaaatctgcataaaatttttaattccaccaaaacttaactaatagcctactgttgactggaagccttaccaataacatagtcaattaacacatactttctatggtaatttattatctactatattcttgcaattagctagagaagaaaatgttattaaaaatcagaaggaagagagagtatatttacgattcattaaatgtaagtggatcatcatgaaggtcttcatcctttttgtcttcatgttgagtaggctgaggaagaggaggggttggtcttgctgtctagggagtggtagaggtggaaaagatggaggaggcaggagaggcagacatacctggtgtaacttttactgaaaaaaaatacataaaagtggacccacgcagttcaaaaccatgttcaggggtcaactgtaatatgtgatctcttgtgtctgacttctttcatttagcataacatcttcaacattcatccatactgtagcatataatttgtacttaattcctttttatgattgaataatctatatatgaatgtaccaccttttgttcatcagttgatgaatgtatttacatgcatttaaataaaatttttttttttgggttttttttttgagacggattctcacccaggctggagtgcagtggcacgatctcggctcactgcgacctccgcctcccaggttcaagcgattcttctgcctcagcctcccgagtagctgggattacaggcacacgccaccatgcccggctaattttttttgtatttttagtagagacggggttttaccatgttggtcaggctggtctggaactcctgacctcgtgatccgccctcctcggcctcgcaaagtgctgggattatagtcgttagccaccgcacacagccaagaaaatgtatttaaagaaaatatggggctgggcatggtggctcacacctatacttccagcagtgtaggaggccgaggccggcagaacggttaagcccaggagttcgagactaacctgggcagcatgatgaaaccccatctctccaaaaaatacaaaaattagctgggtataatggcctgcacctgtagtcccagctacttgggaggctgaagtgggaggatcgcttgagcctgggaggtagaggttgcagtgaactgaaatcacgccactgcactccagcctgggcaactgggtgagggtctgtctcaaaaaaagaaaaaagtaagacaatatggtataaattggggatggtgaagggacataaagaaaagttagtttctaaactggacttgaattaatgttgacagccgtagaatgtaataagtaatgtatatatataatgtgaagcaaccactaaaaatgccatgcatatatgcaaaaactctagagaggaatcagaattttataaaatgttcagctaactcacagaaaggcagataaaaacagacaaatagaaaactaagaacaaaggaaaaataaatcgcagacttaaaccctaacatatgaacaattacattagatttaaatcgtttaaatgtaccatttaaaagataagagattttcagagtggcaatgacgtaactgtatgtgttaatatgagacttcaaatatgactatataggctgggcatggtagctcacacctgtaatcctggcactttggga

SEQ ID NO: 5293 - DNA, 856 bp, Homo sapiens
atagggcattacttcttttagtttgttgcctggacttgggagttgggcccagagctgcaggaaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcaggaaacattagaggaaatttggagaatttcagcattgcatagaagcagccttacaggtaaacggatttgacgggcaggctctgtcaaaattctgcagaagtttgatcttccttcttaaggactttgtgtgaagtaattctttactgcttttaaattgctgttgatcagcttctgggtttttgggttctaacttttttgggtatattgaagacacagtgtattacattatattacatttttaaacgttaagttatttttctgccattgtaaatacaagtatcaaaatattcttgcaaagaagtaaacatttttctcagcaagcatatccttttagtaagagagtggaatgctaaacagttcttatccagcattttggacatcttttattttttgtcagagatcctgtctacactgaaaatattaattatataaacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcc

SEQ ID NO: 5294 - DNA, 2437 bp, Homo sapiens
taaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctgt

SEQ ID NO: 5295 - DNA, 3858 bp, Homo sapiens
gagacagggtttcactttgttgtccaggctggagggcagtggtatgatcttcgctcactgcagcctcaacctcacagacttaagccatcctccagcctctgcctcccaagtgctgggattacaggcgtgagccactgcgcccggccaagagcatgtatttttagtagagacggggtttctccatgttgatcaggctggtctcgatctcccaacctcaggtgatctataagtgctccaaagtgagagccatcactattatttgcataatctcatttacacaaacttgataaaagcatagtatcaaaaggctgatgtgaactgcttcattaatagtcttattttcatcatcattaggtgcggtccacctatgtccctggcattagatgactccacaaagttttattttatattgaattatattcgcctactgcctttttttcgagacaagatcttcctctgctgcccaggctggagtgcagtggcgcaatcatgactcactgcagcctcaacctcctgggttcaagtgatcctcccatctcagcctccagaatagctgggactacaggcatgccccaccaatgcctggctaatttttaaattttttatagggatggggtctcactatgttgctcaggctgcttttgcactcctgggctcaagtgatcctcctacctcccaaagtactgagattacaggcatgagccactgcgcccagcctattgccttctttttaattcataatttcagagatactaatggatgtctttcacacaacacttcaaaagaagttaacactctgaaaaaataccacaataattttctaaatattcagtcattgacttaaatatttatagatgactattttgtgtcagaatcttttctgggttctgggatactgcaatgaacaagacagaaaaaaatctcgctttcatcgagtcctcattctagtgggagaagggagataagataaacaaggaaacaaacatgatgaggtaggcagtgctaagtgctaagaagtttaacagggaacaggatgcagaacaatgggggtggtcttcttctttagacagaatgatcagagagaggctattttataaagatggggtggccacaggcggcctttctgaggtgtgagatttatgcagaggtctgaacaaagaaagagccagccaaatgaagatgtggaggaagagcataaatattataatacaaaaaactgtatctcactattagttcttattccagcactagttcaatgggactttaaagcaaaaatccacttgctaagacacaaatctctcaaacatattgggcagaataaaaagttctgcagttttaaaaagctgctgttataatggatggattaaatgtttttaaatatgaaccacatataaaagtaccaggagaaaatacaagtgaaagtttatgtaaacttgagatgggtaaaatccttctaagcatgaccacaaagttcaaaaacatacagcaaagattgaaaagtgtgattacttttataagaaggcaaaaatattggacagcaacaaaatacccaaaaacaccacaagaaaatacactgccatgaagattccaagataaatggcaaactgagaaacacatttgcaacatatattaacagtctaacactaaaaatatataaaaataaatcactaaggaaaaaaagaacaggcaatagtcataagcaagtaattcactaggaaatacacatggccaggacactaatgaaagacattcaactacagtcatcataaaagaaatgcaacagaaacttattttttgcttatagtatagcaaagatggtaaaagggtgacaaaactctgttttgcctcaagtatgaggaaactttaattcacgttctgttggtgagagtataaactagaaacaacttaaaatttcaatagtaaaaaactattaatgaaattatatgaaatagtatagttcaatagtggtttaatgctgtcatcaaaataatgaagtagacccacatttaatgacaaatatattaatgatgttctcttgagggcgcaggttgaaagacagcacgtatggtatgacagcatttacgtaaaattgcatttgcatagaccactaagtgaaagcacattcatcaaatattaacagtggttatccatatacagtaggatttcaggtagtagtatttttctttgcatttgtaggtacttatatttttgcttttgtagttgtcccaaagaaaggtttttcaaacagctactggcttgactgtcaactaacaattcaaatacttaccagcaaaaatcaacacggtttgagttctcagttggtcagtcaagggaaagcacagtatagttaatgaaaattctttaaagccaagatggtgatcaactcctattaaagaatgcccaactgaggtctttcctgtcattgatattatcaccatcatttactatatgtaaaaatataaagctgcattgctacggtttggtttgtctccccaaacctgatattaaaatatgatcccccaatgttgtaggtgggggcctaatgggaggtgggtttgggtcatgaaggtggatccctcataaatagatcaataccttccttcaggggtgagttcttcctgtattattaggtgctgtaagagctggctgtttaaaagagcctgacacacaccctctccttgcttcctctctcaccctgtgatacctgcacacataggctacccttcaccttccaccacgagcggaagccgcttgagacctcactagttgcagaggctggtgcgccatgcttcttgtacagcctgtagaaacatgagccaaattaaccttgctctctttctcccccttcttttttttttttttttgagatggagtcttgctctgtcgcccaggctggagtgcagtggcgcgatctcggctcactgcaacctccacctcctgggttcaagcgattctcctgcctctgcctcccaagtagctggaactacaggcacgtgccagcacacccggctaagtttatgtatttttagtagagacagggtttcaccgtgttagccaggatggtctcgatctcctgacctcgtgatccgcccatctcggcctcccaaagtgctgggattacaggcatcagccaccgcggcctggctttatttttttttttttaaataaactacccagcctcaggtattcctttattgcaatacaaaactgactaagacatatacaaatacttatgaactggaatgatctaatctcaaggtcaaacaccatggaaaattcttacatttctcagcccaagaacactttccaatctcaaaacatattacaaagatgcagtcatcaagactgtatggtactagcataatagatatagctcaatggaataaaattaacagttctgaagtaaatccatacatttacagtcaactgattttcaacaacagaggcaagacgacagttcatgaggaaagaatagttttttcaacaaatggtgctggaacaactggacatccatgtgcaaaagattaaagtgggacacccctcccccgtcccacttcgtaccatacataaaaattcacagcagatgtatcagagacctaaataagagccaatgttataaaatcattagaagaaaacaaaggtgcaaatcctaatgaccttcgattaggctatggttcctagatgacactgaaagcataagcagccaaatgaaagttagatacatttgacttcatcaaaatgagaatttgtgctgcaaaggtcgctattaaaaaagtaaaaagacaacccacacaatcaaaatatttgcaaatcacatatatgataagggtctagatacaactttgtctagtccacctt

SEQ ID NO: 5296 - DNA, 1262 bp, Homo sapiens
actaaatctggatccctttgcttcttccctgctggctactcttcatatagatgctcttggagcctgtgcattccatgatgcatgtcagaactctcaccttgttcagcctggtgtgccttaacctcaggagtaaagggaatcatgtcggaaacacgtcgttaaagtagaatggtacaaacattggcttcttagtgccattagcacttttaccaggaaatgcaaaagatgcaaccacataatgttttcactttgttttatgctgttcttcaatcgctctttttgtttatttgtttgtttgctttcattaaccaaactcaggggaatgtcatgatgtcaccaaggccaatgggtagagaaataaaaaccagccatccataattgaatctgtaaagtcagtgaacttagccttttcaggttcaaaattacacaaacacaaggattttcttatctttcacctttcaaaggttttctttttattttgccacctgttttccaaataagaagtgggaagcctcttagataaattgtgataaaaatgtctctttgtttggcgtgagctatcaaattagctttgtgtgtccactgagccatcaaattaggctttggctgctggaggcctaggttctagctttggtcacctatcagaatcttactgttacgctgggcatggtggcatgtgcctacacggctcacacctgtaatcccagctctttgggaggctggggtgggaggatcactggagcccaggagttcaagacaagtctgggcaagatagcgagaccctcatctctttgaaaaatatatatatatacttttttttttaaaggagagaaaatgcttaggttgcaaatggagagtattgaacgtggtgatgtaaaaaacttctgcaaaacttgttctgtagctcctgggtcaggtctatgccattttttcttatatctgctcacacagtacagaaatgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaagttctctctctctctctctcaataaacaatgcagaaaa

SEQ ID NO: 5297 - DNA, 1327 bp, Homo sapiens
gggtgctgctggcccttctgtggcctccagtcacctggctatgacttttgatgctgttattgatgtgtttccttggcttcagcagctatttttgctataataatcctgctgcccttcagactcaggataaacggaacaggcaggtgaacaccatgaaattcatgctgctatatgcctggtattcttggcccaatgtagttttgtgtttctttggtggctttttaaaagaccgagtatttggaatatgatggggcacaattacttttagctgttttatttgcactggacaggttgttttgttctgggtggaatatttaatgttttttggctgatggaatttgaaagacttgtgtttggattggtggggagtgctcagcagttgcccaggacatatgctgtcagctggtttaaagacaaagaattaaacctggtgtctggactccaacaatttagcatggctagaattggaagtacggtaaacatgaacttcgtgagttggctgtattctaagattgaagcttcgtggggttctgctggtcacacaacccctggggtcacacttaagattgggggtataaaatgtattctttcactaatctgtgccttccttggctcttgcttacttagatgcgagagcagagagaatccttcataaagaacaacaacaacaaaaaaaggggggggaagtttttacattaactgatgtaaaggatttctccttacccctgtggctcatatttatcatctgtgtctgctattgtgttgccatgttcccttttattggacttgggaaagttttctttacagacaaatttggattttctttccaggcagcaagtgcaatgaacagtgttgtatatgtcgttatcagctcccacaccccagtatttgggctcccagtggatgacacggggaagaacagcatctgggttctgcgtgtggttgcagccactcttgtgtcccacatgatgctggcctttatgatgtggagcccttgggttgctgtgtcttctgggaatctcctattcatcgcttgcctgtgcattttggccaacagtggcatctgtagttcctgaacatcaactgggaactgcatatggcttcacgcactccattcagaatcttggggtggccatcatttccatcactgctgggatggatgatactggacactgggggatatttgtttttagaagttttcttcattgcctgtgattctatgtgacttttatctgtggtcttactctattttgtgaatcatgcccagggtgagaacctaaattattccacaagacaaagggaagaaataaaattttcccatacttaa

SEQ ID NO: 5298 - DNA, 6637 bp, Homo sapiens
aaaatgtacatcgtcaatcacaaacacatattctaaggaattgaattttatagagataattgaatgctttcatctgtaaaagaattagtggcctgcaaaccactgtggattcttgctatgctttgaagttgtcagtgggggaatttgctgctgcaagttacttagacttgtaggcaaagggaaattcaaatttttaattctaaaatgaaaaccactgacaaaattttatactctgaaagtttggttgttagcttagtcattattttcctgttctttatcatttcggaattcagatgcttaaatttaacatacaaattatttgttggtaaaacataaaacataaaaagctacatttggtaaactaaattttaggattcaaagtctctaacaatttctatgtgacatgtcatacggtgcagtttttatttgccaaagtgtctacttcatactgcctatgcactgcttcccgtttttaatctctctaccccaacccccctataattaaataaacccctagaaaactgccttcttttagaatacctaattgattactttaaatattttttcagaatcaaaattacaaaagggagagatacctaagaatctggcttgtttatattctttaaaagatcgcatttgattgaaggttactgtactggtttgccagcaaacaatggaaaatgtggagaagctgaagaatgctcaagctgggacttaatagagtggcctatttggtttgaaatgttttaacttacagagcattgagtagaagcctaatctaatatacataaggaagacaaaagcaaaggattgtgttttctatctaaaggttaatcattgtggttgctcctggccattatcacatgactggaagttaacactctccaaacgctgagcctatcctgtacagcactagaaagtagaaagaatcactcaattcagggaaaccgttttctcttaatgtgaacatttacattaatgccatttccaaaacctttctgggacttcttaaatgcaaagatgctatctgctttacttcatgctgcctgtttttaggagcttggagtgctttaggaagcttcccaatactggtttagcagtaatttggttgactgatcaaggcatgttttaactttgacactgaaattttaaaaagacaacagttatcttgcccggagagtcaagtttctgcttccaaggaggtcaggaattgttctctttggtgatgtggctgtgcttggtagcccttgaaagtggagtcgacagcagtcctcagcttttgtgtgcctgtcttagtctgttttgtgttactataacaggatagctgaggcagggtcacttatgaaggatgctcacagttctacaggctgggaagttcaagggcatggccctggcttttggcaagggctttgctgctgcttcatagcttgatggagaaggtcagaggggaagcagacgtgcaaacaacccacttgttcacaacaaccaaacaagtctctttttaacaacccactcctggggactaatctagtcttgagagagtgagaactcattgcaagagcagcaccaagccattcatgaagcatctgcctcagtgaaccaaacatctcccactaggccccagctctcaacaccaccacaatgaagataaaatctcatcatacatttgagggacagtttgggagacagaccatagcagtgctcagtatttctacccaaatgttcaggtaacttaatatatttttccttgaatatatgtttaaatgggcttcccttccccacgctcatcttgaatggtcccacaacaacttttgattatcacgttcctgtaaatacacaaaaatattttgtggtcttttactggcagcccagtggatgggactttaaaaaatcacccagattccaacaaccagagaaaacgactggtgtatattttttccagtctttatttgtatgtctgtgtatattcaatggaaaatgtttgaagcttcactcacagcacattccattagagaaagctactaaaatcataaggaaaatctaaaatgcagtaagccagtcagcaagccataatgggcatatgaaaacaaagttttttgccatgatttgtggaccacagaagatctgtgttattagtctatttaagtttggtgtttgaaattaaaaatgttcgacatactttttatgttttttttaaatatactgtctatatttaaaattgagtatactgtactttagtgtgtttggaagcagatatccccaaataaaagtatacagtagaaccaaagaattttattgatcagctagaatttagttttcaggtgtaataactgtcaacctaaataacagaggctttctaaaagaaaatgatgtttatttgggaatagggcattgtgaaggcaatatgcatgccatagtaaactgtgtgtattcaggaaggtaaaggaagacaggtttttaaaggacagataaagattatataattgtcttgaaataattattcttggctacaaggattaataacaaggatgctgccagttcgggtttggacaatcggcttctaggcagatgtcccaaaagtattttctgtgtaaggttgcgaatagtgtttgtgcaagctggcgtggtttcttctgggtctttgaggtagtgcgtaaaatccctctcttcatggacttccctggctccatttgtcagggcttttggaaacatgactcttgattctgacagctttcacctttccctctcttgatgaagatgtttttccgaaagtatctatgatgaatcatcttgtagttaggctttgattgtcccttggtgacagaatagacctttcccgggttattggtctggtcctgcatcctgcattggcaggagtgattggcaactaaaagtcagtgttaaaacccttttagccacctttgagggcagggaggctttaagggagtggcacttaggctaagtccacctggagtctattattaagtccaattttttttccttagtcctttgttgtcccctcaaagtgctgggctagcattattctgttaggaattgtacttctttctgcagaaaatttggcaaataacagatacaaagtttaaaaaggaaatacacaaaattaatagtaatgtgacaatcccagtttgcataatggttttgagccctgaacctaggcttacaggcaaccaattgaataaatcaaattgtaatacaattcttgctctgatgtcttaggaaaaatgtctacagcctgaaatcatcaactttttgtcctggtttgcagtttgaatgtctctagctatggcattggttggtatggtgaacttttgtgtgacccatacatcagcatgagacttgctcctttaaaaattaatcacatcttagcttataggcctcagagcatgggagtagttttttttcttagagagtcatagccaaatattgaaggaaattaggaggattcaggagcaaatccagtctgcaggtggataacaggagtttcaaaacggtacagagctgtgatctaataacaggtacatatagctttcttcagaaacttaaagttaccctgatttttaccaaagatgttcagaataaaacagatttgtaaactttatcagattttgtctgcaagaatagtagtatggtcacagtaatctcagatttaaaaacctccttgaggctaagaagctaagtcaaggtagactttagattttacctatagttttaaggttcctgggcctgccaggaaatgataatttttaattcagtgtaatgctgagaaccattgaagccaggcattctacacattctcaaatatgacattttaatcaaagccttggtaatacaaccagtgtttccaattgtatcctgttataacgagagccgatttttattgaacttaggcaaatcatattgccttaagagtactcacaaataggctgggcacagtggctcatgcctgtaatcccagctctttgggaggccaagacaggtggaacacctgaggtcaggagtttgaaaccagcctggccaacatagtgaaacctccccccggccaccgtctctactaaaaaatacaaaaattagctgggtgtggtggtgcatgcctgtagtcccagctacttgggaggctgagacagaattgcttgaaccctggaggcagaagttgcactgaaacaagatcgtgccactgcattccagctggggcaacagagcgagactccgtctcaaaaacaaaaacaaatgaatactcaaaatagtttccaaattggagggatcaagaagaaaggaaaagcaaatatttctacctttgttcacaaaagtattccaaattgctgtaaactatagatagcatgagagaatttctttaaatatggaaaacaaaacatttaagtaaaaaaacaataatgcttcaaataaaagtcacagacacatcttcagttacttagtctcatgtaactttttttgttgtggttgatcttaattagtagttacatggactcatcagtttcttgaagttctgaaaaaatatttagtccattggtattaaagtgattagtaacctgtatttaaaagtgtgttagcatcttttccatgaatctgattgcaaatgcttttagagaaaaagcaataactgggaattacaaaaacttagaataaccatgattaaaaatctgatgagagtttaccataaccagaaatagacaaagagttttggttatttttgtggcaaacagcataatcagaattatgactgatgacatatttctaacggcatcgtacaattttggaacactcatatcaataacatactcataaatgtaactgtgtctagtattacatcattagacaatgcttttcatacaatttaatacatcaaagaagcctaattagctaacatctctaccagatggcatacacatgctctgaggctttccagaggcccaagtggaaaactcaaaggtaattttaagtcaaaaacacttaatttagaacttgagcctagagaagcctgtcaaagatgtcaaaagttcgaaacaggatcacaggtcactataaaatatttaacaagaatgataatcaaaagacttaagaagcaatgcagaaagttacatacatttaaaaaccatcttttcaaagcttcatttttcccaagcaaaaaaaaaacttaaacacaagaatttatcttgatagaacataaaatttttcttaggccagttgccaaaatggtaaagaaaaatctcttgcagtgtgactgcctttacttatgggaagcctatttggatatactgaaagttgaatctgatgaaaaggtacttgaatttaatcagacacaggaagagtatttccaaggttatgagtgtacgccttatagaggaatgtaaataagaaagctagtatgttgaacagaatacatggctcttggaaaaattacgagaaatttcctgcttgcgtggaacaattcaaacatgagaagagccaagaattcagaatcaagttatactggaggaaaacattgcttttctaggccttctacagaacatttcagtatcaagttataacagcaagagttagaaccagaggaaaaaagttacaggagctaatgaaaaagttaagagttatcacccctgccaaacaaaaagatgtaccttcttaaggggagaaagagctaaaggcaatgatgtgtgacctacaaataaggtgcagcaagatacagcaaaggttgaacttgtgagatataaatcaggatcttcaagaagaaaactctacctcaagaaatgaaatgaccatcttaaatgaaaaaagacagcctttctaacctgaatctaggggaaattaaacggatctcagaaggaaatatggcagaaatttaaactgtggtttagaagatggctgattttagaattaaaaattaaaacctctttcaattttattaagaccagatccttaaaaagaaccttgttctaacattggggaccaaattttgtgtgtgtgtgtgtgtgtgtgtgtgtgtgtgtgtgtgtgtgtgtatagtgcatgtatagcatttacactatcgtgtatatacaaatatatagcatatgtatagaatatactgtattattgtacatatacatatgtacaagtatatatgtaagctcaatgtcttatgatttcattctgacctattgccaacttcattacacacaactcctttcataaatgtatccttcatgaacatttcatgatctgcacagaccttcagtgacatgcttaaactttctgctttgttttatacttccccttaaacaactggtcatcctgctttaggataaaaagttactatgcaagactcatacagaattattctgttaattttgtaaccttccttaccaaaggtacattctcacacccattaacttccttcatatttctctcctcctcctacttagtggttcctttctgtcttgtttccatatttgaaacaacctctaataaactctgaatttaaacaacttttttcccaataaaaagcaatttttatgccttataacttttctcatcaaaacatctttttttgggtacactttgtatatggaattgtgtattttcaaattttaacttattaaccttaatttttagtgaaaaccta

SEQ ID NO: 5299 - DNA, 1751 bp, Homo sapiens
acttcggagcctggagcacagggcgagctctcctccgccctgcagcctcaggagtcaggaggcctgggcagcctgaagagtacacgccgacggacagacagacagtgcagtcacccataaagtagaaagcactactaacagcactggagggtgtagtgtttcctactttatggatgagtgtactgtgggcttcggagatcacgccactgctgccgcccgctgcccgccaccatcttcctcggcgctcggggacctcgtgtgacaggtgagcaccttacggcccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttctcttttgtctgagactctgttgctggggtggggagctgaatgcgggcggcaggcacatggacagtatgggcgcacagaagggctgggagggagaacctctgtcgctcctccagaagatacgggtttggccctgcctatgagatcagaagagggctctgggcctggccaggccacagccggaggagagaagggcctgggccatctgcagaaaggggcagggatgtaaggcatcctctcaccttctaccctagctctggccctatcctgcccccctacatacccaaactgaaagctgcctacatccagttttaatctaagaaagtctagggggtcctaggtcatataaaaattgggcaaaatccactgtggcacatacacagcatcttagacaagggcacagacactcatatacaaagcacacactgagatgcaaatgcatttacacacagaggccccattcagtgtgccagtaacacacacacagacacatgtgacatgactggcatgacacacacagggattacacacacccagggcacatacatattcagtagtacacacatgcaatgatagaaacatagggcgtgtcttacacatagaagagcacacacatacagtgacatttgcataataaacacggtggctccatacacatacatagatagagacatgttcatatatcatgataaatatagaatacatagatacatggtgatatatatatataaatcaaaccatgtcattatgcatatttacatgacgatatgagcatgtcatatattgtgtaatcaattactacattgtgccatatagtagcatccatatctatatatatcatgatgtgttgtaatttataaactcatgcaatgatagcctcccatgcacataacagcacacacatagacacagtggcaaacaaacatagatgcaatgacacagaaacatacatacagatacacccaatgtgtttttgttacgttttattatgtgactcatagacacataatagcacacacatatatacacacaatggccccttcacatatacagaaatagataatgtctattctatagatgcatactatacacacgcatgcgcataatggcatgcatatatactctgacctaaacagcaacacatcatgcagtggcgtgcgtgttgacctacacactgctttagggaagtgaagatgtccactcctccccatgcaccccc

SEQ ID NO: 5300 - DNA, 4375 bp, Homo sapiens
agagtcttgctctgtcacccaggctggaatgcagtggcgcgatctcggctcactgcaagctccgcctcccgggttcacgccattctcctgcctcagcctcctgagtagctgggactacaggtgcccgctagcacgcccagctaattttttttgtttttttttagtagagacagggtttcaccgtgttagccaggatggtctcgatctcctgacctcgtgatccacccgccttggcctcccaaagtgctgggattacaggcgtgagccactgcgcccggcctatgtttcttaatatagattgcagtggctagattacagtgactattcacaggcataatcataatgcaccatagcctcaaactcctgggctcaagcaatccaaaaggaggaaacttttaacttatgatcagtttctaccataaatcaagcaacttagaaaaaccttagaacagggtttctcaaaccaagcattgttagtatttggggttggttaagtctttgtttgtgggagcctatcctgtgcattgtaggatttctagcagcataattggcttatgcccacttgatgtcattagcaccactccccaccctacttccagttgtgacaacccaaaaatgtctccagacatagccaactgtccctgggtgttgcgagtataggaggcaaaattgcaccctgttgaaaaccaccaccttagatcatctaggttttacttttaggataagacacttgagggaaaggctgtgaaactgaacctctgttagaagcaacacacagtatcactgcaaaaagactaaaagaaataggtgatttggaaagaggaggcccaggattaaaatatgtttccaagaaagtcaaatcttacaggagactcttgacttcacatctgctgatccctttacccgataggacctagagcagccattataaatctctgtacctgcttgctgcttttctacctcattgttagccacacccagtttgaaacagatgaggtatgctatttcataactagtacatcttttaataagcattttttattgtgattaaatatgcatatcgtaaaattcaccactttaaccagttttaagtgttcaattctgtggcattaagtatattcatactattgtgcaaccaccaccaccatccgtctacagaactcttcatcttcccaaactgaaattatgtattcattaaacaataaccacccattacctcctctctcctcagcctctggtaaccagcattcagtctctatgaattgactactctggatatctaaatggattcattcttatttcatttaccataatgtcttcaaagttcattcatgttgtagcatgtattagaatttctttcctcttaaaggccaaatatgccgtagtatgtaaataccgtattttgtttatcagttcatccattaatggacactgggttgcttctgctttttggctattgtgaataatgcttctgtgaacgtgggtatacaaataactgtttgagtcctaataggcttgttatttttgagtgcacagatctgtatattcgcaattgaaatagggaaagtctttatattcatataaagataatttataatacaataagtcctcaatgttgttgataggttctgggaaactgcgagtttaagaaaaacaacatataatgaaatcaattttaccataggtgaactgatataaataagagttaagtccctatggcatatatttctggttacaaaaacactaccaaatttctaataaagacccaaaacacttctaaaattaaacattgagattaatatgagctttatatacatttaaaaaggataaaaacaagtaagaattggctggacatggtggcttacgcctgtaatctcaacactgggaagtcgaggtgggcagatggcttgacctcaggagttcggaaccagcctgggtaatatggtgaaacccgtctctacagaaaaattcaaaaattagccagaggtggtggcttgcacctgtagtcccagctactcgggagcctgatgtgggaggatcccttgagcctgggaggtcgaggctgcagtgagccatgatcacgctactgcactccagtctgggcaacagagcaaaatcctatctcaaaaaaaatatatatattatccagccccaaatgtttatggggttgttattgataaaccctgcattaaacaatcccacagtcggtgctgcggtgagccgtgatggtaccactgcattccagcctgggtgacagaatgagaccctgtctcaaaaaaaaaaaaaaaaagtaaaaattatttacccaatatttggcgaatcagtgagtgacagcagttgtagtgctagtgggttaaatcaaggaataactgttgggaagtgaaaattttaaggagcacctcctaccaccatgcagttcaaaaacaaaaaataagaaataaagtgggcttgctgagtgctttcatactgcatcatttattgtgcatttgtatgattattatatactttacaaattttcgttttacagtaatttgtattcattcgtttttcaacctgcttatttcagttcagtgtcttgggtagctggagcctatcccagcagctcagggagcaaagtgggagccaaccctggacaggatgccttttcatcacagggcgcactcacacggcacacacacgcatactgggaccatttagctgtaccaattcacctaacgtgcatctttgggaattgagaagaaaccagaatacccagagaaaactcatgcagatatgtggaggacatgcaaaattcacacagacagtggccctggttgtaaataattgtttttcatcaatgttataatgaaattacaggccgggtgtggtggcttacgcctgtaatcccagcactttgggaggccgaggcgggtggatcacgaggtcaggagatagagaccatcccggccaacatagtgaaacctcatctgtgctaaaatacaaaaaattagccaggcttggtggtgtgcacctgtagtcccagctacttgggaggctgaggcaggggatttcttgaacccagaaggcggaggttgcagtgagttgagatcgcgacactgcactccagcctgacaacagagcaagacttcgtctcaaaaaaacaaacaaaaaaagaaattacattagttgaggacctgctgtatgtgatatgaacaatgaggatcaactctttttgtaatagtttttttacatatgttatttcatttgtttatttcctctgtgagggtaagtattgatagtccagtcatagactggtaacacaggcacaccattaaaaataatagacatacagtatgcagtattttgttttacttatgaaactccgtattttatgtatgatgtattgagtatgaagaatagtacatactgtttccttttaactttatgtttcttgcctttgtatattttatatgaatagcacttgtcactaacatagaaagcagtagaggtggaagagggagacttgccagaataagtttttaatgtgaatcagagatttttattaggaattgggagtggaaggagagagatagtattagaaagtatgtatgcagcaaaggatggagaaactgtccttgttgttaaggcatctaaggatgctccaattactggggaaaacataccaggctcaaaatggtctgattatgcaaataccttctaatacgtttgtttcttttgttgtgcctataaaagatgccattaacttcatatttatgtcactaataaacttctagaatccatgtagtagggtgtagtagtgtggttaagctatgaagaacaatggtatttatttccaaaacacttatttggtatattacataggatagagtatgttttctaagccaaatagtgttaggttttcatgtgcagttgccttacacatatactagtagcccttacaaaatttcgtctgtctttattataaacatgttgtaagtgaggaaactaagattccaagaaattaagtactgttggccctctgtgtctgggggttccacatctatagatcgaccaaccatggactgatggattgaaaacatttggggaaaaaacaaaaaataacccaacaatgaaatagtataaattttaaaaataatataacaatatttatatatcatttacattatgttagatattataatctagagatgattagcatccttggattttggattttggtatccttggggtatcctggaaccaatccctggcggataccaagggatgactgtaatataataacatctaacaagtgaaggatttgaaccccaatgtaagtaattatgaaaactatttttcttccactagaacttttttccccaaaaatactctggaa

SEQ ID NO: 5301 - DNA, 679 bp, Homo sapiens
agcgagaggcagtgacactgagcgggcgcagggggccgagtcggagaccgtgccggagttcgggagcggcaacagagtgggcatagacactccgagcagcctcgccgtcgtctctgcgttcctgttgactgcctggctgccccctcccctactcctcggttcctggtgaagaggctgcgcgctgctgtttggggagggggtgtgtggagccgggtcctgtgtccgcagtggctgctgtcggggggtcgcctgttcgcggaggtgcggagagactccttgggggtcgagcacataacggggttcgggtgtctcgtgtgtgaacatcacaggtctattctggataagcaggttttgtgaagacatttattctttcttggacctcagatttaccagacatctcatgacggagtctcgctctgtcaccaggctggagtgcagtggcgcgatcgcagctcactgcagcctctgactccctagttcaagcgattctcctgcctcagcgtcctgagtagctgggattacaggcacatgccaccaagcccagaatgctgttatgtcccaggcactgtgcagtttggaagacaagcagcaatagcacaaatagaagtcattgtctgaaggaagtttgtggcaagctctttactgaaacatctcaagtgtgggtttgtggatgcactta

SEQ ID NO: 5302 - DNA, 2511 bp, Homo sapiens
accgcttggcgcgcgcacgtcccggagggcgtccagggggcgccgcttcccgttcagctccgctgaggggctggtccagcccgcgcggctcggagcggaaagagtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtaagaatcggagttcctggattcagggggtactgggagcagccgcctgtgagaaggctgggccaaacaaacaaatgttctgaatgaggataagaaaacagcatttctcctgagggtctctgattttctgtagcctgcccctggcttgaaaactgtcagcttagcaaagtggactctcaaaccacctggatctcatgttttttgcttgtcagattcattgattgctgcagaataggctcaacatcccacagggtctgcttctctgactgggacaaaagcgctcataagaaactgatgggagcggcttcaccaggggtggcagacaattctggccaggagtgggtgtccgcagtgggcaagaagtgtgggctccatgccaggagcagtggcgacagcttctagaaattgtctagtagcctgacatcctaaagaatgtcctggagagctggaaaagcggttcttccagacacatgcagggagcagcgaaatgagatgcagtagaaggttgaatccagctgggagcacagtgcaatttagttaagagtgacttctgtggcatctgctggtcgtgggtgagggctgggggaagataatactaatttggccattattacacatgtctttcttgaatcttcaatcagattgtcaactccttgagggtagtaatggaatattttatgtcttttgcattcttcacaaggtcgggtactcagccattgtttattggttgactatttgatgcattccgacacaatacacttgaccgggccaggtcctgggatcttcattcataggagcagtgttgtcaccagtatctgttgggcacctgctgagaaggagcaatggcgggtacttttgccacccgagttggcctgaggttgctgagtgtatgagtttcctagggctgccttaacaaagtgccaccaactgggtgattaacagaaatgtcaggtctcccagttctagaggcgagaggtctgcaaccaaggtatcagcagggcctgacccctctgtggtgtataggaggcccctccttgcctcgccctggcttctgacgatttgccggccgactgtggtcttccttggcttgcagctgcgtcactccaatccctgcctttatcatcacatggcattctccctgtgtgtgtgtgtttccaaattttcccatttttataaggacaccagccatattaggaaccgccctactccagtatgacctcatcttaactcattacatcttcagcaaccccgtttccaaagaaggtcacattctgaggtactaggggttaggacttcaatgtggagatcacagttcaagctgccacactaagtgagctcattcacagtgacaagactagggacatacaaagggccggggtgaatatgaatggtgttccatggtgctgcctgaaagtgactggcagcagtgtcagcaggggagcatgtcctctgttctcagcattcactagagaggtgtgctgagctggggcccagctggacacattggatgctgtgctccagaggaggaactgcactcacctatcgctctcctttgtatgggacaagtgggacagagccttgatggggggaacacaccactggggttccaggcagccttaactatcgaggaatggcaggaaattctgtctgcccagcacctggtgaccctggagctcctcagtttcccgggaagttgagttttggagcagtctcttccagagaggctgggagtgcatcactttccccctggaggtggcggaggctgctgggcccaactagctcattgccaggcaatccagagagagttccagacaccagatactgaacaacctacttgtctccacacctagtaaagcttggatccaatgctgccaacttttctgcctctccagttttggagcccttaatgtgaaggtgcaacccagaagcctgcaggctgttcgtagcctgtagatgtgttttcttcccagtagctggtgtatacagtgtttttgtattatttttcaaataagcaatacatttgtgtggttcaaaaattaaagcgctatagaaaggt

SEQ ID NO: 5303 - DNA, 1659 bp, Homo sapiens
ctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagta

SEQ ID NO: 5304 - DNA, 3956 bp, Homo sapiens
tatcaaaatgcatcttgtttatttggcttttgaaactgttataacacaacttataacattggaaatacattattttattaatacaaagtagttttcatagtaaaataccaaattaattaaaaggcagaatgaaacgtaccatatacatgtagacgacaaatgaaaactgtcaaagtatccttctctctaaaaagccacaaattacgttctttgaagtaagtattgggttttatttcctaaactatacacatcaatatcacctcctgaagctttttacccagtttcacggttggtatttcggacatgcaatgttccatgctgtcaaacttggaatgcctcgtttggatacagggagacaaagacttggagacccagaagcctgaaagtggttcttgaccgactttgtccactcaaattaaggcatcatgcagctggtcatcacttacattgctggttgcacgcaggcacacacacaccagtgctcacagccagcacttgttaagaatggttgagctggaccaaatggtatacgtgtctttcatcaatataaacatggactgcattcatctggacacgggccttgcggccgggagggaccgagcggggagcaaggcctgcggggaggcgcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccgggttagtgtgcctgacaacactgaagaaaaattgtgacattttccttccccagaattacttcgttttatacatttcacttctcttctgaaatcacagcaatgccagtttgcgccttttggtctgaggaacgcaggccctggccactaccaggaaaaaaaccttctggatttcagctttggcaagcttcctctgtttctgagacacctccatcacctgggttacaatcccatccatgattttccccatctccaggcatttttcatggaaagctcctcatgctttttaattccagtttatccatttgtgtggctttaacctccacatccaggtctttctggctaaactgcagtatatccacaatggggccaatggacacataagggaggccctatcacaggaacacgaacacccggagtcgctagaaatcagattccaccggctttgcttcaggccgacttcctaaggaaggcatggtagcatcacagatgctgtttgtctcagtttcctgagaagccagtttcttagagctgtcattcaagagtgggtcaaatttgagatataaaaacctttctcaaggtagactctttggcccctatgcctagtatgtcagctgggcctctgaagctctcctctttgaggtcctggcaggctctggcccctgttgagaaggggaagcagtcatgtgaactcatgtgctggaagaatccactctaccccttccctggcttctctgctgcaatttttgtctttaaacgtattttcaggtatcctttgcacatggcctgctatcaacaatcctctacaatgattctcagcatcacctagggagcttatgtaaaatctcaaattcctgggccctatccccagagtttcttatcaagtaagtctgcattgggatctgaggatttgcatctctaacaaaaattcctaggcgatgctcacactgttggtgtaagggtacagtttccttgatggagaactatcaaagcagtcaaagctatcaaaataaaaaagaattctgattgggtgcagtggctcacacctgtcattccagcactttgagaggccaaggtgggcagatcacatgaggccaggagttcaagaccagcctggccaacatggcagaaaccccatctctactaaaaataccaaaattagccgggcatggtggaacacacctgcaatcccagctactcgggaggctgaggcaagagaatcgcttgaacctgggaggcagaagttgcagtgaaacaagttggtgccaatgcattccagcctggatgatggagcgagactctgtctcaagaaaaaaaaaacaaaaacaaaaacagaactctgcctcatagcgtcttttaagttatacactggacctatcctttcctcactgacagacattttaaaaattttttggtaaggcctagttcatataaaatgtaatccaagccaaaagttaacaagaataaggggaggaaaggggactccaatagcagagaaaggtatttacctgggatatacactgcaagaaaatcaaagctataagaaacgtccatgaatagtagccataaggcatcagagtgataaaattcctgtccctaggagggaatattggagtttgccagagaaacagaatgagagagacagagaggtttattgtaggaattggctcatatgattacggaggctgagaagacccacgatctgccatctgcaagctggagaatcaggaaagctggaggtgtaattcagtcaagtccaatggccagagaagcaagtgtactgatatccaagagcaggagaaaatagatgtcccagaacaagcagagaggctgattttgtccttcctctgcctttttgtttcatatggggcactgaatggactgatgcccatccacattagtgagggtggatcttctttactcagtctaccagtagaaatgtcaatgacttccagaaacaccctcaccaacacacgtggaaataatgttttaccaggtatctgggcatcccttggttcactcaagttgacacaaaattaaccatcacagaaggagactggccttactctgaaattaggaaactaaagaagtgaccagaatggagactaggtagagacaactagttctctaccaaacatgtacagttattcgttggtatctgaaggggattggttccaggaactctcagggataccaaaatctgcaggtgctcaagtcatttatataaaatattacagtatttgcatataacctttgcacatcttccatatactttaaatcatctctacattacttataataatgaatgtgtaaatgctatgaaaatagttactacactattgtttatttgtatttttattgaattgttttggggtggggggcagctgtatctttcttagtaatagaacccctggttttagctgggcacatgactgccctcaataaagattaaagtaccccagccttccttgagattgtggccatgtgactgaactttagacagtgagatataagcagatatcttctgtggcagtgttaggaaactattaaagacagtaagaacattgc

SEQ ID NO: 5305 - DNA, 248 bp, Homo sapiens
ggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatg

SEQ ID NO: 5306 - DNA, 1410 bp, Homo sapiens
tacaaacccatcaaatcaagtagaggaaacaacacatccaagccatttaaccatttccttatcacatgctgactcaaccctcagtttcctccagtggaagtaagagggaaacttggaaccaaaattatgcaaatagcagagctaagccccaggtagaggcagagcactacctcacactttgtttctggggctgagaaatggctatctgggtggacaaaaaaacccaaatcgtagtttctcctaagagtctccccttggtgactcttaggaaattgtttgatacataatacattttagcatgttaagttacacaactagaaggaaaaccctaaagcattttcttaagtcttaatcacacaattaataaatataatggaatggattcaacaaaatacatagagaactatatccagcaggatgtgttacctttatctggagacaagttacagagagtgttcaagttctattccagagggaccacctaaggagattatacatcaatcacacattcacttctgatatattttctctgatatattctgctagaatgcccttcatgaatatcagcatcccatgtttgaggcagatgttgggttaggccctataggcgcagaaattgtcacaaatgccagcctttggtgtgagagacaagccttctcatctatcagcaagcacacataacaaggttatctttgaggtcatggggaagtgggttcccacaagcgggcaagtgcatcagcatctcagtatggtctacagtccaagaccagtttgtaccattttaaggttatcctacctcaggtagaaggaggtgggataatgaccacatactacattcttgagaatcctcagactagggtgaaacaaagtgatccaccctcagcttgaatgagtggacacatttaaagcatgttagagtggcaaataatattcatagcctgtattagttcattctcatgctgctaataaagatgtatctgagactgggtaatttataaaggaaagaggtttaccattcagcatggctggggaggcctcaggaaactttacaatcatggaagaaggggaagcaaacacatccttcttcacatggtggcagcaaggagaagtgctgagcaaaaggcacccttgtaaaaccagcggctctcgtgagaactcactctcacgaaaacagcagcatgggagtaaccaccctcatgattcagttaactcccatcaggtccctcccatggcacatggggattatggaaactacaattcaagatgagatttgggtagggacacagccaaaccatatcacaggcctagctggtcttcaggttgcagttactatctgaactcccctgaatattggccaattagtactgtccttttcctaaggtaataacctcaatcaggtttgacttccca

SEQ ID NO: 5307 - DNA, 294 bp, Homo sapiens
gccgggcacagtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacagagcaggtcaaaactcccgtgctgatcaggagacagagtttgtgagcagacaactggtctgaccaaaatttatgaggtgggaatttcctct

SEQ ID NO: 5308 - DNA, 7974 bp, Homo sapiens
ctggcggaaagctccttgcctggaacgcagagggccttcgctgctgcggcccctggggactccttcgcgacggcttcccggggagggggctgaggcctggcagcgaggaccctgacaccccttcgggagaggagtggctgctaggccgctcgcttgctcctggaaagatttggggtttgagagctcttggccaggaggctcgcgctggccgaggcccgagagctgtccccgcgggacgggactagcgagggccggggagatggagcgcaggcggcgtctgggttcgaagcactttccggctgaaccacctgctgctgaggctgagccctgagaggcggttcgtggcccccaaaccggggaaggggcgaagctttgggcatctgtcccatgcaagggtcccaacatctgaatctcacctcactcgtctcccacctgtcacgaatggccagcgccaaagtgataaatatgtaataggaatgtcttcccgaggctgtgctggagacttccctggccgcacagtgaccgttcagagcccacgataagcaagccgaaacccggtttggcgcagaggcgcgcaaggagagaggtctgtcctttgactctgtgagttgggcagcctaacatggttattgttaattgacggtaaagtatctcgaggtccgttagtctatgtttttgttcttatttatcactgtgtatgtctttgggcttctcttcactttgtatggcagattattttgaaaaagtttacccttgtgtttgtctcagctgttttaaaggggatctgccgtctagggagttccccttgaaaatcggacctttgagcagtgacttctgttttgccacctgggagcaacgtgtaaggaagtggacttaagcttctctctccccaggggaagaagcacagtggaaaaatcacaagtgacttctggcctgaaaagcccttaatttacctgcttctacaattactgccctttctgacccagttctttccctgcagatataggtgaggttcaaagaagcagatggtggagttttgttagacaatcagtgaattttctaattagaaaaagaactgaggtcgggcgcggtgggctcacgcctgtaataccagcactttgggaggccaaggcgggcagatcacccgaggtcgggagttcgagaccagcctaacatggcgaaaccctgtctctactaaaaatacaaaaaaattagctgggcctggtggcgggcgcctgtaaccccagccacttgtgaggctgaggcaggagaatagcttgaacctgggaagcggaggttgcagtgaaccgagatcaggccattgcactccagcctgggcaacagagcgggactccatctcaaaaaaaaaaaaaaaaagaaaaagaaaaagaaaaaagaacaagaactgagagtggcttagaaataatctctaactgacaaccacctggtctctaaagccagaaacttgggcctctttctctctatcttcccgctcagatatcagtgtcaccaagccctctccacttatttcctgaatatcttccagatgcttgcctccacctctttggttcaggctccatcttctctcacctaaactaccatgagagccaccttgctagtctcctagtcaccttccccctgggtcatttttcacactgctactggaaagtttcttttttaaaatcaggattctcaggggagggggtgcctggtcatcagcatttttttttttttaaaaaaagcaagcactgaggccgggcgtagtggctcactcctgtaatcccagcactttgggaggccgaggtggattacctgaggtcgggagttcaagaccagcctgtccaacatggtgaaaccccgtctctactaaaaatacaaaaaaaattagccgggcatggtggctcatggctataaccccagccacttgggaggctgaggcagggtaatcgcttgaacccaggaggcggaggttgcagtgagctgagactgcaccattgcactccagcctgggcaacaagaaccaaactctgtctcaaaaaaataagcactgattttgatgtatacccagattatatgagcatacaaggtagagtcaaaatagcctggcatatgagactgctcagacctggatcctaattacttctcaaggtacattccccttctggaaccctattctgtattcaaatagaaatactgaatatcatattctctcaagccggcaagcctcatattgttcctcctgcctaaaccacccaatctcctattccctacttatcttttttttttttttttttgagacagagtctcgctctgttgcccaggccggagtgcagtggcgtgatctctgctcactgcaagctccgcctcccaggttcacgccattctcccgcctcagcctcccgagtagctgggactacaggtgcctgccaccacgcccggctaatttttgtttttgtattttcagtagagacggggtttcacagtgttagccaggatggtctcgatctcccaacctcatgatctgcccgccttggcctcccaaagtgctgggattacaagtgtgagccaccgtgcctggcctttttttttttttttttttttttttgagacagtctcactgtcaaccaggctggagtgtagtggtgtgatctcagttcactgcaacctccacctccgagttcaagcgattctcctgccccagcctcccgagtagctgggactacaggtgcgcaccaccatgcccggctaatttttgtattttttagtagagatggggtttcaccatattggccaggctggtctcgaactcctgacttcgtgatccgcccgccttgacctcccaaagtgctgggattacaggcatgagccactgcacctggccttatcctttttttttgaacagtgcaaatgtcaccttctctataaagccttcccttacatctcctcccaggtttgtttatagcatatctcactgtagtgttattttacttcttatgtgtctgtctcccttgctaatttcaaactcctcagaggaagactgtaatttattcatctctgtttcctcaggacctagcagtgtttttgtatatgttaggcagcttaatacatgatcttcgcatgaactggtttaccccctgtacatgatgagagactagagttgccaccaagttacctatccgggggccagcctgtgggatcagatgggcaggattgggtgggcccccttaccatggtgtgccctggaaaactgctcatcttgctagattgaggatatagagctggcttccaacagaactttggaaccatcctgccagcaaggtcagactgtcaataaatgggaatttattgcatgcctgtggcataatctgttcttgaagtattctgttttggaggatggaagatatgagaatttggattcttcccttgttcttttctctgcccctctgtcccccactgatatagtttggatagttatccctgcccaaatctcatgttgaaatgtaatccccaatgctgtaggtgggtcctggtgggaggtttttggatcatgggggcggacccctcatggtttggtgtagtatttaccctatgagttctcacaagatctggttgtttaaaagcgtgtggcacctccaccacaactctctctctctcactcccattctcaccacgtgatgtccctgcttccccttcaccttccgttttgattataagcttcctgaggcctccccagaagctgagccagcaccatgcttcctatacagcctgcagaacggtgagccaattaaacctcttttcttttcttttctttttttttttttttttttttgagacggagtcttgctctgtcgccaggctagagtgcagtggtgtgatcttggctcactgcaacctccccctcccaggttcaagtgattctcctgcctcagcctccagagtagctgggactacagccacacaccaccatgcccagctaatttttgtatttttagtagagatgtggtttcaccatgttggccaggatggtcttgatctcttgaccttgtgatccgcctgcctaatttggcctcccagagtgttgggattacaggcgtgagccactgcacccggcctaaacctcttttctttacaaactacccagtctcatgtttttgtttgtttttgtttttgagacagggtctcactttgtcacccaggctggagtgcagtggtgccatcttggttcactgcagccttcacctcccaggctcaagtgatccttctgagtagctgagactataggcacatgccaccacacctagctaatattggtatttttcgtagaaatgggtttttgctatgttgcccaagctggtcttgaactcctgggctcaggtaatccacctgccttggcttcccaaactgtcaggattacaggcatgagccactgtacacggcctcaggtatttctttcttttttttttttgagacagagtgttgctctgtcaccaggctggagtgcagtggtgcgatctcggctcactgaaacctccgactccgtggttcaagtgattctcctgcctcagcctcccgagtacctgggattacaggcatgcaccaccacgcccagctaatttttgtgtctttagtagagacgggtttcactatgttggccaggctggtctcgatctcctgacctcctgatctgcccgcttcagcctcccaaaatgctgggattacaggcatgagccaccacgcccggcctggtatttctttatagcaatgcaagaacggcctaatacccaccacacaaaatcttttttgtttttttggtttttttttttttttttttttttttttttttgagacagagtctctgtcgcccaggctggagcgcagtggcgcgatctcggctcactgcaagctccgcctcccaggttcatgccattctcctgcctcagcctctccaagtggctgggactacaggcacccgccaccacacctggctaattttttgtatttttagtagagacagggtttcaccgtggtcttgatctcctgacctcctgatccgccctcctcggcctcccaaagtgctgggattacaagtgtgagccaccgcacccggccggttttttgcttttgagacagagtctcgctctgtcacccaggctggagtgcagtggtgcaatctctgctcactgcaaactccacctcctgggttcacaccattctcctgcctcagcctcccgagtagctgggactacaggcgcccgccaccatgcctggctagttttgtatttttagtagagacggggtttcaccatgttagccaggatggtctcgatctcctgacctcgtgatctgcccacctcagcctcccaaagtgctgggattacaagcttgagccaccgtgcctggccttttttttgttcgtttagacagagtcttgctctgttgcccaggctggagtgcagtggcatgatctcggctcactgcaaactctgcctcctggcttcaagagattctcctgactctgcctcccaagtacctgggattacaggcgcctgccaccacacccacctaatttttgtatttttagtagagatgggtttcaccatgttggtcaggctggtcttgaactcctaacctcaagcagtccaccagccttggcctcccaaattgctgggattacaggcgtgagccactgcgcccggctacaaaatcttaaatctaaataactcctctgtgaccacaacctcctgttcttctcattctctcaattcctaccaaacttgtttttccattccagtgacacctgcaactcctccttctgcccctttggccagtttctagcttgtcttctgtgtcagctgccttgctataaagaaatacctgagactgggtaatttataagaaaagagctttaattggctgtggttctgcaggctgtacaggaagcataatgctggcatctgcttctggggaggcctcaggaagcttacaatcatggcagaaggtgaagggggagcaagtatctcacatggtgggagcaggagcaagagggcaaagggggaggtgctacacactttttaaaatgaccacatctcataactcacggcaagagggtggtgctacacattcatcagaaacccacctccatgatccagtcacctcccaccaggcccctcctccaacattgcagattacaactgaccatgagatttgggtggggacacagatccaaaccatataatcttctgttgcgggaagtcagggaccccaaacggagggaccggctgaagccatgacagaagaacgtggattgtgaagatttcatggacatttattagttccccaaattaatacttttataatttcttatgcctgtctttactgcaatctctaaacataaattgtgaagatttcatggacacttatcacttccccagtcaatacccttgtgatttcctatgcctgtctttactttaatctcttaatcctgtcatctcgtaaaccgaggaggatgtacatcgcctcaggaccctgtgataattgcgttaactgcacaaattgtacagcatgtgtgtttaaacaatatgaaatctgggcaccttgaaaaagaacaggataacagcaatgtttaggaaacaagagagataaccttaaactctgacctccggtgagccaggcggaacagagccatatttctcttctttcaaaagcaaatgggagaaatatcgctgaattctttttctcagcaaggaacatccctgggaaagagaatacgtgcctgagggtgggtctctgaaatggcccctttgggtgtggctgtcttctatggttgaaactgtagggatgaaataaaccccagtctcccatagcactcccaggcttattaggaagaggaaattcccacctaataaattgtggtcagacaggttgctctcaaaaccctgtctcctgataagatgttatcaatgacaatggtgcccgaaacttcattagcaattttaattttgccccggtcctgtgatctcgccctgcctccctttgcctttgatattctattaccttgtgaagtacgtgatctttgtgacccacaccctattcgtacactccctccccttttgaaagtccctaataaaaacttgctggttttgcggcttgtggggcattacagaatctaccgacatgtgatgtctcccccggatgcccagctttaaaatttctctcttttgtactctgtccttttatttctcaaaccggccgacgcttagggaaaatagaaaagaacctacgtgactatcggggcaggttccccgataatcttccttatccatgcagcttagattccgcattccatttcagccacattcttgcgtatgttcttgatgcccctctcccattgtttcattgcagctgccaagcaaaaccctaaatcatccatcaacattcaagtacctataaccaagatgctaaaagaatcacaacactatatgtgtctatggacaagttgttctccaacctcagttgggccctcaatgctgctcattttctaaaccagctcttttctattctccacacttcatctgtcttctcatcatttgacctccctatatagcttagtgggagatgcaagcaacagaagcaattacagacactatgttaggtgctgtgacagacaaagtattgggcctgtgggagcacccaggaagaaggaatatctaactgaagcttgagcagtcagttaagccttctttaaaacagctccactgggcgcggtggctcacggctataatcccagcactttgggaggctgaggcaggcagatcacctgaggttgggagttcgagaccagcctgaccaacatggagaaaccccgtctctactaaaaaatacaaaattagccaggcgtggtggtgcatgcctgtaatcccagctactcgggaggctgaggcgggagaatggcttgaacccgggaggtggaggttg

SEQ ID NO: 5309 - DNA, 2825 bp, Homo sapiens
gtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaaa

SEQ ID NO: 5310 - DNA, 904 bp, Homo sapiens
gaggatgtgaatggggtgggggcagtcgcccctgtcccccacccttcccttcaagccgggcaggggtggggggaggggccgggctgaggcggcggcggcggcggcgctcggggagggttgggccaggcaagggcgggactagcccacggcgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactgg

SEQ ID NO: 5311 - DNA, 24385 bp, Homo sapiens
ggaggtggctcgggccgcgccgaggggaccacgggacgccctccttcccttctcaggaaactgtgagtgccccccgcccacaagcccgtcgccaggatgccgccaactagagcaaagtgaaacccccaacattctcgggaaagtgcgggtccctccctctctacagccccttaaatgcacgccccagggcggcccctacctggagccaagagaaaccgctgcccttcttggagaggtgtgggcctctccgcgcccgcccttgctgtcccctctctgttcctaacaggcaccccccccaggcagccccaacggggaggaaatgaaactcttcctgctcctctgctcggaaaactatggggcccccttccagctgctcacggggcgctcagggcgatccccaaggggtgcaaagtgcaatcccctccctgcttagaaaggcgtaggccttgacaggcagccacggcccctggtcctttctggagcgtccgagctgggggcgctcagtggtgaaagatggcgggggtggggggctttgagacacactgcggatacccgctctgcgcgggaccaaggacgttctgccgcaagctcagagacagggttgggagtgaggacttgtggtcgtggtttggggttgggggtaagacccctatctgggtcgcctggctgagtcctggtccttggcgactcaccccagcaggctgcgtcaggggcccttcggtaacactggtcttgtgctgtctcaggcctgcgggtgactccgtctctccccaggccacctgtgcccctggatcagacacaggcaaggccagaggggctggccccgcaccctggggcccacctcaggggtttgaggaatgcagcagtctaactatgcactccactcctggaggcagaatcatttttcttttttctttcttttttttttttttttggtctttgcttcatcctgaacctgcctgggataatgacgtgatggctggagtcccagcagccagttcgaagcaggaagtctcctacaggatagaagttgtctgtgtgttgtttgtttgtttatttgtttgttttgagatggagtcttgctctgtggcccaggctggagtgcagtggcacaatcttggctcactgcaacctccgcctcccgggttcaagtgattctcctgcctcagcctccccagtacctgggattacaggcatgcaccaccatgccaggctactttttgtatttttagtaaagacagggtttcaccttgttggccaggctggtctcgaactcctgacctcatgatccgcccacctcggcctcccaaagtgctgggattacaggcatgagccaccgcacccggccagaagttgtattctaagcatggcagaacacgttgagcaaaggtatcagggtggctgatgatacagcaggacggctgtgccagcccgactcacattcccaacttcttttacaggacaaaggagtacatttttatcttaccatttgctaaagttaggtttctatcagctttctttaaatcacttttatttctggttttcattaccaaggtctgagcccaacttagagacctcccgtgaggttcttgtgggcaaccaaagcacttaagaggtgtcagagcatcacacaccatgtctgctgcacagacgatcaaatgaagcttttgaagtcagtggatgatgggtggatagatgggtctgggggtaggaagtggtggatggatgaatgaatggacagacagccatctggatgcgtgaatggatggatcacttgctggaaggatggataaagagatagatggctggatgaatgaataaatgggtggatggatggaaagatgagtggatgattggatggatagatagttgggtggatggatgaatggatggatacatagatgaataaatggatgaatggatgggtgggtggaggaatggataaatggacagatgaataaatggatggatgaaaggggggatagacggattgatctatggatagatggacagatagataagtgggtggatgggtgggtggatggatggttggaaggataggtggatggacagattactgggtggctggaggggtagagagagatgggtgggtgggtggatggatggatagatgggtggacagattactggctggctggatggatgggtagagatagatgagtgggtggatggatggatggatggatggacgaatggatggatggatagataagtggacagacggatagatagctggatagatgggtgggtagaagaagaatagatggatgagtggatggatgagtgaatagatggattgatggacaaacaagtaaatttttacctgacatttttgtattgtgtaactttctgtgtgttcattcattgggaaacaattgtgatacatggatattggacttattagctcacgtctgctgataagaaaacaacacagggccatagagttcattagcagtggactgggatcaaaacgaagggctctttgattttgagttcaggccatttggaccactttgccttgtgactgcccccaaatcactggaattttcctcggggttcacagcgcccaaaggtaaacagtatttggtagcctagagttcatacattggaaatttcatggtctgtgccccctcagtggtgcaaagcatttttacagcaataattaatttggcaataacttagtgtgtgagcctgtgtatgcgtcttttcagctggctagtacagtaccagtgatgccatgtttgcacactaaataccagccagagacatgcaagaaaagaagggcaggccaggcacagtggctcatgcctgtaatcccagtactttgggaggccgaggtgggtggatcacctgaggtcaggagttcgagaccagcctggccaacatggtgaagccccatctctactaaaaatgcaaaaattagctgggcatggcagtgagtgcctgtaatcccagctactctggaggctgaggcaggagaatcacttgaacctgggaggcggatgttgcggtgagctcagatcacactactacactccagcctgggcgacagagcaagattacatctcaaaaaaaaaaaaaaagaagaagaagaagaggggcacagcctaccagatctgctgagacacatgttttttatctgaacttttgggggtcaactcaaaatccaatcaacagatgacaatgacatcctaaaaactgttcccagatcagacagtaaaatttcacagattctgtctttgagtcatggggatttacgtctctgtagattcaggagaaacatctcatgcatacagttccagagagtcagggaccagcctcttctgtaaagagggaaacaaaatgaaattgcgcattggcatggaccggacgcaagaagacatcactgatttaagctcctttacaaactctatcctaggaagcactttccttcttcactttcagcagtcaagcctctccaatgtcattgcgtctaaacctgttgacatgatggggctgtggttcacctggaagatgggctctattcctgaccattctgaaggcaaagaacttgaaataagttcaaattcaagttgcagcacatccacggagcagctggaagtgctgcctgtggcctgtcgtaatggcagggtagcagtgagagagaaatatatttcctcacccatcattgggttcatgactaaggcccctagaacaaaagacaatagcaagagaaaagcaggcccatgtatttaggttttacgtgacacagaagccatcataaagaaagaaacaggaaaatctgagtatttttacgcttaggttttctggttttttgtttgtttgtttgtttgtttttgagacggaatctcactctgtcacccaggctggagtgcagtgacgggatctcagctcattgcaacctccacctcctgagttcaagcgactcttaccatgttggccaggctggtttcgaactcctgacctcagttgatccacccacctcggctcccaaagtgctgggattacagatgtgatatgcttacttttaatgaagagtggacagtgatggagaagtatgactattggacaaaaacgttacaggaatggggtcccaatccagaccgcaagagagggttcttggatctcaagcaagaaagaattcggggtgagtccatagagtaaagtgaaagcaagtttattaggaaacaaaaggaataaagaatggctactccatagagcagccccgagggctcctggttgcccatttttatggttatttcttgatgatatgctaaatggggggtggattattcatgcctcccctttttagaccatgtagggtaacttcctgacgttgccatggcatctgtaaactgtcatggtgctggtaggagtgtagcagtgaggacgaccagaggtcactgttgtggccatcttggttttggtgggttttggctggcttctttactgcaacctgttttatcagcaaggtctttatcacctgtatcttgtaccaacctcctatctcatcctgtgacttagaatgccttaaccatctgggaattcagccaagtaggttttagcctcattttacccagctcctattcaagatggagtggctctgttttacatgcctctggcaaaaggatctgatctaatgagaataaactgcgggaacttagcagggcctgtttgttcagattcttctgtgtccctgcatgttcagagttaaggatattctcttcctcctggtatagggagggcgcctctggaatgagggtcccctgacctgcttcagggtaaggtcagagagtccttccgaggttttatggcctatgctaaagaagaaccatgagggtaaggtgaaagtgaccttcttacttaaattgttttctcaaatgccacagttccatattttggtggaatgttttctgaaccccatcaggaaaagcaaagcaatgagaaaacaatctggggggacaagacaaggagatataacagatgggggaggtttgtggttgactacatcactcttggaggcattcgaccgaggaatatttcagaatctctggtaacacacaccaggaacagcctaatctactccctaaaaggagtctagttcattactgagtttatggcttccctacatttccctgtttctgaccacaaccatttttttttttttttctggagactgggtctccctctgtcgcccaggctggagtgcagtggcgcaatctcggctcactccaacctccgcctgtcgggttcaagcgattctcctgcctcagcctcccgagtagctgggagtacaggcatgcaccaccacgcccagccaatttttatatttttagtagagatggggtttcaccatgttggccaggctggtctcaaactcctaacctcaggtgatccctctgcctcggcctcccaaagtgctgggattacaggcgtgagccaccatgctcacctcccccgcctgcccaatttttttttttttttaattagccaggcatgctgattgcttgagcctgggagatgaagactgcagagatgtaattgcaccactgcactccagcctgggcgacggagaccctatctcaaaatacaaccaaataaaacaaaaaacaagaatgcagactcagagtccagccaaaaccaggttttagctgcaagacaggttataggaaggagaaaggaaaaggctttcctagcaaaagtgggcttgttatgtacatgcagcttcacaggtagcagcccccagagagaagagatgctgaatatttcttttcaggtctttaaaggcaccatactctcagttaatctctcctagatccggacaagagaagagttggctgccttacaggagaccctctgcagatcgacagacgcaaggtcccccacaaaagacagtgtttcttcttcttttttgtttttcttcaaattttattgtaaattcaagggtgcacgtgcaggtttgttactaagtaaacatgtgccatggtgctttgctgcacagatcaacccgtcactcaggtatgaagccagcatccattagctcttcttcctgaggctctccctccccctacccccgaccttttcacagaccctagtgtgtgttctcctccccgtgtccatgtgctctcattcttcagctcccacttataagtgagaacatgcagtattttattttctgttcctgcattagtttgctgaggataacggcttccaactccatccgtgttcctgcaaaggacacgaactcattcttttgtatggctgcatagtattccatggtgtatatgtactatttcttttttttctttctttctttttgaaatagagtcttgctctgtcacccaggctggagtgctgtggtgcaatctcagctcactgcaacctccgcttcccgggttcaagcgattctcctgcctcagcctgccaagtagctaggattacaggcacccaccatcacacccagcacatttttgtatttttagtagagacggggtttcaccatgttggccaggctggtcttgaactcctgacctcaagtgatctgcccgcctcagcctcccaaagtgctgggattacaggtatgagccactgtgcctggccaccgcattttctttatccagcctattatttaggcatttaggttgattctatgtctttgctattgtgaacagcgctgcaatgaacatacgcatgcgtgtatctttataatagaatgatttttcctttgggtacatacccagtaatgggattgctgggtcaaatggtaattctgccttgaggtctctggggaatcgccacactgtcttccacaatggttgaattcatttacactcccaccaacagtgtcacagtgtttctatttctccacaacctcgccagcaccggttgtgttttgactttttaataatcaccatcctgactggtgtgagatggggtctcattgtggctttgatttgcatttctctaagaatcagcggtgctgaggtttttccatatgttttttttggccatatgaatgtcttcttttgagaagtggaaagatagcatttcaggagtattccccaatatattaaagaaatatattttgagataaaatatttttatttcctttagtacattttatttatttatttatttttctttgagacagggtcttgctctgtcacccaggctggaatgcagtggtgtgatcttggctctctgcaacctccacctcccgggttcaagcaattctcctgtctcagcctcccaagtagctgggattacaggtgcctgccaccacagctggctcatttttttctattgttaatagagatgggattttgccatgttggtcaggctagtctcaaactcctgacctcaggtgatcaacccgcctcccaaagttctgggtttacaggtgtgagccactgtggccagcctgtttcttttcttatacaaacaaacctataatggtaaggtttaatttatgaattaggcacagtgaaagattaacaacaacagactaataataaaatagaacaattacaacaatatactgtagtaaaagttatgtgaatgtaatgtgctctctctctctttcatgtgtgtgtctcactctctctcttgaaatatcttagtattttcagccatagttgaccagtgataacggaaaccacatgttgtaggctgttcttgcattgctgcaaagaaataccagagactgggtaatttatacgaaaaaaagaggtgggccgggcacggtggctcacgcctgtaatcccagcactttgggaggctgaggcgggaggatcacttgagatcaggagtctgagaccagcctggccaacatggtgaaaccctgtctctacaaaaaatacaaaaaattagccgggggtcatggtgggtgcttgtaatcccagctacttgggaggctgaggcaggggaatcgcttgaacctgggaggtggaggttgcagtgagctgagatcacaccactgcactccagcctgggcgacagcaagactcctgtctctctcacacacacacacacacacaaaggaggtgtaattggctcatggttctgcaggctatggagaaagcacggcaccggcatctgctcagcttctagggcctcaggaagcttccagttatggtggaagatgaagtgggggtaggcacatcacacgggaaaaacaggagcaacacgggggtggtgagggtgccacagcactaaaacagccagatctggcaagaactcactcactatttcgaggacagaagtaagccatgaggaatctgcccccatgacccaaacacctgccaccaggcccacctccagcattgggcatgacaatttgacatgagatttgacagggacaaatatccaaactctttcaccgtggaaagcaaaaccacagatggggcgggagggctactgtacattgtgcagaaatgcagctcctcggagccggctgggggaaggagcaggtctctcagctgctgaacagttttgggagattacctaccatcacttctctctgtcccagaatcacacaaaatggtcagctgtgccaagtgccttgcccagttctctgcacctttccttctgtctccttccacgtgtgaccacccccttcaccatcctgtcgtcgcgtctaaagctccctccacacattgcgtgatagccagtaagtctagacacaaggtgtgaaggtaaggacagcaactttattttgaagaaccagcaagtcaagaagacagaagactgctgtcctaaaaagccatcttttttttttttaatttattattatactttaagttctgggacacacgtgcagaatgtgcaggtttgttacataggtatgcatgtgccacggtggtttgctgtacctgtgaacccatcatctaggttttaagccccgcaggcattaggtatttgtcctaatgctgtccctccccttgccccccaccctgcaacaggccccggtgtgtgatgttcccctccctgtgtctatgtgttctcattgttcagttatgagtgagaacatgtggtggttggttttctgttgctgtgttagtttgccgagaatgatggtttccggcttcatccatgtccctgcaagggacatgaactcattcttttttacggctgcatagtattccatggtgtatatgtgctacatattctttatccagtctatcactgatgggcatttgggttgaaagaaccatcttaatagaattttaggctgcttttatgccagggggagagggagggtggtagagggcaagaggtgagcaatgaccacagacatctgggcggctattatggtccaaggggccttgtggaacttcctcatccttggtcaggtcacagtgctcttataaatctttgacataacattgttccttctgcgcacatcctcctgatcccctcgggggttatttttgggaagggactatgatcattcttgctttaaagttaaactgtaaactgaattcatgattagcttgacctatttgtaggaatgagcaaatgcagttagcttgtgaggtgagaagcaagacagagtgaactatgttagaattttctcactgttacattcacacataggttcttggccaaagaagcagacgaccaacacattctctctttttttttttttttttgagacggagcttcgctcttgtcccccaggctggagtgcaatggtgcgatcttgggtcactgcaacctctgcctcccgggttcaagcgattctcctgcctcagcctcctgagtatctgggattacaggtgcccgtcaccacgcctagctaattttttatatttttagtagagacagggtttcactatgttggccaggctggtctcgaactcctgacctcaaatgttccacccacctcagcctcccaaagtgctgggattacagatatgagccaccacgcccggcccaacatgttctcttgttagaggcatttgaaccagagcaactcaatcttgaataggagctgggtaaaatgaggctgagacctgctgggctgcattcccaggaggttaggcattcttagtcacagaatgagatgggaggtcagcacaagatacaggtcataaagaccttgctgataaaacagtttgcagtaaagaagccggccagaacccaccaaaacccagatggcgatgagagtgacctctggtcatcctcgctgctcattataccctaattctaatacattcgcttctcaaaaatactcccaacagtgttgtgacggtttacaaatgccatggcaacatccagaagttaccctatattggctaaaaggggaggaaccctcagttatagaaactcccgtttcccagaaaactcttgaatttagcatataatatggcattcagattatatgctaaatgccctttgtttagcatataatcaagaaataaccataagtatactcagtcaagcagcccacgcttctgttctgtctatggagtagccattgttttactcctttactttcttttttttttttttttccctgagacaaggtctcgctctgttacccagggtggagtccgttggcacaatcagagttcactgtagcctcaacctgttgggcttaagcaatcctcccacctcagtctcccaagtagctgggaccataggtacatgccaccacacccagctaacttttttatttttggtagagacggagttttgtcatgttggcaaggctggtttcaaactcttgagctcaagcattccgcccatctcagcctcccaaaatgttggcattacaggcatgagccaccctgcccagcccttttactttcttaataaacttgctttcactctgtggacttatcctgaattttttcttgcatgagatccaaaaactctcttggggtttgaattgggacccctttccagtaacactttgactcctctcctgttcagatgtcatcactccctccagcaaacctggagtgttcaaactcttttccatccatcctttcctttcaaggcaaagaggcaacttggctattctcatagacacacagataggagatgtaggaattcataggagacattcaactcagatgttagatctattgataaacaagatggcagcttgtcttgctgcttagatataaaagatgctgttgcttgcttgcaaaaaaaaaaatgaagcacgttcctggagttcaccaatatggcgtggactttacctcctcaacactgtcagtcagtgcaagatggtccaacctctgggtgccaagacacgtgatcattttcccaatgccattctcttatcccttgagcctgctttcccacctgctaaggtttggatctgtgttcccacccaaatgttatgtcaaattgtaatccccaacgttggagctggggcccattgggagatggttcggtcatgggggtgctttttcatgaatggtctagcatcctcttcttggtgctgttctcatgctagtgagtgatttctcacaagatcaagttgtttaatagtgtgtggcacctcccttctcactctctctcctgctcctgttctaaccatgtaagatgcacctgcttgccctttgccttctgccataattgtaagtttcctgaggcttccccagtcaggcttcctgtccagcctgcagaactgtgagccgattaaacctctcttctttatcaattacccattctcaggtatttctttatagcagtacaagaagagccgaatacaccacccattgagcagattggaagtgcaagaaaactagcatatgcccccatcctggaagcaacctcagccaacacatgttgggaaacgacagaaaaagaccccggccttcctcactcttccggtgggatgaccctgagtctccaagctctcattgcagtcactggcctgataatatcttccactctctgtcttcactccctctcccctcccactgctccctgggactcacccccgcccaccctccccaaacacaaaagctttgcggtaaaatcacggtctcaaggtctgctttggggagaaaagagtcacctccttgaaatctagactttctgtgcttccagaaaacatgttgaaacgttacctgtcaattaaattccgggaagcctgggtgtgtcacactttgaatcatgtggacagacaccatgaagagcctggagtttggtgaactttgttgaaacccctccatcactctcgtggtcgaatccaatccaatcctcatgtcctcatgagttcgttttcatttcctaaatgacatccatggaaaaataatggggagagaggaaacacaattttacatttgtatctgacaggctctgaaagggagctagagaatgtagttagcatccataaattatggaagagggtatttcccatcttcttaacacatgcaacacttctaaggggcctgcaaaaaccccagcagcctttcaatgtcccccacatcttagcacacataaatatttacatctgtcctatcaagaaacaaatatgcatgcatatcattattttggagatatagcgtgagcactttgtttgcaagaaaaaaatatgcatgcatatcattttggagatatagtgtgagcacttatatttgtttgcaagaaacaaatatgcatgtatatcattatttttggagatacagtgaatgcacttttcagttacatgctcaaaatggtatgctaaactgaaagtggttgtcattacccttaatttctgcaaggaataaacaagtatgtcctggtggcacattgctatgaataaagcagactatttcagggctatgggagttctatggaaagcgtgagccaaaacatggtttttcctgtgtcttgtttatgatgcttattcataatgggagggaacagaatattggcttcattcatgtccttgatttatgatggaatccataggaatctgccaccttgggtgaatgagcaatacctaaaggaatgtcctataagataccgagatatgccacccaaaatatgacttaggagaccaagatacgccacccaaaatatgacttaggagaccaagattgcgatttttataaaaagctcatcagcaatcattagggttagtgggcttttttggttttttttttgtttttgtttttgtttgtttgtttgagacagagtctcactctctgtcacccaggctggagtgcagtgacatgattttggctcactgcacactacaacctccatctcccaggctaaaccaattctcgtgccccagcctcccgagtagctgggagtacaggtgtgcaccaccgcacctggctaatttttgcattttccttttagtagagatggggtttcaccgtgttgaccaggctggtctcaaactccaggcctccaggaatccacctgccttggccacccaatgtgttgggattacgggaaggagccactgcacctggccagtgtatgtttgtaaggctcacccacactgtagcatgtgtcagcacttgaaacctttttctgcctgaatcacattccactgtatggatatgccatattttgttaaatccgttcattggctgagggacgtttgggtcaccttcactttttggctattttgagtagtgcagctatcaacattacgtgtataaatgtacaagctatttggtggacacgtgttctcgtttttctcttgagtatgtgcccagaagcagaattgctggctcatagggtgatgtggtttggctgtgtccccacccaaatctcatcttgaattcccatgtgttgtgggaggtaattgaatcatggggacaggtctttcccatgctgtactcatggtagtgaataagtctcatgagatctgatgattttataaaagggagttttcctgcacaagctctctctttgcctgctaccatccatgtaagacgtgacttgcttctccttgccttctgccatgattgtgaggcctccccagccacatggaactataagttcattaaacctctctttcttctgttagttgcccaattttgggtatgtctttatcagcagtgtgaaaacaaactactacatatggtatgtcttcggttaaccttttgaggaaacatcagactcttccatctctgtatctttccaatttcaatctaaacggactcaaatctgactcttagactccactcccctgggaaatgtgatgtcggctattattgcggttccctctcctccctagagtctcctaagaatttgggtcatgctccattttcagacaatttgaaaattggtctgttatggtctctgctctgaaaagcttcattctcatcccacctcctgccccggcttccagcagcctcccttaaaattctggggatgcagacatctgtgctgaggctgagaagccaggagcctggagaccagcgtccctgggcaggtgcagtggaaccagctggccatgtgccaaaattcctgtgacccttccctggtactgtgctgtctttgctgagagctggccgcctgctcaggggtccctaagtcttacactggacaactggatgagtgagaaataattatttaattgttaagccacagaaattccagggctcatgtgttacagccagtcatttctcatgaactaatacagtagatggcttggatcaaccccctctgatgggatgctgcttctcttctcggttggtggaaaaagaatttccatcagtctctctctccttgtctctctctctctctctttattccttttcctttctgtctccatctccctctccctgactcttctggcccctccctaccattgtcagataaaatatcaggttgcacacggtaacgcacgtctgtaatcctagcactttgggagactaaggcaggaggatttcttgagttcaagagttcaagaccaccctggacaacatagtgatacctcgtctctacaaaacaaacaaacaaacatattagctgagcatggtggcacacgcctgtgattttagctggtctggaggctgaggtgggaggattgcttgcccccaggatgtcaaggctgcagtgagctgtgatggcaccacttctttctagcctgggtgacagaacaagacccccatttcaaaaaaaaaaagacacaacatcatcaaaaattgtacttaaatataaaagtttgaatactgaaaagtctcccacagcaagcaggctttaaaactccaaaatctatctgtacacagcacttttttttttttcactcttctcagatctaagaacgatgacaggtggccatggtgcctcgtgtccccttgcaggggtgcaggggtacacacaccttttttttttttttttttaatttgagatggaatctcgctctgtcgcccaggctggagtgtagtggtgagatctcggctcactgcaaactccgccttccgggttcacgccattctcctgcttcagcctcccgagtagctgggactacaggcgcccgaccatcacgccaggctaattttttgtacttttaatagagacgggggtttcaccatgttggccaggctggtctcgaactcctgacctcgtgatcctcccgcctcggcctcccaaagtgctgggatgacaggcgtgagccaccgtacccagcctcggtgaaaacctcagaggcaggcagcatattccctgccgagccggtaggtggcgcagtcagataagcattaactaaatcacagctccctctccccatcagaatctttatctagagggtaaccccaaacctgagaatttggtcaggtccgcacacacacaggcatcatcattcttcagcgccatcatgaagggctcttctccccctgttaaaggaaactatcacatagtcttccgaaacagccagtcaaaaactttgtgatgcaggaaagaacaaaaaaaaattaaaggacgattacagaataaatatttacatttctgcctgtaacacggactctgaagcattggaataatgaggacttgcacaccgcaaatgggcatcaaaatcgggctttatacttgaaaaatgaagttttgtgtcaaagaaaagggacatttcaaacaccacatttatgtttgacccacatatacatgtgattttagctggtctgatattatattatattatatatatatatatttgtttgtttgtttgttttgagacagagactcactctgtcgcccaggctggagtgttgtggagcaatctcggctcactgcagtctccgcctcctgggttcaagtgattctcccgcctcagcctcccgagtagttaggactacaggcgcctgcttccgtgccctgcctcggcctcccaaagtgctgggattacaggcgtgagccactgcacctggccagtacctttatacccttctggaaagagaacatgttccttcccctgttgacactgaattatgtcaacagttctcccccaagtaatgcatgggtttaaatcacacaggtgatttcaacttgctgcccccactatttcatttgacaaaggacacagtcctgcctacctgagaggcagtggctctacgtaaaaagttttaacacacaggaaacaccattaaagggttagtgactaacccatatttcctgtttttttggtttgtttgtttgttttccccacacatccccactggcctgaatgagacctcaaggtgtctcattcttactttatcttacaatcactctgatggtcaagaagcttgagcacatgggaattcttaaatcaaggcacatgattgttacaaagaatagacgctgaggtgggcggatcacctgaggtcaggagttcaagaccagcctggccagtatggtgaaaccccgtctctactaaaaatacaaaaattagatgggtgtggtggcacgtgcctgtaatcccagctactcaggaggctgaggcgggagaatcgcttgaacctgggaggcagaggttgcagtgagcggagatcatgccactgcactccagcctgggtgacagagtaagactccatctcaaaacaaaaacaacaaaaacaaaccaaaaaaacaagttaattagaatgcatggccaacgttgtgttccccagctctgttggttttcacatttttttccacaaacgaaataaaaatgaaagcaaagcttaaagctaaaaagcatacccatttagacaatctgtaaatatatactttgttgaaataacactgtgagagtttgtgcacatttctttggttgttttcgtcatctgaatccatggctgactggctcccactctgctattttaaaaataaaatgtcctttcttctatcgtttctgtggttttgtcgccaacccatatttgctggaataaggtagtaaaaaacatacactaaagtctgaagtccccatcagctctgctaacttattactagttttcacacacactgagtttaatgaatctatgttttggaacaaagcagttaccttaggaacttgagagatgtttccggccaggcgcggtggctcacgcctataatcccagcactttgggaggccgaggagggtggatcacaaggtcaggagaccgagaccatcttggccaacatggtgaaagctcatctctactaaaaatacgaaaattagctgagcgtggtggcacacacttgtaatcccagctacttgggaggctgaggcaggggaattgcttgaacccaggaggcggaggttgcagtgagcctagattgtgccactgcgctccagcctggcgacagagtgagactctggctcacgaaaaaaaaaaaaaacctagagagatgtttccttgtaaaaccaccccattctaaaaagcaggtgggttacatctgcttccctgtaaagagaactctttctagtgttagctgctctgttcatagataaaaaatgctggacacctaaaatgttagtttaaatttattaatagcatctacataaaatcttagctatttcacacaacactacccactatcatatttgaaataatctgagcaaatagtaaaaagacatatcccaaagacaacaacactggcagactaaagaaaagcagaaaccatgaactaagaaggtaaaatgcttttgaacctctaagcgactcctgctattacggaaacatccgttttcgtccattgggttttatcggtttttatcattggctttgtgttttgcctaaattagcaaatatagcaagtctgtttatgcctcagttaacctgtagacttaacctcactaaaaataataacacattaggaaaaactatcagaaaaaacaataaccacacctccgccccaacacaaaggcacacataaagagggactggacacaaatccataccacagacttgatttggtttacaaacttgattttgtaacccaaatcctttttgtttttgagacacagcctcactctgtcgccctggctggagtaccctggtgtaatctcagctcactgcaacctccgccttccgggttcaagcaattctcctgcctcagcctcccaagtggctgggactacaggcacattccaccacggctggctaattttgtatttttagtagagacgaggtttcaccatgttggtcaggctggtcttgaactcctgaccacaggtgatccacccaccttggcctcccaaagtgctgggattacaggcatgagccaccaagcccggctgcaacccagatcttgatttttgaccttgatttgacccacagatttgggaatgagaagtgattacagagttggagccttggagggagagagggtttctcatgtgagcagggcatggagaaacagtagtcaaaatcctgattttgaccaagattttttccaaatcttgatttttgaccttgatttgtaaaccaaatcagttttgttttgtttcctgcttttttgttttttgttgtttgagacggagtctcgctctgtcactcaggctggagtgcagtgacgtaatctcggctcactgcaacctctacctcctgggttcaagcgattctcctgcttcagccttccaagtagctgggacaacaggtgcccgccaccatgcccagctaatttttgtattttaggagagacagagtttcaccatgttggccaggctggtctcgaactgctgacctcaagcaatccacctgcctcagccccccaaagtgctaggattataggcatgagtcaccatgcccggccaaatcagtttcatatagcaaattgcgaaagctggtcactggatcacctgagtttgaattattttgaatactgatgacccaacgtgcagatccaggagacagagccaggacccaagattttcaatcctccaaaggagcccaggattgtcaagaatttgggcaagtttcctctggttaaaaaacaaaacgcatgtttcagcattcaaagtgaagcagaggaaaagcacttattattcaattactttaggcaattgagtcaagccagagatagacacgatccaaaaactcttgggaaagatgttccatcttctacatggaatgctggacctatcccaaagttctccagggataccctgaagagttgtagcacattcaagaaagtacacacgtttcttcagtaaacagacccagagatagctgtccacctggagcagattctggtcagcccatgagcagctcttactcacacagatactgagccaatcagaagtgataaaatccttccaatacttctaatcacccaggaatgaattagtcaatggggaacttttcctgtcctcatctgcctgccccagggctcatggttcatcttgtccatgagtttctacatgcaactatgagctaaaataaaaacaaaccggcccaggcatggtggcttacacctgtgagcactttgggatgccgaggcaggcagatgacttgaggtcaagagttcgagaccagcctggccagcatggagaaacttcatctctactgaaaatacaaaaattagtcgggtgtggtggcgcatgcctgtagtccccgctacttgggaggctgaggcaggagaattgcttgaacccaggaggtggaggttgcagtgagttgagatcgtaccactgcactccagcctgggcgacagagtgagactctgtctcaaaaacaaaaacaaaaacaaaaacaagcaaacaaaaaacccatatacacagatgaaaaaggagaagtcctaatcactgatagtaaatcaatagattaccgtccacgttagaagctctgtatctcaggaccaaacaaccacaagccacatatggagagagcgtttagtagttcacacattgtgatttaggaagcaaccacttctctgattctaaaataattcactctagggagagtggctgccctgaaacattgccttcccaccatatttagttcaagaagtcactcagggatgaggaaaatgaaggatatgtacatgactgaaggattaagtggcagaaacagcattttatttttatttttatttttgagacagactctcgctctgttgcccaggctggagtgcagtggcgcaatcttggctcactgcaacctccacctcttggattcaccatgttggtcaggctggtctcgaactcctgacctcaaacaattcacctgcctcggcctcccaaagtgctgggattaccggcatgagccactgcactcagccactagcttctaataatgataattctactctctacttctatgagcttaacttttttgtacctcccacttacgagtgaaaacatggggtatttatctttccatgcctgactttcttcactgaagatattgtcttccaagttcatctgcgttgtcgcaaatggcagatttcattttttatggctgaatagtattccatgatggatagataccacattttctttgtctagtcatgtgttaatgaacatcttagctattatgaagagtgttgcaataaacttgggggtgcagatatctcttgcatagacagactttcttttaaaaatgtatacagtagtaagattacggaatcatatggcagttctagtttgagttttttgagaaagtgccatacagttttccatcctggctgtattcatttacattcccaccaacagtacatgagtttccgtttgtcccaatcctcaccagcgtttttcactttttgtctctttgataatagtgattctaactagggtgagttggccatgaatctgccttttctgggggagatttgtattcagatcctttgatttttttttttgagacagagtctcactctatcgcccaggcctggcaccatctcggctcactgcaacctccgcctcccgggctcaagtgattctcctgcctcagcctctcaagtagctgtgattacaggcacccaccaccacacccagctaagggttttgccatgttggccaggctggtctggaactcctgacctcaggtgagccacctgcctcagcctcccaaagtgctgggattgcaggtgtgagccaccgcaccctgcccttttggtaatttttaaattggattactgttgtttactcttgagttgtttgagatccttgtaattttccagattcatcccctttcagatgagtcattattatccccaaatatttgtaaatattttctcctattctacagcttgtctgtccactcggttgattgtttcctttgctgagcagaagcttttctggtttaatatagacccatttatctatttttggctgtggtacctgtgctttcaatttgttgcccacaaaatcgtggcctagaccaaggtcctgaagcatttcctcttcttttagctttagtcatctcatcgtttggggtcttatatttcagtctttaattcatgcggagtttgtttttgtatatggtgagggatgggggctagttgtgttcttctgagtacagtatccattttttctagcaccatttattcaatagagggttctttcctctgtgtacttccctgctgcttttgtcaaaagtcacttgggtgtaaatccatgttttttttttttcctgggatgtctattctgttctgtgtcttcctacattaaaaatcacattataggccgggcacagaggctcatgcctgtaatcccagcactttgggaagccaaggtgagtggatcacctgaggccaggagttcgagaccagcctgatcaacatggtgaaaacccatctctattaaaaaatacaaaaaattagccagacatggtggcgggcgcctgtaatcccagctactcaggagggtgaggcaggagaatcacttgaacccgggaggcagaggtttcagtgagctgagatcgcaccactgcaccccagactgggtgacagagcgagactctgtctcaaaaaaaaaaaaaaatcaaattctatttgtgagaaaggaatcgtggtgtattggctctgacacctgccttatacctttccatctggatgttctttttgctcttggcttcactgtgggtgtctgataaattgtacagacaaaagtaagtttacaaactgtctgaaactttggtgtttcttcccctgaggaattcccctgaggaataccaactcttcatgtgcagagaagtggaagtatagaaattcaattatccatcttctctcagccgatgaacagctagaggctggaaacgcaggttcaattgaaagttagaagctgctgccctggaaatgtacacactatcgctgagcgaggaccttttcatgcactgtgtgggcacgtgcacacacacccacccacacacacgggtacgcgcgcgcgcacacacacacaattgatttcctctctaaagtggcaagaagaagctgcctggctgcaagccttgctggcatgggtcatgccatctacaaaactgttcccttgctccccacttctgctcgaaaacctttcacagactgcagattcaagggaaagccacgccagccacccggctatctgctgggagaccctgaggtgggctcttctctttgccgtcagcaggaagagggtctcctccctcccacctgtgtcatcctgggggaagagctgtctctggaatggaaacaccgggtagaagggtgcagaggagagattgcatcgccactttagtgcttgatgaattcctttttccccgacccacacagccctctgatatcatggtccattttcctggcatccttcctcagctgcaaatccatcctagaccatagcaggggaggctatttttacctgggtcaggtcctatcttctcctttgttcctgtttctgaaggtcaggaatgccttaccctcgggagccaggctctcagacaaaggctctccaaccctgaagctctttctgtctcccagaaccatggggcatcggtgctggggtcactgcatgcaggtataaaattttccctcagtagtgtgtcactgcaggcaggcgaagacttctaccaggcatcgtggaacagctcctgctcaccggtgttaggggccacagggagcggagacaaaaatcagggcatgaaaggcctgaattgtgtatttgctgggaaactgggtggtccctgttcttaccatgtcatggattcctggtgcaagccctatgcccctgtccaacagccccagctccctccctcccttaaagagagtattcaggatgcccagctagggaggaactacctcctttcccaagaatttgggctccttcggccttctgtgctgtgccctgacctgttcgtgtctccaccagacatcagccctaaacacagctcacacttcaggaaaaatgtgtgtgcacccacgtgccaccatgcctgtctctccattccccagggctaagccccagagagtaagggacaaacgtggggtggagggctttctgtgatgcgagggcagaaacctggatccttacactaaggcgtctgtgtgcatcgcccctttatcacgggactgagtctcacaccaagacgtctgcctcaccccttcatcacagaacccagtctcccccttccccttatagaagctgtgactctgggcaagggtgtgtacttttttcctgcctgggcccatcctgcttggtatcagcaatgagttagttgcaacttgaaacccccttccctgtacaagagacacagagagagagagagaaagagagaaggggcagcttctctccatgagcaccttcattctttgatgagaatatcgcagctcacccataccggggtgcagggtgagagtgaggaaaagaggaaaggaaggggactcccaaagaaggggtgagatgcaagacctggacgagagagatatccaccgctgcgctggagagagggggccgggaaaagcagagaggtgggagaggtgatggaaaggcgcgcagtcggggacgcctgctctcccccgaccctccccatctgcaaagggaggc

SEQ ID NO: 5312 - DNA, 882 bp, Homo sapiens
caaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaa

SEQ ID NO: 5313 - DNA, 2592 bp, Homo sapiens
tttttagtagaggcagggtttcaccatgttggccaggctggtctcgaactcctggcctcatgtgatccacccacatcagcctcccaaagtgctgggattacagttgtgagtcacgcgcccagccctgagtaaagccagtatttaagagaagaggaacctacaaggtatcctgagaaacagataggcatctagaattaagttaagtatttgttaggttatcatttaatgtctgctttcaacaagtatgcaatgtcttacagagaaaattcaagttttaaaaagaaaaaaaaatttgcttatagtaaagttactgaaaaagaaaaagttctttcagaataccgtaacatggcttcctgggacaggaaggaaaccaatgagatacaccctcctgacctcttaccagtacttcaaaaagtgcaataaagctggttgagagaaacaaagaagtttctttggagacctactttaaacgcttaatccgtgccaaaagtccaaagtccatgaagctaactacctttggatgaattttcaaggcagagataaaatctccaatgtgcactttaatgactaatactagttttgagagacattactacacatctatgctctgggacagaccaaaccttcagtctctacgtcaatggtacaacagagtactattctccccagtagtgttactgaatttgcgactcactgagttggaagagctgcttaaaggtttatcatcatcaaaagccatttattagggggtgttcttgtttttttttgagcaaagtgctaaaaactccgttgtacgtttcctaccccatcatagtttacaactttgttgggtaagatcaaatgactccaaaaaacacctctggaatttcaatacaagttgcgatagttaagtgccaaaacaagcggtatgacagctgtcgggatgcagaagtaatcagtaaagcctggatcgtgtaagaaaatggggcttgagccagactttaaggaaaggccaagcagtcaagaaggaatatgatgtccaaggaatatcataggcagggtacagctgacagcaaaggcacagatgcagcaactgtgcctagaaccagttgatcagttttattgcaataagaggttcatgtagccgggttgtggtagataaaagcagataagtagacaaaaagcaagacggtagagagccagaccacagcattttgtactttatcctatgaacagtacatagccagtgaaggttttatgccgaggtagatgacggatgcaaagcacaattttaggaaaattaatctggcaactgtgtatagaaaggttaatggaatatcatcattgtgacgaggtatacatgtgtcaaaactcatcaaatgtatacacttaaaattgctgaattttactgcatataaattatacctcaggaagaccaattttttcaaaacaaaggacaaagataaagacaagaataagcagattattaaaatacaggctggaaaaaaagtcaggctgtaaaatcctgaatatttgatagctgagattaattcaagccagctgattatacacattttttcccaacttcagcaacataacactagtagcctgaaaccagccatgatagagtatttatacctcagaaatcagcaaacattacaaatcagggctttatccccctccccagggtggttgttcaatattcaccagcacaccactgtgtaatttctatacgaggtttggcttggatatggtgctaaatgaagagttcctcgacatttcttctcactcaaaataatgacataattccgaagcaccatatcttaatcttaccagcagtagacagttatcaaaaaagtgttaagatttaagagtctaacattttactagtttcaagaattaaagcatgcccatgaataagaaacctttgtgtctcccaatcaaggtttctagctattatgtggtttgggactaacaccaactgatgatgacaatgcacaaaaaattccaccattcattccattatactaaaggctaattgcatgggcctattattggaatatgctttcctagttcaactagctgcatttcaatagagtaaagagggttttctggagaaaccctactgtgaaaagatgaactttgtcttaacaactttagtttcaaaaactattcatttatagatgcctatttcacgtctctgaagcaaaatggttcatttgttatgtagattactaagcagtcagtcacttaagaataaaaagtttcttctttagaggctccagctaactgtctgcataggttcaatctaaaaaccagcaaagcatactgctaaatatgatagcaaataattgtttaaacacaaatgagcaccaccttcaaattttccaatccactttccaagggccaatctatgattatccccaacaaagactggagcccctctctctcagagaaggaatacaaaacacaggagaaagatcataaagaactatgtaatataaggagcagggagaaaatgtcaggtgggaaaaatggccggaaatgggaagaagaaacatgtacaagaatcaccaggagagtgacattccccgccccactgatacctagaga

SEQ ID NO: 5314 - DNA, 511 bp, Homo sapiens
ggccccttcacctaccaaacgcaaagaccgctcagatgagaagtccaaggatcgctcaaaagataaaggggccacgtgagaaggatcgcggccgggacaaaacgcgaaagaggcacagcgcttccagtggtagcagcagtaccaggtctcggtccagctcgacttccagctcaggctccagcaccagcactggctcaagcagtggctccagctcttcctcagcctccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcaccaggaatgtgacaaaggatcacatcatggagatattttccacctatgggaaaattaaaatgattgacatgcccgtggaaaggatgca

SEQ ID NO: 5315 - DNA, 3755 bp, Homo sapiens
agaggtatccacgagggaggaggtggattgtgacacctgggagaatgaaggcggagatgggtgaattgctaattcagaccttggagaagaggcagacggatccagggggtctccatcaaggaaggagcggtggcggacactaagaagtgtaaatagggaaggggcgcggcctctgtgtggtcagggcggaccccaggggtcccggactcaccttccgcataatcttccggccatagaagagcactttgtccctcttccggaaccgataccgggggccatccggggctggggtttctggggataggtggggacaggggcactccgagctctgtgcagactccaccctgccagagctggggtaccgcgaacagacgccagcaaatccccatctctgccgcctcgggacccgggcatttgggccccccaccatacagcctcccaagaggggcccctcgggtgctcacttggcactcgcagcctccgcaccaccaggaggatgagcacggccgtgaccaccaccgccactccggccccgatcatcacgccaagcacctgagggacgaacggcactggctgcgcaccgcaaatccgtcccgccgagccttccccgggcgccaggacgtcctggaacccatccctctccgccaccttcgcccccgaggagttcgtagccagcccgtgactcgatgtccccatctgcagaatgggccagtgctgctccctccccgggggcgcgactcttccctgaggcccggcggcccgcagtgcatgccgggaaacgtagttccgcccgagcggacgcagcgcgttatcgccagaccacgtaatgcgcgctgagcacgccgggagttgtagtcctcttggcgccccacgccggcacctacccggtctccgccccaccccttaccattccagtttgcagcggagcctccatcggttgattccagctggacggccgatctggtagcccggagtcctgggaaatcaaggagtcgaaggaacccgtgcaagtcgtcaatctgggcccacctctcccctgcctcaagccctgcccccagctcaagccctgccctctggggtggcgggggaagcgtctccagctgccaggggcgaggctagaggggcgctgcgggactaagggatggagcaaaccgacctctcggccctggccaggagatgaggcgggtccccggcttcctgctcccttcgcctacgcgtagggcctaccagacgcccgcctgtccaaccccaccccggggccaaaggccgacctggtacccactgtcagcagcctgcaggcaggtccccacagggcacggtcctctgcacctggtgacttcctcccgggtcactgccctctgcagggttgatcaagcctgaccaccccaccccccaggccgcaccccctactccgtcgaagactgaatgccccaccccaggaaaacgggcccgcaaaccgtggggtccgggagtgggcacctagatactcggctcccgacgcaagcctgccccggggaagacccaggagctgggaggcacgggagtactgccggggcatccgcggaaggcgtctgatacccacgtttcagaagagtcctgggatgcttggggtggcgtgggcttgcaaggcgctgctggtttttgccggggatttactatcacgtagtagtgaagttatgggggctctatggcacagagcatcactgggactccgggaccgatggtggcgccattgctgggaggcgtaaccagagacgctgggattagtgggtggggatgcggggtcactggaaagttactgagattctgaggattacaatactactgctgggaaaaccaggaggtgggtgggcacattcctggggtgcttatgagagcgggcctggggagggcgtccgggctccttggaagatactgagagatgctggaatattactgggatttttctgggaagctgaggatgtttctgacatcgctagaatattaatggaaattcgggggccgggagataggaatcccggagactccgagtcgttacttggaaaattcctgggtggccggtcctcttccacctcagggcacagctggctaccggtgtggaaacacctgccgagacgtggggggtatgggaacatcagaaagtctagagttaacaggaatcggaggacagatcgtgggaaagcggaggctcgctaacgaccctcgaagggacacccctgcgaggctaacggaaacccagactcacccaggggccgcagccggggtccactccgcgccaacaccgctagcgttccgcccggctccgcaggcacggcccctttaaattattcactcctagtcgcaccgcagtccctcccgaccctcccacccctcctccccgcgccatgcttggaaggccgactgaggccgccatgctgagtgtggccgcgccttaaagggcctcacaccgcttaacgcaaggactgctcctcccgctaaaaatgaaaacgacacatttattttcccttttattcaacaccctccccacccagtctccccgcccccaagggtccgacacgaaaggtccaggccctcctcgggcgcgacagggagccgatccttaaaagcaaaccctacaaataaataagcggggtcgggggcgggggtctctgcagtccagggcctacggtccaacggcagtcaggtcgaatcaattcaccagcagcgaatgctcctccgaggggtccctggaggaaggaagcagggaagaggggcgtcagttttctctggctcgctcccctttccccattccctaacctccaatctgaatgtgccagacccgggactcgaaccttccgcagcagcagagaaggctgcaggccgagccgctcccgcggcggaacttgccggaggtggggctgtcctggcactgtgcgatgtaggcctgcagctcgctctcctctgcgcctgcgccgccgggatgctggggagagaagccgggaggctcagcctgaaagtggctcccaacctccaaggcccttgaagtccgccctcccctccagccatatctgcatcgcttcccacctccgggcctttgcacttgctgggcctgctccacccgttgttccacagtttgcttgcacagagggaccttccctgacccctgaacctggatacaagctgtgtctttgccagtctgtgtctttgccttctgctgtaggtccagcacctacagacctagagccagggctgacatgacctcgatgctcagaaaccatctattgagtgagctggatgcacgctgagcacagcagtgggagcagggcctgagactgcccacctgagtggatgcatgtgtgtgatgtctacgtgctaaggcaagacaggaagtagttccaagggcctgagtcaatgtgtctgtgggacagctgaatccatgcatggggaaaagggggtgtacccatctgccggtgacattggatgtggcagggtcccagccaaggcttccttcctctcactcggcctcatggaggggccatcttttctccaagttttttcaggctactagacctttgctttagctattccttcccctcggtgcactgcccctgggctcccatctcttcagtctagaggcgatggaagtattcaatatctatgctgtccaatatggcagccaccagccacactggcttttgagcactggatacaggatggtgcaagtcagaggctaaatttgcaattgtacttcatttgaattaaaatttttaaaaaat

SEQ ID NO: 5316 - DNA, 827 bp, Homo sapiens
cttcccagcaggcctcgcgtaggaatccggccttcctagtctcccgagatggacgacgggagccttctgaccggtcgtggcaatcccccctaggagccaggttgagcacgttttcaacctgagtttctggctctatactgggccgcggcctaatgactctaggagtcagatctttcccaactctcataattccacatccgagaagtgccacctcataacacttctctgttttaatctgaaagaaatgctgccccacccatcactaccctcccatatgataaggtggacaggggaaataaactggtagcctggctgtgcttcattttggagggtatatagagagccaggaggaaggagtgaactctggctcgttctcttgtataaaaaagcaccagtgtcctggactggacacccactgctataaaagatgcaggggggcccagggcctgatcgtcaccgactgatatcccgactggagtcccacaacttgttgggcggctcagcccgaaggcgggcgaagaaaggatgctgaagggcttcacccaaggtcagccgcttagctggttcatactctagcatgctttcaatcagatcgaagagctggtggtgttcctctgcctctgaggtcagataccgctggtggaggagggcaggaaaaaggtgaggcaggatgccttacaaaccctgccttcttcaagaccctacctttcattcttggagaaccaaggctctgcttgcaaccaatttgaaggctacctaaccacgaccacaccaggaccaacgtttctgatattatagctcaacctaccttcccactagcacaatta

SEQ ID NO: 5317 - DNA, 836 bp, Homo sapiens
tgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgt

SEQ ID NO: 5318 - DNA, 2070 bp, Homo sapiens
acaaacacacagacacacacagactcacacacacacacacacacacacacacacacacactctctttctctccagcccaggagggggacttttgttcctataagaggaggaataaatcacactacaaatgctttgggtgacgcacttggggcccgagtcctgctctggggtcagtggtgctgtttttcctgtggcctcagctctggatactgtggtggcctctccaccaaggtttctgtccttgctgtgtaaactctgccccagacaaggtgacagatgacagcagaagtcaaggagctgtgcacgcctgcccgtgagtgtgcgagtggcatggctcagctggctggtgcttccctttgggcctggcccccgcctgccgctggcacagcacagggaagacgtgtgccctcctggctgcctctccccctccacactctcctcagatctctgtgcctcgcactctggagcaggcctcggcgctgccccatctgccccaggggatttccagagtgagctcaggcatctgcaccggctgtggaagcgctggctgtcggaagcggctcccagtttcctatccagctgagccaggctgggggaggagtggcggggacgtctgcgcctgcccaagtacaggctgacctcggcggtggtggtggctaggcagggacagctctcagggcacgggcggcttcacagggaaaccaagcctgcccggaacgtcgttttgcctcccaggagacctaggatgggtgtaaggaaaaacacatcttccgggaagtacaaagcgccaccgtgtccacggcccctccttcagcaaatgtatccgggcgcccagctgggagttgtttgtggtccaaaagctactggaaggcagttccagccccagtgcccggctcctgcaggaaagtggtttcagccaagtgggcagtgcaggaggtgggccagagacactgtttggagtgtgaggggaaccttgtgaccagcagaaaaggatggaggaggattccaaacttcaggagctgggccaaggtccaggggctgctgggcacagtcgtccatgtgtgtgctcagtaggatgagttcacttaattagtctgtgcctcagtttccccagctgcacagtgggctcactaacagtaatctacctggagggttgtgtgaggtgaggactcccgtggtaaaggtgtgcagcctgcagtgcagtgcccggccatggcaggagcagtgcggggagccatcgtgataatggtgttagggtggcttcaggtaggggcgtggctgccggtccatggcacagacttgggagatggccgaggccctgcctcgtgggctgtcaaggactagatgggaacacgcatatggagcagtggcactgttgttattgttattctgtaggagtggctgtgtctggggtagggggacctcagtgccttgctggccaagggaagtgagggtgggtttccatctgggcatgaactgctgacctctgcccaggggttttcctggcctgccagtgtgtgtgtgtcactgacagtggggtggggggcagctcatggagttggtgcccctcagctgtgctttccctggcgtaggttcctggggctgggagcagggtaaagctgcctcaagtcttggttttctcctctgcctcccccgtgtggccgccaaccctgtgccagcaggtggtgcagggatggcttcctgccccggtctctggcaagaaacccttttccctctcccagtgggtctccccaggttgtcagctccatttagtcataagaagatctggggccaggcgcggtggctcacgcctgtaatcccagcactttgggaggctgaagcaggcagtcacaaggtcaggagatcgggaccatcctggctaatacggtgaaaccccgtctctactaaaaatacaaaaaaattagccaggtgtggtggcatgcacctgtagtcccagctactcaggaggctgaggcaggagaatcgcttgaacccagaaggcagagcttacagtgagccgagatcaccctactgcactccagcctgggcagcagagcgagactccgtctc

SEQ ID NO: 5319 - DNA, 697 bp, Homo sapiens
gaagactatgaaactattatacatatttgaagtatagttataggttatgttagttacttttaataaatttaatgattagtttgactgttgactaggcatatacaattaagtagaaacgacacaaaacactgagtgaataattctaaaaaggcttaggaggctcttttcactgtccatgaaatcatcttgtggcctcttgaatcagctatgcacaaggcaccaacatatctacgtcgcaccataaagattccacagtcttccattcccacaggtggcctcaaacctgggtagcagctgctggctgggatcattcctgcacagctcctccaggctcccagattttttcatctacttctatggttctctaatagcaacatttttcaactattaatttacttttattcaaaatgatccaacagacaccccccaagatttaatatttacgttcatatatatatatttggagacagagtcttgctctgtcacccaggctggaagtccagtggtataatctcggctcactgcacccttcacctcccgggttcaagcagttctctgcctcagcctcccaagtagctgggactacaggcgcacgctgccacgcccggctaattttttggttttttgtagagatggggtttcaccgtgttgcccgggttggtctcgaactcctgagctcaggcaatccacccacctt

SEQ ID NO: 5320 - DNA, 3732 bp, Homo sapiens
tacccggatggcatccccttcaggatgtggagctggcctgcactgactcctgcaaacagttcctaaagcaggtgtcagggtcgcttgccctttaagagggctcttagctgcccgagtggatgagaaacgtgcagaactatgggaggataggagtgtgatgggttttaagcatgagccaaggaaggcatgaatgagctgtacctcacccagcatccgatggcagagatcagtaaacttcaagatgtgcttcatcttcaatcctagtctaacaccagtcttcctgcagacagttccgagagcaggtctcgatgtcacttgccctttaagagggctctcagctgctcgagtggatgaggatcaatgtgttaagattgatattagactaggaaaaaaatcttagttaactttaatttccatttcttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaagtcgtttgtctcatacctagtcccagacccccacaaaacatgttttgcagaacttctgccaactttgggatagcttacccccttcctattcgggaaaggttttattgcttgtagacccctcagaaggcagggtagggtgtacgtgggctgttctccccatctcagcctgggtcatgaacaaacgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggaccacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagattagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgaggttgcgccactgcactccagcctgggtgaccgagtaagactgtctc

SEQ ID NO: 5321 - DNA, 2649 bp, Homo sapiens
cggaccctgcagtggcgcctaaagtctgagagagggaagtcgcctctgtgctcatcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaa

SEQ ID NO: 5322 - DNA, 2658 bp, Homo sapiens
tttcttttccggaccctgcagtggcgcctaaagtctgagagagggaagtcgcctctgtgctcatcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaa

SEQ ID NO: 5323 - DNA, 1321 bp, Homo sapiens
cctccttcctgctcagcccaaaggcaggagtcatggaaccccaggaaaggacggaacagaacaggacagggcccccagccccatctttatctcaccggctgctgctggctgccaagcctcccctgaatgggggagggtggtctgtgtgagtcagcggaggcacgaagtggaggaagacgggagcctctgccaggcccgttgagcgtggcctcagaaatgcgccgctgggttagggtctccccgaccgaggctcgaatccaggtcgaagggtcgccggagcgatggttggagaatgtggaaggagctggaggacacccgagtattcttaaagcaatccccatggccagatgtcatcagcagctgaacagcattccagaaaccagctgcaaagacagaagcagaacaactggtttggtggagagatctgataacaaaaagttgggaaacaggtaaaataataacttggggtagaagttatgcttgtgtttctccaggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgcttctgcagatgtggatcctaactcctgcgagaagtaactcacagtgacaaagctgcctttgcttttatcgagttgcaaatcaaagaaggggggacatgttgggaacaggccccccaagatctggccataaactggccccaaaactggctataaacaaaatctgcagcactgtgacacgttcatgatggccgtgacgcccacgctggaaggttgtgggtttaccggaatgagggcaagggacacctggcccacccagggcggaaaaccgcttaaaggcgttcttaaaccacaaacaatagcctgagtgatctgtgccttaaagacacactcctgctgcagataactaaccagacccaccactttacttcggcccatcccttcatttcccataagggatacttttagttaatctattatctatagaaacaatgctaatgactgacttactattaataaatatgtgggtaaacctctgttggggctctcagctctgaaggctgtcagacccctgatttcccacttcgcacctctgaa

SEQ ID NO: 5324 - DNA, 527 bp, Homo sapiens
gggtgagtgccgggagctctgagggttgaagtttctgcagacctaaaaagcagtttgaaaactggcagttcccagcctctaaaacccgggggtagcaggaggcagagagtaccccggggccagatcctggagcctcattgtcccttcaaatcaccttccgtttctctaagggagaaataaaccttgaaaagccatgggcttttcagatgtatctagatgtatctgatgcttttcaggtgtatctagactcccatccagcgtgctttctgcaaaacttactgaaccatagcccagaatggccatccatgatgcccacccgccttgtctcctgaagcacattgccaggtggacctgcacatggtgtggacggcagacagactggggctctcaacaactggtatttgctggatgaccatgaactaaccattcaatttctcgaaactttggtttctcgtctgtaaaatgaacatatgcaaatctatcctacaaagtgtgttttgtggattgaatgagatgatacacgccca

SEQ ID NO: 5325 - DNA, 751 bp, Homo sapiens
ggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaattgtatttatgagcttgtgttgcagttatctattgctgtgtaacaaagtacctcaaacttagtggcttaaaacaacagtcatttattttgttcatatatttgcagtttgagcaaggcttgattggtagggatgcttgtctctgttaacatacagcatgaggtggggtggctggaagggttggagtggctcagtggctgggaactgggatcctttgaaggtaggcttgctcactcacatatctggtggttaaagctggctgttggctaggacctcagcctgggctgttggcaagaacaccttcatgtgacttctccttgtggctgcttggcttcttcacagcatggtgcctgggttccgagagagagagcatcccaagagaggaaggcaaaggtgcatggcatatttgacttggttttggaagtcacatagtgttactttgctctgtcctactggttgatgtagttgtaaaggttctcccaagtttcaaggaagctgtggacatagaccccaccacttgaaaggatcaacatcatattgt

SEQ ID NO: 5326 - DNA, 898 bp, Homo sapiens
cagcctcccaagtagctgccaccatgcagtctctaatttaaattttaaacaaaccctagatgttattattatcttagagtaggctgcttctaaaatagctcccaatgatcctcttgctggtctttacatccttgtgtaatctccttgagtgtgggctggacctaatgacttacttctaactcacaggatgtggcaacagtgatgggatgtcacatctgtgattggattacgaaagactgtgccttctgttttgctattactgtctctggtgagtcctctctcttgctcttgcttgcttgcactgatgaagtaagctgccacgttgtgagatgctcaacgaagaggcccatgaggcagggcaccgagggaggcttctggccaacagctcctggggaaccaaggccttaggaagtgagtcctgccaacaataacgagagccttgaactttgaaaccacagtaccttgttccagcgtggaaagcagcgtggcacttcccggtggtgaaagcaccccagcttgaaagggtgaaaacaccttctcccagatagtctccctttgtttagccagtgcttttgccttaaggaaatcaaatgaaggtatgctccttggttggctgctgaatctgtccttccttgtcagctttgcccagagcagcaggctttgagctctgggaggatttccaggtggcagcagaacaacggtcccataggctggagcctggcacgctttcccttttaaccagtggcagaggctgcactttgctggtgtaattatgcaacctagtgtaaagtccacatgggtggggatagggggtaggcaaggcaggactgtaagctggctcagcactctgattgggttttttgactgtttttctagcttttcttacccttttctctcc

SEQ ID NO: 5327 - DNA, 777 bp, Homo sapiens
cagattcctacttaaggaagagaggggctcctcattgtcactgtacagagcaggctggtcagctttacacaggtgtcagatgaaccgtcacagccagatttgcatgttggcctcaggagggcttcaaggtccaacatctcgacattgctcttcttgaaaacagcagcctgtggttatgtcagagatgcaaacactgctgaaggctacagagagaagctggtaactggctgccgttgaggctaaacactggccctatgaactattttggactggggctggaactagccttcatccctactgccagatgggctgagcgtgaggctggaaacgtgaacagctggcacagcagaagctggagtaatactcattgccacaaagctgggcctgcaggatcaaatcacagttggccagctctggctggtcgacgcagtccctgccagggtccctgggctgggcggtgggtgctgcagaacgacaggggagagagaaggtggtgaggaagctctgtgtatgctgaaaattctcacctgccatttcatttccttcaaaggaacacagcattataactgccagattgaaaacgaagtgcacttaccctgtaaccttttaaccatacgtacaaactctatgagggatgatgatttctacctgtttcttggcctcacttcaacatgcagtggtcctcccattattatttgtggcctcagcccactgaatagctcttcctagactcccaaatatttattgactggataattaaacatctcttgaagttaa

SEQ ID NO: 5328 - DNA, 1385 bp, Homo sapiens
gcgcggcgctcctaggagcaggcgttcccgactccggcaagagggtggcgcctggactctcgccctcagagggaggcccgtcccacggtctgtggctacggatcccaggaccctcttcgcgggcgattcgcgtagcctcagaactggaaaagcccaaagatccagcaataaaggagcaaggcaaataaagctgttaccctgcaggatcagtcagcatgagccagattgtgctgcagtaacaaagatctccaacagcgcagcggctacagttggcactgcttatttcttgcttgcacctgtgggccaccgtggctggggcctgtcagacctgtgctgacgacagcctacctggacatatttctccatgctcactgaggcaggggaaaggccacagcaggccacaagtaatgtgtgtcaccccacttccatttctgtggccaaaggaagccacagagccacacctgagttccataggacggcagcagctgatcatcctatgggctggggtgctcagtatggagaagtacaagcagccacccagcgtggggctggttggtgctgctgaggatgggaggatgggaggggcctgcatccatcccagggcaacatacctgtttgtctgctggggctgcctgacaaaggaccgcaggctaggggacttaaacaacagacatttcctcatgattctggagctagaagcctgagatcaaggtgtgggcagggttggtttctcctgaggcctcgctccttggcctgcagatagccatcttcttgccgtgtccctgtctgtgtctgtgtcctaatctctcataagctcactagtctattggatcagggcccaccctcatgacctcatttaaccctgaattacctctttaaagaccctgtcttcaaatgtaagtactaggggttaggacttgaacataaaaatattgaagggacatagttctgcccacagcggtgcccgcgataggcttctctggttttgtctttgctgttcctggcagcgctatattgggcaggcttctgtggtctccacatgcctgtgtgcagagtcccccaggccctgggttctggggcccatactgaggagtggggatggccaagccttggctgttgagtaggcagtgcccagttgtgctgtatgggatgctgtttctcacttaagaaatctttccctacctggggggtacaaaggcattatcctgtattcccaggttgtaactttctgcctttgacattcaaccttgagtccacctgtaagtgtaactgcggcagaagggaggggtctgctgtcatccttgatagcctgtgatgagcagagcccctctgccgaccgcgatgcacatgtaatatgagcaagaaataaatttttgatgtgcgaa

SEQ ID NO: 5329 - DNA, 2077 bp, Homo sapiens
gaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaa

SEQ ID NO: 5330 - DNA, 11763 bp, Homo sapiens
agaaccgccttcacctagccctagagcatcaggtactaagttagtgtgaggacattttaaagcgggagggaaactcaagggacttagcccatactcccaaattcagaaatttgtcacgtcacttgagatcagaatgaaatttaagtttcagtccctttgagatctctgagcgcacaaagtcaggctgctatcactcggctggggagtccgaacccggctggataaaaactacttggtgcggaactcgcatcttttccgcccaccgtgggggggccgcaccggtcgggtccggccaggaacccgggcgcgagtttgggggcgcagcgggggcggcgagcgcgcgtccccccgcccgctcaggcagcgtagaggtgcgagcagctcagccagccttgcagagggagctctcggcagctctggggtccctctgctcgcagccgctgcagcgccgcctgcgccactcggcggagacggagaccagcggcggcgacgcgcggactgggagcgaccgccgagcagccaagcagctgggaaggcacgcaggccggcaggcttggaatacatgaggaagaagagtgggagacaggaggaaaggtaaggttgggagagggcaagaggaaaggaggagagtagagggaacactccatcgattgccagcacaataaactgtatcatggactacttcagcctggcccctgctttgcagtgtgcgtggagcagtttcctctgggcagagtctcagagatgatggccaaggcgactgtggcctcaatggacttaactgatagggcacttctcagtgtgtcacaggccttggaggcccacttccatctgtcccctcagaggctgggcagacgctttccctgccctgatacctttgactcatgatggtatcgtcaactgcccatcacctgaggcaaggggctcccaactgtcctcagtcccaaacagcaggaacacctgcctccctgacccacatgacagcagggtagggggtgggagaatgctatgggcaggtttgccctgtgggaggcccctgtgaggcagagggggtcaggagagatacagaggtgggaggacaagggttctctctgcccctccaccatctcaggaacctgggcatgggcctgggtgtaggaggccatccagcctgccttcaagccactgatggagagaggctgactggctgtcctggggttgattcatgctgctctgagccagataggcatcatgtgcttcacctggctgtgctcacagtgccctcattccagctcctgtccccttccgatcctcacacccacccctggctagagctgaatactaggctctggcctcaggactctgcagagcacagagtctagggtctgtcccttcccagcattggagagcagggattcttagtgacaacgccagtggaccccttggctgggatgatgacatttttccatcctccatttcttgcccaagccctgctctctcctgtgtactgagctgtgagctcatgcaggctcagtcacccccatctgcactttcccaggacctggtcaaccagtgttcacttcctcttcccccaccatgacaggctatgcttttgatgcaggtggatagccctgctctaccaatgggcctcttgtgggggcctcaggactgagggctgctaggggcggttctgggattgccggcctcctccagggacccctggggcaggccccagctgtggccagccttgggtgctggcctggtctccatcatttgtttgcctcctctgccccatgctgctccagctcaccaccccaaatactgagctgcaccatcccgtgccacccttcgttacccagagagcaaagagccgcgccagtgtgcagagggctgcctgcctgcccctgcccaccctcgccccagcgtctggaatgagccacttgcatccacacaggtgcttcctgtgcttcttcctgttgccgttttttctgctcagcttggcttccccagcaggtggttaaagccccagccaaacctcttcatacctagctctaaaacactggggggcagggctccctggggatctgggtcaccctccagaggactgttggcacttcactggctcttcctgagggcaggctccccaacgtgacacgtcctgcacaggccaagctgctgccacaggtactgggacatcagagtggcctcaatgagtcagggaagtgctgcgtatgcaccacctccttgcccctggatactggaagtgctgagggagaggggaagggtggagagcctgtttctctagccacgggtgtgggcctccctcagcccctccttagaacaggcctgccatcctgaagtcccaccccacactccagttcctcacgcaggactcagccttctggggttaacacattcactggccaggcagctctggggcaaggcgaggcggggcaaaggcaagccctctcctgggatctctgcttcctgaagcagcacaggttggccggctgttggggatcacagagttcaggcacgtttgttattatagagggggagacagctggagagggaagggacttgctgtcttgggtcacaggttagccatccaggtctcctgcctcccaggtcccagctcttcccctccgcaaggagctcctctcccctgccatccagcttcaaggagctccttcagccccctctgcagaaagctgcccaggctgcagaagacccaaacctggcatctgctgacgcggatctgctgccccctggtgggcagaagctccagccaccccgtgcctcctttcccttcctgtttttcctttcccttcccctttgctcccaggccacagcctgggattggcaccctttggtgttttctgggccaactccagtttagctccaccttgggccgtagttcccaggcccagggtaggccccacctgcaggctgaaccacccttttcccctgctctcttctccaagcccagttccagcctctgggctttcttccacctgaatttccagggcaagtgcacatggcactgtcacagctgcagtgtgaacacaccagtgtcaggcagggccacagccagagggtgttggagcagagggtcaggagtgtaccaggccatgtaggaaagacattttgcttttttattttctgtaaaactctgtaaataaaatacaaaaccaagggatgtggctgggcagcggcagggtggccaagccccagacactgatttgtggcaagggatgtgctgagccgaggctgggaggcacttgactgcaggcactgactctccaaccccaggggcaacagaagaatatattagattttcattgctaggaatctgtgggggaggggtatctggagccagcccttaccctccctgccagtgcctggtgagccctgaaagtggggggaaaggggcaccaggaacccatgggtgaatagtttagaatgctgtgctggccatgctgccaggcccaaagatgcggggcagggcgtccagggactcctccagccgtcgatgggcagactgtccctcttctcctgtaatgagtgaggatgaggtcaagggtggccctagccccatcccactctcccacccctggcgccatctctcctactcccatcagccaagatgtcccagaactccacccatctcttccatcccccagcctcaccacactgctgtaggctttgccgggcagcttccctcacagcttctgtgtcagtttggcagaggtacaccaggggctcaatgccctcgggagcctgtcaggggagggagcattgaggtgggctcaggggagcagatgggagggtttcaggggtgggggtgccggaagcggacagaggggtgggagggttggcaggggtcaccttgatgcagcctagggccaggcagccagccactcgagtctgcacgtcctcatcctccagctggtccaggaagcacaggagggcctgtggaagggtgggaggacagacttagccagacagtgggagtccaggaccccagccctcgccctcaagggagccctgtccaactcaccctctcccggaaggtagggcccagtgacaggctccggagctgggtgctgacagcagccatgaccttgttgttgccatggacgagcagggagctgagggcccgcagcccgtcccttcgcagacgcccctcgggcgccaatctcagggccttcagcacaacagcctgatcatccgagttcagattccgcaccagtagcactgaaaaaaggggatatggtgggtgggtgggcaaggtggcagggtgaggagcccccgaggttggggagggcttgtcctcatgtcctcagaccccaagaggccactatgtgatcagggccaccgcctcaccctcctcagcggtctcagtcacgtaggcctccatggtggggctgtccaaggtttccacaaaactccagaactggaagactgtgagctgctctccaggccctggctggggccttctgggcagcttctgccccagggcatcctccaggaacttcacacacactgcaggaggcagtagcatgggcctcagagtttgggtgaacacagcttttagaggggagagatgctcctatcccaggctcaggtccaggggccccctgttcaaaccccacccatctgggtccttctgctctaaggcccaagtctttgctggtctcctcggtgcccagttcgtttatctgtgtgggctgacctggcttccccgagcttcctgtcactgggaatctgagcaagggtggaaggaggaagcagcccactcaccagcctcagccaagcctggctggcgcagggagaggcgggcaccatactggttgcagaaggtgagaagcacccgctccaccgggcagaggaagcagctgagtctctctgtgcactggtcccagaaggtcaggaagccaggccgagaggccgagaactgcaccactgtgagggggtgagggaaaccgtcagcaacaggcaggcaggtgagtagagagcatgcagatggcagtaggctgaggtaggagcttcaaggcagatggcagagcccgaacccccagggcctttaccttcctgggcagagctggccgggatctcccaccgcctgctgaactcgcatactgcctccagtactcgggcttcccgcagcagccgctccagggcccatgcctcctggcagcgcaggggcccaaatgtgcccagtttctggagaacatgggtggccaagtagctcaggcctcagggtagggctcgggaggatcgtgctcagggacaagtcccagcatgcactgggggaggttggggttgcagagttgggagatactccattcagcaagggccagatgccaagggccctggggcactggggtgtggcactcagaggaggtatagaggaccaggatggaagggcaggactccctggggttaggggttacaaaggaagggtgggggaacaccatcagcctcaccagcaggaggcgactgcagtggtacaggtgccggaccaaggcagcatccagagctggacaccccgtgctgagggggcgggcactgggtgagtctatgctgtcctcagccccagcctccgggctgcttggaggcctgagggaaaaatggggtccaccaccccacaggcacacatcaccacctggtcaccagcgtttatttttattaagcttcccccatgccagaaaggaagaagatgatgcaccgacagcagacagtggggtaagttcatggaggatttccagaaggaggaaggggctgggaccagcaggtggtagtagggatctctggagtcagtctgcgccatgctacctccagctgggaccactggggatggcatgggtaggagtaggctgcaggcgggatggtttatgacaagtggactgcaaagggtgcagggcatggggctgtagcctgggcagcagcagaggaaggagggacctggcacaactctcaactgggaaccagcaaaggccactccaggactgacagttgaggggccagggcctctgggagagtcggggttgagaaggagtggggcagtgctggggtcccagggtgcacggcgagacactgagagagctccttaaagggcaggtccaaggtgaggccaaggggaagaggaggggctggaggcacccaagctgatggggaccggcaggggaggcagacattgcagagatgaagagggcggtcagaagcactggggacacacgtagggttggagacatgggcatgaaggacatgggaggggtggacacaggtgcacctgccagcaactcagtcctcacatgctccacctggccctgcctcacctgtcctgtcctttgactttctcccaattcacctgttccaccttcccctggtcctgcctcaccttttccctctcacctagcctcacacccatcttgcctagccccctcacctgtccccaggaacatcattgtcttcatcttcgtcttcattgaggaagctgaagctctccaaggcatgctccacagtgatgctgagactggaggcccggctgcgagtcagaccttgtctctgctgaggttgtgaagggcatcagagcggctgccgccccctggctgccctccctggttgccctagcccagcccagccctcctcaccatgagcagactttctaggcgggtcacctcctgctccaggccctgcagctcaggaaactggccacggtagtcatccagggcagccattagggcccccagtgcctcctccaggctcctgtccccagaccctccggctgccgttgggactggggtctggacagccatggccaggcaaaggtctgaatgctggggtgcaggggttgggggtgagggagtggggcttagactctgaaccgtagactctgagggatctggggcagggcttgtgaggggtttcctactggaatgggcaggacttgggtggggagttctgggggccatagggtctgcctgagtgtaggaattggagactgggggactacagggaagggagtcagtgcctgggagggtggggtctgagtgtttggaggggctggagagggtagcaagttctagagaagtggaagggcttacatttataaggatggggcttgtggtgggatgggtggggcttgtggtaggatgggtgggacttgtggcagtctggactaggcccataccactgggggtaggacttgtagtggtgggaggtgacatactggttttgtgggtgggacttgtgggggtatgggtggggcttgtggaagtatgagtggggcttgctgtggtatgggtagggcttggcatagtgtgggtggggcttgtggtagtctggactgggcctatgatattgagggtagggcctgtagtagtaagggtagagattatgggcttgtgggtggagcctgtagtagtgtgagtgagggggcttggagcactgtgggtagtggtaatggcactataggtagagcctgtagtggtgtgagtggggcctggcagttctgaagggccagagtctgtggacttatgaactgagtctaggtgtgcagatggggcagggtctgtagatgtggggacagagcctgttgtaccgagggtagagcttgtggcagagtggccagggtccagggcaggaggaacaggactggggtgctctccatgggtgggagctgggtgtgtaggtgggctaggtccccaggctaggctttctgggccaacggcctccactgaagcctcagccaaggcagcatctacactagcctcactgatgtggctcagagtccgactgtagggtgcatgcccatttgccaggactggggccacggccccctcctcatccaagggcccagagctgggggtctcaggcctgcggaaggcaacttggatgggaaggggctcgggctgctgcaccaggggcctaggggctggtgagtggcgggcagtgcctgagagctgtgggctggatgagtcgtctgaagattcagatgacagggaccatgctgtcccattctccagctcctcctgccgtcgcagcatgttctgagaaagaggagagggcatttcagaaccacccccagggagcctctgggggatggtgaggcctggacctgggctatgactcacatagaaagcctgttcccgaagtgagggtgtgtccggtgggctctggctataggtggagaagcgcttggtgactgtggaggccttgttgacagaagaagcagctgagggctggtcatccttgtcgaaggggctgggaagggaagaggctgttggcaggtgccacagccctcctggccctcctccaagcctctcagccccaccaacctccatgtgacttccaggctgagcttgatggtaccaaggtcattgatatccacagccacaacctggggcagggcggcaaacaggtccttggtctcacaggagacactgcccacaaccacatggttggccaggcccttcagttctgtcacctgtagccaagagtgcatggtagggtcacaagggtgcaggggctatgagatcatgggaaatctgaggtctgaatttgcatagaacttataaaatggtcatgggaggctgaggcaggaggatcacttaaggccaggagttcaagaccagcttgggcaacatggcaagactctgtctcaaaaaaaaaaaaaaaaaaaatttttagccaggcatggtggtgcacctgtagtcccagctacttgggaggctgaagtgggaggatgggttgagcccaggagtttgagactgcagtgaggtatgattgcactgctgcactccaacctgggtgacagagtgagacccgccaactcctagatagatagacagacacatgcatgctcatggagccatggatgcttgaagcagcctgggagcatgggaatcacagaggtctgcatggtagggtcactgaggtcatagaggtcacagcctcatgggagcttaggaggtcaaatattcacagggtcagaagatcatgaggaggtcacagggtcaggaagccatgatgtcctaagagtcacaaagattgttcctctcagggccacagagatcatgaaggtcatggaatcatatcttcacagggctatggagctatgaggggatcacaggagtaagggactcagggtaatgggggtcacaaggggttcacagggccatggtggcctgccgtcctgggcagagacatcaccttaatagacagaaattccgtgagtagagggagaaagatggtttcttcactgtcccacacctgctttccactaccctcaattcggccccgtagtttccagcgctgacgcccatatttcatgcagatctgggggaacaggtaggatgaggcagcctaggtgttgggaccctaccgacccagcccttccctgcacattctcatacctcatactgatcgcctacacacagcctggcgaagccagccagccctgagttggaggagaaggggagaagtcggtgagccatattggggttcttcagcatactccctccagccccccacctgcccccacaactcagtacctttcattcggagatgaaactcgcccagctgtgcctccagctcgctctccagcagacacatgctctgggagggaggggcagggacaggagggggtcaagggccagccactagccctgccacaccctgtgcctctgcctcatgggcccccatccctcacctccgtgtactcgcgatgcccccgagtggcctctgccaggctgtcccgggcctctcggcttcccggggacccagtggtgtaggcacggaccatgttgtaggcaccatcccggagacgccgctggacacagtatgcctcatacagctcatcgatctgggaaggtgagtggggtgacagtagggggactgagactcacctctggggttactcacctctaaggttgctcacccagggcctggcaccacccctcttctccctatgatatccaaccccccaccccactctgcacacatgctgcactcgtaccttgctggcatggaactccagtcgtcgcaggaagcgttcaatggacttgacttgctgggggagaggtgggtcaggaggggcctgaggcccagggtccttaccctccctgtgagccaaccccttccagtaccattccatgcatactcaccttgtccagatcatacaggaagccctgcaggggtggggagaaggggcaaatatttaggagggatgaggaggactccagcagaggcactcagactcgtcacagctcccctttctcacaccacagtccacaagcactcctgtcacagtagcaactgacgccccttcctgctggtctagcccttggtggatgctggtagcacagatctggtcccttcagccccctccaggacccctccttccacctcttccctgggattccttttcctgcagccgcctggggagagctctctgcttccttgtgcaaggttccctctgcaggggaactcccatcaagccccggcagaagtgttccctcctccaggaagccctaacctcttcccaagaagcaccatgcagcagtaccactgctcagtaccactgcagcagaatctcctgctgtccatgtctgtaggggtcccacctaccccactggaagctcctggagcaggtactgagtcccaagcagaaagtatgcacagcaaagtttggggatagaaaagcccctcagcctttcctgatatccccttttctactcacacctgaaccagatcacttcagaaaatagcccagatatcacccagggctgcccttgcccagccctccacaccaaagaggcaaagggcatccgtacctcccgccactcaccaagcgggaattcctcttggactcccttatctgcccctggagtttctcttgctcctgctggtgcacttccaagtaggccctgaggaaaggggcgaccacaagaatgaactcggctctccagcctcatgctgcccagggtgcagacagcagggagagggcatggggctggagaaggttcctgctagcaggatgcgggcttggggagggatcccgggacagggctgggaacagaggagctgctcacgtcaggccccgcttcagcgccgtgtacaccaggtccagccgctcgggctgcggcaccttggcggctgggtgagccacggaaaacatcctggacactcgggagagcgcggggggcttccgtgggggccccggcgggctgaagaccgggaaactcctgaaggagaggctgtcctcagaaagaggagagcaggagtcccccagactctcactacgcacccccagacccagccccatctgacgccctttgaccccaccaaccctgcgcggccgcgtacctgggcccccgctcgtggctgccgaggacgcctgcgaaggactggctcctattgacccgggcgctgagcagacggcgctgcggccgcaccgacagggacatcatagagtgagtccgcgcggggctccctgcgggtgatcgggggggtgtccagtaccagtcggatccccgaagccctctcccacgcagcgggatccagggctggcgcaggtctttcctgtcgctaggcacagctgccccagcgggctccggccgggtccgcctagtcccgccgacccgggcactaatgacaggacagccgcaggcgactcggcctcggactcagcgtggcctcggctcggcccccacttcctgccgaggtgcgggctccgcctgccgcggggcaggaaggggggtcgcgcggggaccctcctcc

SEQ ID NO: 5331 - DNA, 2795 bp, Homo sapiens
agattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagccaagacaaaactccaattcagctacttacctagtaatgagtctcaggctgaagtctgctctctcccatcctagaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaacaaatttggggagatcagggattctctgggggtggggtggctcccaggcctcagccaattgtcctattggtttcagccataaagacagctcaggctgctaccacgcactgataggagatttgtcaaagatcgaggcatcttcactcagaatccctctgtgattaccaattgtgaacacaaaatatctgatatgggtctcagtcaatttagaaagtttattttgccaaggttaaggacacatccatgacatagcctcaggaggttctgttgacgtgtgcaaggtggttggggcacagcttggttttacacattttagggagacatgagatatcaatcaatatatgttaagacatatatcaggtggtccaaaaaggtgggatgactggaaacagggagggggcttccaggtgataggtagataagagaaaaacagttgcattcttttgagtttctaataagcctttcactgaatacacaatttacaggactaatcacttaagccttagcctggctcagtgaaacaacagggcaaaggaagcaatcagctatgcatttgtctcacgtgagcagagggatgactttgagttctgtctagctatcttgtttaggaatataatgagaggcaggtttgcgtgcagtttccagattgacttttccctttggcttagtgactttgaggtcccaagatttattttcctttaacatttacaaggagaagtgaagaaataagtaaattagagagctagaaggatggaagtttacagttagagagagtgggatgttgaaggtaatactggttgcatatttcttatccaaaatgcttgggaccagaagtgtttcagatttcagatgttttcagattttggaatatttgcattatacaggttcagcacccctaatctgaaaacgtgaaatccaaaattctccaatgattgtttcctttgagcatcacaatggtgctcaaaaggttttggattttagagcatttcaaatttcagattttcagattagggataataaacctatatctcagaaacggtacatttctgaataatgacaaattgtcattatttgccatgagaattgtcattaatgtgggtggagatggggatgattgtaggtcaagagactgaagcaatagggtaggcttgggtgttagtacggcccttcatgggaatgtgttgatgtcatccagggtcacgggaggcttctgagtgggaaggaagctgagagcctatgattacggtcttcactgatgaaggcagacagtaggaggttggcagatggtgggcactgactagactggaagtgccaagaacttcagtggagcaaggttttacccaagacacagaggttgtggtctagagcagcccagggatgaaggatcacccattggagaggactgtggggaaagcagagtcctgggagatgaaccaagcatcagttgaggctggaacagttaaaatgtatacatcaaattctctccaaggacactgtacccttggctgaaaattccctccttagtctacttcccatcccaaattctacccatccacactgtggcatcctaggtctctctagcagctgaacaggcaggcctctgtaacaactgtttcagcgctgactgagtggttaagttaaatattaaaagttgaaagagccagtaaccttatacaaaggctggaatagaacaaaagcccaccacaagtttttgcctaagtctttcctgtgccttgaaccatgacaagaggaggaaggaattcttaaccagacccatttaggattaagtaagtttttattggctgggtacggtggctcacacctataatctcagcactttgggaggctgaggcaggcagatcacctgaggtcaggagtttgagaccagcctcctggccaacatggtgaaactctgtctctactaaaagtaccaaaatgagccaagcatggtggcgggagcctgtagtcccaactactcaggaggctggggcaggagaatcgcttgaacccagaaagcggaggttgcagtgacctgggatcacaccactgcacttcagcctgggcaacagagtgagactccatctc

SEQ ID NO: 5332 - DNA, 502 bp, Homo sapiens
gaggacagctcagggaagcttcttgggaaatgaattctgggagttccctctgccaaggacccactgtgttaagagctttaaggtgaatgtccacttcgaggccggctcaaccaccgtcttcagagaactctcccacactggccacagcctatctgccagcgtcacccactgtctaggtctttgcccataatgtgtcaagggcaaaacagaggggtggatatgatgcacgtgcctcagcccggggcccgtacatggctggcgtccaggtaacgcaggcctggggcagacattccttacacagctcccaccctactcttacgtccacatttaggcagccaggccaccttagccttggaggggaggacaccaacggggcccgccttaccagcagtcagaaacagacccacatcccagtgggtacccaaggcttctttccttaggccccatcccatttaggaagttgggaaacccactgggtgagcccaaaggctaccaaagcctg

SEQ ID NO: 5333 - DNA, 2051 bp, Homo sapiens
agctcttgcctgggccctgtctgtgggaagcaccttgtgacatatctgtgcatccattactttggaggtgtgactctcctcttccatctgcaccatgcccagagaaagattgtgttgcatctctgggttcagcaaccaggtgctgtgtttcttgtgcccaggccttgcctgcagagagaattgtgacatagctgggtccagtaccaagtaacgtgactttgttgtctgtgccttgctttcgagaaggaattgtaacataaccctggacaggcaaccaggtaatatgactctcctgcctggtccttgtcctgaaaaattgtgacatatttccgactcagcatgcaggtgatgttactctcccatttactttctactcacaggttagattgtgacatacactttagcccagttcacagttgcgatgatgatactcataccacaaaccagtccatagcagagatactggtgctggtagctagacttagagaaacaggtaaagtcctggattaccattctttcacattttgtataaagtctttggacggtacagagagtgttatcatagggccaagcacacaggtgagactgtttctcaaatgcacaacctaccaaatgttagcattgtcaccctcacacgaatttcacacgtgaatggagtccacagtaaaaattgtgactgtcatatgtaatcatgtgacaacagttaagatggtgactcatttctaaacctagctcataggcaggtgagaactcttttctctagacccagccaattggagagatgttgactctaatgcatgagcctaggtccacaggtatgattatgagtttgtattagaaaaaaaagtctcagagcaaattgtgaccatcatggatattgtataaagccctcaggtagtatagagagttctataacagggcctagcacccaggtgacattgtgacactcgtatgcaaacccagccaacagtgaaaattgacaactttccacatgaacacagctcactgttgaagttctgaatctcacacctggaggtggttggaaaattgactctcaaacgtggattcggttcacacgtgggctggtgactctcaaaccaagattcagcatacctgtgaggctgtgactccactaaggggacacagtccacggcaaagattgaggctctcatggatgtatccagtccaccgttgagattgtgacttgtgtacttggactcaacatacaacatgtgttgactctaatactaagaaatgggatgtgtgggattgttcattcctacatttttttgtgactgtgattgtaacatacacctttgcccagcacctgagtgatttgactctcctgcctggtgcctagtgcacagatcggattgtgacacattgctgaatccaacatctaggtggtgtgactctgtacttttgcctcagcactgcccacaggggggcattgtgacatatcactggaccccacaccctggttatgtgactcttctgcctgtgccctatcttcatgggccattgtgacattgctatgtgcaacatccaggtgatgtaactttccttgctggatcctgcttgcaggaagcattataatctatctgcatccatcacccaagtaatgtgactctctttctaccaggttgctgcttacagaaagaattgttacctatcactgggccagcacctagctgttgtgatgcttctttttctacctacattcagctcacaatgtagattttgacatactgctgggctaaacaccaaaaatgaagttacgtttttcctcagcactttcctcatcaggcattgtgacatattgtttggcccagaactaaggtaatgtgagcctcctgcctgaaccctgcccatagtgggcatagtgacatatttgtgaacccatcatccatataatgtgactttcttacttggcttttccctataggagagattgtgacatatatttgagcccagaaaccaaataatttgacccttctttcctgctatggccatgctcccataaaagagagtgacttattgctgcgattagc

SEQ ID NO: 5334 - DNA, 731 bp, Homo sapiens
aagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagattgagtctcgctctgttgcccaggctggagtgcagtggtgcaatctctgctcactgcaacctccgtctcccgagttcaagcagttctcctgcctcagcctcctgagtagctgggattacaggtgcatgccatcatgcctagctaatttttgtattgttagtagagatggggtttcacgtgttagccaggatggtctggatctcctgacctcgtgatctgcctgcctcggcctcccaaagtgctgggattacaggtgtgagccactgcgcccagcctaatttttgtatttttagtagagatgggattttgccatgttggctaggctggcctcaatctcctggcctcaggtgatctggccaccttggtctcccaaagtgccgggattttttttctttttttctttttttttttttgagacggagtctcgctctgtcgcccagcctggagtgcagtggcgcgatctcggctcactgcaagctccgcctcccgggttcacacc

SEQ ID NO: 5335 - DNA, 246 bp, Homo sapiens
cgcttgggtgctccacttggcaggtgtaaacctctccactccgaggaactgtttccagcatcaccagggtctggaaggtccagtctccattctggatcaggcctgtggacaccatcccagccttctcttcctggccgttcaggaaccacctgacttcaatgctgcctggatagaaaccactcacagagcagaccaggaggttgtggtgctgcaggggctgggtctttgaaggatatacagtcacct

SEQ ID NO: 5336 - DNA, 642 bp, Homo sapiens
agcgggcggccgccaccgagcgtgctgagcaaccgcagcctccgcggccgagagtgcagcgagcaaggggagagccagttgcgcagagccctgcaaccagcagtccagggagaagtggtgaatgtcatggagcccagctgaaatggactggcccccttgagcctgtcccaagccctggtgccaggtgtccatccccgtgctgaggtaagaccccctgaagcccagcctgaggaagagaggacacaatgccttttttgcaggggcaggaggcagagggccttctcaggaaagaaggagcagttagttgtttctggttcagtcaaaccatctgcttcagcctcagcccgttgggaggcaaggtcaattggtggccaaagaggcttctgctttgtcagagcaggtctttggaatcttgatgggagttgtattttctcagttgctggtgaaatttgaattcccaagggaatacatttatcctccaggtaagactgcaccggattcaggtgaatgcttaagtatacctcctctgctctgcaagggagctcttgggaaacacacacacacgcacacacacacgcgcgtgccacgctctctctctttcaacccaagggtgacagagtgaaacattatgcagagaggtta

SEQ ID NO: 5337 - DNA, 501 bp, Homo sapiens
tttgcagagtgtagcaggttccttggactgaggttgcagggagaaggaactgagccagagagaacaagtgcttttccaattaaagtatattcatgatggcattgtacaactgagtgagcaccacaaagtggacgggaaggcaggaagtacggtcctgggtggccggattgcacgtgagccaggacagagcgttgtactgctccaaaacaaacctgccaaagagaacacacagagcaggggcgtgagcctcaagagggaaggctggttctcagattctaatacattccagatcttagcaggaaggaggtctcaaaggcattccttaacttgccccaggctctttccctcatcctttgtctcatgttcctccttccttctagatatggactatccagtacagcctgtatattttctcaaggtagatgaagaatgcctgtggcttgattaatacacacttctggaatgcacttctcaactatgtcatttatgttctagtccatt

SEQ ID NO: 5338 - DNA, 318 bp, Homo sapiens
aggttccaaacaggcatgcgaggtgcctttgggaagccccagggcactgtggccagggttcacactggccaagttatcatctccattcacaccaagctgcagaacaaggagcatgtgattgaggccctgcgcagggccaagttcaagttttctggccgccagaagatccacatctcaaagaagtggggcttcaccaagttcaatgccaatgagtttgaagacatggtgactgagaagcggctcatcccagatggctgtcgggtcaagtacatttccaatcgtggccctgtggacaagtggcgggccctgcactcatga

SEQ ID NO: 5339 - DNA, 949 bp, Homo sapiens
cagaggtctcagttaggagaaccctaactgggtgggacctcaaaaactccatgcctgggagaattgaaatctctgtcagccccagaacaccagcgagggtggctgcaggccccggttgggggggttcctcactgggcaagaccccgagacctccgtgccagggagaattcagatctctgtcagccccagaacaccagtggggttggctggagaccccagctaaaaggaccctcattgggtaggacctcaagaactaagtgccagggagaattcgaatctctgtcagcctgagaacaccaggggtgggtggctggaggcctgaattgaaaagacccacagcggacaggaagtggagacctccatgtcaggaagagttcaaatctctgtcagcatgagaacacaggtgagggtggccggaggccccagttaggagaacccttactgggcgggacttcaagaaccaagaactgcatacctgggagaattcaaatctctgtcagccccagaacactggcgggggtggctggaggccccagttgggagatccctcactgggcaggacctaaagacctccgtgccagggagaattcagatctctgtcagccctggaacaccagcgaggtgctctaccaaaatgtggccatactgggtctttaagaaggtctgtgatccattcctcctcactgggcgggacctcccaaccagggcctccagccacccccaccagtgttctcgggctggcagagatttgaattctccctggcatggaggtctggaggtcctgcccagtgaggcacctcccaaccggggcctccagccacccccaccagtgttctggggctgacagagatttgaattctccctggcatggagttctggaggtcctgcccagtgaggcacctcccaaccggggcctccagccacccccgccagcgttctggggctgaca

SEQ ID NO: 5340 - DNA, 592 bp, Homo sapiens
caaagaaaagtcaacaaaggctctaacatcaacatgaccttggataaggtgtacatttcatcaggacagatgactcgaatggccaccaccaccgaggccttgcacacacctttgcagtgaacggcgatggccccttcggtgttctcacagatgttcaggaaccttcgcacgatgttgtcactgggtgtgctgccatctatgaagaagaggtcatagtgctcgaagccagcgtctgtgaagcgctttgcctcataaatctttttgtttagcctcacaactgcagtcacattatgctttttgaaataaggaaagtaggcttcaggggcgtgaagaggataacctaaaggaacaaaggagcagtaagcaaaaggcatgcatttcatcttccacaacccagaaatacaaaactctcaacaatgaagtgtataaatctcaacaaagcttgggaggaaagtgtgttgtgtgagagaagaggtcacagcaagctcctacaagcatcaatctgcataactgtaagcaccacaggaggttaaaaagaaaacttctgtaagtactgaaaatacatcattaaagttcaaaatctcaacctcta

SEQ ID NO: 5341 - DNA, 1897 bp, Homo sapiens
gtcgaagctctttttccaaagctctgtctcccccacctcctccagcttccctctaagagttcctgttggtgtccgcccccagtccacagtccaggagccaagaattcgtggcagaccccgagccacagctcgccaaatcattcactcattgttagacatctggggttttcaactttctgttttcatgaaggacacgataagtgcccctgggcagcggctcctctggagctccagtccgagaacctcgggggtgaaattctgttctcagctccgcccctgcccaggccgctctaccatcccatgagaggctggagttggaagccccttgacgtcccggcctccatgggcatgagcatcccgagcacccagacctcggcttctcagtaccgtgttccattcaaagtggccaggactcctgggagaattggccagctccagcctgggcacggaaaacaccagaggcttgtaggagatcacgaccctccagggctacgaggccatgtctgagcactcaggagcctgcttgatgtggagggtggggggggggggggtggtgggagctgacagtgccaggagatggcctggggcacaagcggccccacagctcaggctcagacaagcagctggaagcctggtgcgcgtggatgtccccatggctttaaaggacgccccacagaacacggattaatcataatagagagaaaggacagcgttgcaggggaggctgcagacacggcatcaattaaaccgtcagcgttcacgtcaccagagaccgcccagggtgagattttacacctgccgccaggacacctgcagaagcgcagcctcaccccctgctgtccccgcccacccaggatctcatcaccaggaatccaaaggcaaagcagtccgagtgcccacagcacggaggggccaggagcctgcacaggctgacagagatggaggagagacggcggcttggggaagggcgtgacaccatcagactctgctctcagaaactcgtggggacagtggtcaggctgcagtggggccttgcagggacctgtccattccctgattctgacgatgctgagggcttgtgaatgtccttgtgtgcaggaaacacaccaaagagcctggctgtgtggaccacggtgcagcccagctgcgcacactgcgtttcctgtaccatactcggcactccggccttgcctgcgcactgcctgagtctgcattatctctgtgtgtaacttggccccaccccgggatccggggaggctgatcccccacgggcctctcccaacctgagcagcgccctcctggccactgtccactgctgcctgaggccctgccccagcagaaggcacaggctgggacaggcctgcaagaatggccaggaggggcctcccagggtcgaggcatctgagcagcaccctgcaggacgggcaggcccctcatgccccgggcacctgcacagggcctgcgatctcatgcattcgaatggtgccgaatgggccagggtgtcctgggggatcctgtcgggcgccctcctcagctcttccactttccacatgaggacttggtgcccagcaccttcctgtgcaagaagtcagggagttcaagacgagatcaaggctgatccaggccttgcgcggctcctgctcacaggatcctggggaccgtttcaagaagagcctcaggacacggagaatgctcagtctcctggctctccccgccaggcaagagggcccgggggtggagggaatccaggggacacagtcctcaccccactgtcagcgccagcagaccccaacactcatcccccagccccaggcacacaacccgccctgccgcccctcgccaggccctgccgggtgtccaccctctgcggcagcaggttggggaggagacgtgctgg

SEQ ID NO: 5342 - DNA, 4860 bp, Homo sapiens
cagctccatcgttacaatggcctctttagacccagctcctgcctcccagccttctctccaggccctgaacattctcagtaagttcaggtagctgggactgtaggtatacatgacgatacttggctaatttttaaattgttttgtagacacggggtctcactttgttggccaggctggtgtcaaactaatggcctcaagtgacccttccacccctgcctcccatcctcgaggcatgtgccaccacaaggagcacttgttcaattttctaaaaaaaaaatttctaaagtaaggctgtgggatgatggcaggaagataaaagaaaaacagaagaataagttaaaatgacttattcacgcatattcttttgacagcaagaagaacttttagtatatacattccttacaaacaaacaaaaggcagataaacaatgttgtataggaacttcaacacacactgtacaatattcccactttgctgacataagttatggaaatttcatggtttacttgagtgtcgctaccagtattttgcttctctgatgatttttatcaacttcctcatctgttaacttctctccaaggtatgtcatgtcacgacatactgccgctgcacgaacatggccagtgtcttcctattcaacatgtagaatgctttcctaatttctctttttactctctgtctttgtgttctgcattttccttacttttattgtcagaaactccagaaagccaatcgtactaatttatcacgatttgctttattaatttatactttgcttatatggaattttgcccagcagacctcatcacagtttctaacctgttttatttatttatttttttttttctgagacagggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaatatttggaattttcgtatacgtggattccagaggggtgacagcaaaacgtgagtaagcatggattttggtatatgcagagatggggggctggaactaattctgtatactgagggacgacgactgtatatgtttttacaattacgctgtaggatacatactgttgcatagccttgaaaataataatttttaattgagtggaataagaataatattgataaaagtagcagctggccaggtgtggtggctcacactggtaatcacaacactttgggaggctgaggcaggaggatggctcgaggccaagagtttgcgataggccttggaaacaaagggggagtcaccatccctacagaaaaatacatgaattagcctagtgtggtggcatgttcctgtagtcccagctacttgggaggctgaggtgggaggatcacttgagcccagggaggctgagactgcagtgagtcatgatcaggcctctgcactccagcctgggtgacagagtgagaccctgtctcaaaacaacaaaaaagtagcagccaacatcaactgaccttttgtaccaggtgcctattgataccatagtttaatttcttataactgtttcttatttcacttaccaactctgtcttcagttactcccagatttttactgtgtgtgtacagatgaccttttgtttagactgaattgtctccccagaagtaagattactgtgagtcatggtgaatggacattctccttacccttgatgtaaattgacagggttttgggtgcctcccagctataatcttagcactttgggaggctaagagaggaggattgcttgaggccaagagttggaggaggcagtatggcagtatggtgagaccctgtctccattattttaaaaaattgacaggctttaccctggaaggcttatacacaatttaaccacccctcatagtataagaaagtgcccatttcactgcacctttgccagcacagggtattataatttagtaagtcattttttgtttgattattttacatagacaaaagaactcatattactttacttgtcacatttcaacatctttcctcagcttattagctctatttcttttctgtctgtaaatggttgttgctgttttggtctttgagacaggatcttgctctgtcaccaggctggactgtagtggcataatcatgcctcactgcagccttgacctcccaggctcaaacttcagcattccgagtagctgggactacaagtgtgcaccaccacccccagctaacttttttcttcttttggatagagacagggtctcactgtgtcgtccagaccggtctctagctcctggccttaagcaatcctcctgcattagcttctgaaattactggaatttcaggcatgagccaccatgcctggcctgggctagtcccatattctctagagttctgtttactttgtgctagccaatctctcattatgctgttcacctgttataatgaataattctctgtattaaattttaccactttaaacttttgagtggtttatgcttcctgattggactctgactaatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgctttggatgcacttgagcaggggtccccaacccctgagccatggagccgcaaggagccacacagcaggaggtgagcggtgtcgagtgagggagtgagggaagcttcgtctgtatttacagccactcccctttgctcacattcccgcctgagctccaccttctcagatgagcagcagcgttagattctcataggagaacgcaccctgttgtgaaccgtgcatgtgagggatcaaggttgcgctgtccttatgagaatctaatacctattgatctgttactttctcccatcacgctcaggtgggaacatccagttgcaggaaaacaagcttaacacgcccactgattctacattatggtgagttctatgattattttattatatattacagtgtaataatggaaataaagtgcctaataaatgcaaatgtgcttacatcttttggcccagctcctacctcccggcagcctctccaggccgagaactttctccagtcagcctctacagaccaactcctacctcccggcagcctctccaggcccagaactttctccagtcagcctctacagaccaagctcatgactcacaatggcctatttaggcccataccctacgtcacggcagcctccgcagatgagcctactgcctcacaacagcctccacaggcacagctccatcgttacaatggcctctttagacccagctcctgcctcccagccttctctccaggccctgaacattctcagtaagttcagatagctgggactgtaggtatacatgacgatacttggctaatttttaaattgttttgtagacacggggtctcactttgttggccaggctggtgtcaaactaatggcctcaagtgacccttccacccctgcctcccatcctcgaggtatgtgccaccacagggagcacttgttcaattttctaaaaaagaaatttctaaagtaaggctgtgggatgatggcaggaagataaaagaaaaacagaagaataagttaaaatgacttattcacgcatattcttttgacagcaagaagaacttttagtatgtacattccttacaaacaaacaaaaggcagataaacaatgttgtataggaacttcaacacacactgtacaatattcccactttgctgacataagttatggaaatttcatggtttacttgagtgtcgctaccagtattttgcttctctgatgatttttatcaacttcctcatctgttaacttctctccaaggtatgtcatgtcacgacatactgccgctgcacgaacatggccagtgtcttcctattcaacatgtagaatgctttcctaatttctctttttactctctgtctttgtgttctgcattttccttacttttattgtcagaaactccagaaagtcaatcgtactaatttatcacgatttgctttattaatttatacattgcttatatggaattttgcccagcagacctcattacaatttctaacctgttttattttgtttttttttctgagacagggtctccctctgttgtccaaggctggagtgtagtagtgctatcgcagctgactgcagcctcaaccttccaggctgaagcgatcctcccacctcaacctcccacgtggctgagactacaggtgcttgccactatgcccaactaacatttggaattttcgtatacgtggattctagaggggtgacagcgaaacgtgagtaagcatggattttggtatatgcagagatggggggctggaactaattctgtatactgagggatgacgactgtgtatgtttttacaattacgctgtaggatacatactgttgcatagccttgaaaataataatttttaattgagtggaataagaataatattgataaaagtagcagctggccaggtgtggtggctcacactggtaatcacaacactttgggaggctgaggcaggaggatggctcgaggccaagagtttgcgataggccttggaaacaaagggggagtcaccatccctacagaaaaatacatgaattagcctagtgtggtggcatgtt

SEQ ID NO: 5343 - DNA, 2552 bp, Homo sapiens
actccagggctgatgtcatggcgcgaagcccggcggtgctgccctcctaggccccgggaaggccggccggcaggggcgggggcaggagtcgccgactctgggggtgctccgagctcgtgctgcggtcccactgtgcgccctgtcgccgccaccgcggaaaacgtcttgcacgtgcgaggggcatttcaggagtttcctgtctgtcagggttttcccaagctcagccgattgttcttgctgggatctctcctgtgattacagtcaaatgagagctggctggattcttcactgagtctcccttactcctgtggctggaggctgatgctggctgtcagctgggacctcagctgaggctgttagccagaacccctacatgtggtctctccatggggcctggactctctcacagcatggtggctggttgcaaggagaagcatcccaagagatagcaggagaaagttgtcttgccttttgaaaactggcttcgcaaggcccatagcagatcttcccctgtgctccactagttgagacagtcacgaagccccacccagtttcaaagaaggggacagagactccatttcctgatgtgtgagtggcaaggttctggaagagtatgtggaatggaaagcattattgcaaccatttggggaaaatacaacttgctgctggcaggaaggtcatttcaggcagagatcttcattgatggtaccttcagaaatgcatttttaggaaagaaagtggtttttacagacttggcattgctaagggaaaacataaggttttagaagtatttactgagccatcttcaccaagacttatgagaaacatttcttcgaagagaagatgctgaggaagaggaagatgacttttgaagtggactccaaggggcagacaggaggctgggatggatggcagctcacagctggcaaaggcagtggactagcaatcatgggtgaaggcctaccaagactgattcttagaggggggagaattgactttgtgttcttatagcaagtgaccaggaataaccagatgctgtgtccaagctgagtcctcaaaaacagtagtaggcaggggccaaaccagaaagcaacagttaacaaaaactgtattgtagcaagagagataagataagcacacaagtgtaaccacccaacgggttcaccttgtctgctgcctagacagagccgatttatcaagacaggagaatagcaatggagaaagagtaattcacgcagacccggctgtgcaggagactggagttttattattactcaaatcagtctctccgagcattcggggatcagagttttaatttggcaagtaggggcttgggaagtggggagtgctaattgctcaggttggagatggaatcatagagggtcgaagtgagttttttgtgctattttctgttcctgggtgggatggcagaactggttgagccagattacagttctgggttgtgtcagctgatccacccagagtgtagggtctgcaagatatctcaagcactgatcttaggttttacaacagtagtgttatccctaggaacaatttaaggaggttcagattcttcaagccagagactgcgtgacccctaaactgtaatttcgaatcttgtagctaatttgttagccctgcaaaggcagactggtccccaggcaggaagagggtctttttgggaaaggtctattattaattttgttttagagtcaaatcatgaactgaattccttcagggcaaagttatttccacctatgcccaggaatgaacaaggacagcttaaaggttagaagcaaaatggttaggtaggtctgatttctttactgtcataatttcctcagttataattttgcaaaggcagtttcacaagcaaccacaaggcataacagctatcatttgggggtaatacagggaagcagggagcagtcatcatgcatgagcaagagctgggtcagagataagacacagccccaggttagaaggcagcttcacagagatgaatagggagtgagatcaaggaccacagcagaggttgacagcccaaggcccttgatggcactatgacctgaatgtccaggatcttccatgtcaaccaccaactttataggaaagggtgcacgagccaggaataatggtggtcaagcttggctgtgtgggaaatagggagtttgcctgcctggcagctgctgagtgtctcagtagtgagcttccagctacacaatatctggaccctgagacccaaagaggaaggagactttggcttcctttactatgggcattctgtgacccaccctggcaatgagaaggactaaagaactacaagatattaaatctaccttatgtttttcacttgcttatgagcactggagctccatcacctgagcccccactaagtgcagatgtatgtgactttagaaaggttagatttactcttcatagctcagggtataaagaagtggtcccaataaaagtttcctttgctacagggggctgaggacaatcatgaggttgtgaactctttgaggacaggattagatcttggtcaatat

SEQ ID NO: 5344 - DNA, 1104 bp, Homo sapiens
agattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgata

SEQ ID NO: 5345 - DNA, 1104 bp, Homo sapiens; identical to SEQ ID NO: 5344

SEQ ID NO: 5346 - DNA, 438 bp, Homo sapiens
gaaagacttgtgaatccaggaagagagactgactgggcaacatgttattcagaatctccctgtgccatccaggctggagtgcagtgatgtgatcatagctcactatagctttggccttctgagatcaagcaatcctcccatctcaacctcccaagtagctaggactacacatgcatgtcacccatgcccagatcatttttgtagagtcagagtttcaccgtggtggccaggttggccatgttggccagatggggtcttcttttgttgcccaggctggccacaaattcctgggctcaagtgatcctcccacctcgtccttgtagagatgagatttagttacgtcgtccaggctgatctcaaactcctgggctaaatcgattgtctcacctcagcctctcaagtatgttatgaaggttatatgttaggaagggtcccagg

SEQ ID NO: 5347 - DNA, 1235 bp, Homo sapiens
gaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgcaaagacccagcccctgcatcaccgcaaccccctggtcggctctgtgagtggtttctatccaggcagcattaaagtcaggtggttccagaatggtcaggaagagaaggctgcggtggtctccataggcctgatccagaatggagattggaccttccagaccctggtgatgctggaaacagttcctcggagtggagaggtttacacctgccaagtggagcatccaagcgtgacgagccctctcacagtggaatggagtacacggactgaatctgcacagagcaagatgctgagtggagtcgggggctttgtgctgggcctgctcttccttgggacagggctgttcatctacttcaggaatcagaaaggacactctggacttcagccaacaggactcctgcgctggactcctgagctgaagtgcacatgaccacattcaaggaagaaccttctgccacagctttgcaggatgaaaagctttcccacttggctcttattcttccacaagagctctctcaggaccaggttgttactcgttcagcaactctgcagaaaatgccctcccttgtggcttcctcagctcctgttcttggcctgaaaccccacagccttgatggcagcgcctcgtcttcaacttttgtgcttccttttacctaaattttcctgcctcccctgggtctgtattccccttgtgccacaaacacattgcattattcaatgtttctcaaacatggagttaaaaattatctggt

SEQ ID NO: 5348 - DNA, 673 bp, Homo sapiens
ttgacatgtgtgaaaacatgaaatgacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacagaccctgcatgtgatggatcagctgacaccatccagatcggtaaactggttcatctgatcttgtgccctccacccaggaactgactcagcgcaagaagacagcttcgactccttgtgatttcatccctaaccaatcagcactcctggctcactggcttcccccaacccaccaaattgtccttaaaaactctgctctccaaacgctgggggagactgatttgagtaataataaaaccctggtctcctgca

SEQ ID NO: 5349 - DNA, 1959 bp, Homo sapiens
ccagcctgtgctaagaaaactgccccacatcatctgcagtaggacgggggagttggagccctggtcaggccactctgctactgaccacagttttctcatctctaaaaaggcgcagtaacaatataattaccgtatgcagtcccccaggatacagggtcaaaggagagcacaaccatcgcagttggaagcccatggggcagaagcaaggtctcgctgtgttaccctggctggagtgcagtggctacttacaggcatgatcatagcatactgcagcctcgaactcctggactagagcagttctcctgcctcagcctccagagcagctgggactgcagacacgcaccacagagcccagcctgagtcattttgattctgtaactggcttcctctcggcgggcaggctcacaccctccacccccagctggagatggaaggaggatgctcaccgcccattcctcatgcaggccatcgatggaaatgtcagacagtgcgagtccacgcctgaacacttctggggtccgctctgggactgacactggcagatccatcggtgagctcccgcctgccacctctgggcctgcattgcggtgatagggccaagggcctgggccttcaattctccagacttgccaaaatgctcagcgcaggcctcgtcggcaactgcagacaagcagaggcagcacctgggctctgcctgtgcctggcacagtgaagcgagggtgggggcaggaatgagggtcctctccatgcaaggggggaagatagaagaacaaaatttcaccctaatgtagtgtctttagaccgtgcaatgttgtgctcctgttagtctgatatcaggggcttgcagcctggcaaaggaaaaaaaacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacaaggtgggcggatcacctgaggtcaggagttcgagaccagcctggccaacatggtgaaaccctgtctctactaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaaaaaaaaaaaagaaagaaagatgatgtgatacatatcacatatttcctaacacccccaaccaaacacatttatgcatatgcataaagcagacgaggaaagattctaaataggctctgaatctcagttttctcatctctacaatggggcagtgatggcatgcacctcccagggctgttctgagaatctgatgcctcccattgcactggtgagcctggcacaggcacaggtcccaccccaggccctttgaactggctgttcctttggcctggaacattcctccccagatacctcctgagagggctccctcacttccttcaaggcactgctcaaatgctacctcttcacagaggctttccctgaccaccccgtctctttcctcttcctgcatagcctctgtcacctgacattttatgtcataaattactcatttattaatttcctgctctcccacagtggcacccgagctctgtgagggcaagactttgttcggttgtgggctatgcccccaacccctcggacagtgcctgcacaggtggacatttttgttggatgaaggattttctgttaaatgtgtctggcacacacagaaaaacaaagcccagcaggtacgatggtgattattattgttactggtggcgctcta

SEQ ID NO: 5350 - DNA, 3170 bp, Homo sapiens
gcataacccaatgtgcatgctgaggaggcctcacgccagtttaggctctccagtatctcccactgagctactctgtccccgacttagaggaccaggagaagggggagctggaggctggagcctgccacaccgtggctcgtctcactctggatggtggtggcaacagagatggcagtgtggctggagttttaggagggcggcctgagccgtaggagggggctggagcagtaacatggcggcctgagcggtttttctggcattgtctgcccagctgctccaagccaggctgatgaaggaggagtcccctgtggtgagctggaggttgtagcctgaagatggcacagctctgtgattcatctcctgcggttgtggcggccacggtgatggagactgcagctcaacaggagtgagaaatggaatcatcgtatcgctgatctatgtaaacaaactgaagaattgtctgaaagaaaatatgacatgaacttatgaattcaacaggtgaagatttacaacttgataaatcaactgtcagctcgagctgtaaaagccaaaggtccggtgatgatcccatacccttttttccagtctcatgttgaagatttttatgtagaaggccttcccaaaggaattttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcaaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagagccacctaagctgaagattcccttgagaacaagtactgtccctggtttcccagtgctggaatatagaaaatggatggacaactggacctaccatgaaagacttctgaatccaggaagagaaactgactgggcaacatgttattcagatggggtcttcttttgttgcccaggctggccacaaattcctgggctcaagtgatcctcccacctcgtccttgtagagatgagatttagttacgtcgtccaggctgatctcaaactcctgggctaaatcgattgtctcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaccatccagttgcaggaaaacaagcttaacacgcccactaattctacattatgctcctacctcccggcagcctctccaggcccagaactttctccagtcagcctctacagaccaagctcatgactcacaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcagcctctacagtcccaacgtctgcctcacagcagattcttcacgcccagcatctacctcactgtggaccccccaagccaagctcccaacctttcagcagcttctacacacccagctcctgccacccagtggcctctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagttagactctctagtcccaactgctgcctcctggtggcctatgaaggcccaaaatctcctcaagttgacctgtccaggcccagctcctgcctcctgtcagcgtctacaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccaggcccaccttctgcttcccggtggcatcaacaggcccagctttgacttgagaacagcctctgcaggccctgctcttgcctcccaggggctttttccaggcccagctcttgcctcatggcagctgccccaggccaaatttctgcctgcctgccagcagcctcaacaggcacagctcctccctcacagtggcccatttaggcccaactcatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggcgaagctcctgcctttcggcagcctctccaggcccagctcctcctgcctcccagtggcctctttcggcccagccc

SEQ ID NO: 5351 - DNA, 432 bp, Homo sapiens
aagctttaaaaaaaaaaaagatgccccacagagattctgattttaattgttctgatttaattggcttggagtagaattcaggcattgatatctttaaaaactccccagtgttgagaaacaaatttagagagttgagaagtaggtatattaaattacagaatcttactgagttttggtagactgataatacaatttgctttgcttttcttaaatttgcattgagatgggatttgaagcatattgtgctcttgtgaatgttgaagttgcattgtagaagtttagaagctctggctatgggttgcctaaattgatgttttgaggaagcatattaatgttataaacttcgctgactttgaaggttgtgttgtagcatgaggaacacaaataaaacaattctaaatcaaactaattttatatctaacatgtccccat

SEQ ID NO: 5352 - DNA, 715 bp, Homo sapiens
ctgagtactatataatttacaatcttaagaaattatcaagttggaaccaagaaatagcaaggaaatgtacaattttatcttctggcaaagggacatcattcctgtattatagttccatgtgaaatcttcatggaaaatgacaagcagtggatcacatatgtgtttatagcagatacaggagctggctatctagaagttggcagacagaactgcccaaaggcagagaaaagataattggatggttaagaatttcatgacaaggctatgaatttcctggacaccactagaatagaggtggaacatttgaagaaaatgtaagctgttgaagtgtgcttagaaaacttgaatgtttggtcagagttatccatcacatgttcagtaagaagaacaaacagtagtaaacacaattgagtatttctgacaggaaaagtgtccagaagtcacaagttgatacttgatacagcagaaaaacactgcatattataaccatcagcttttctgcactcaacctaaagtcctttggaacccatcgaaaggtcaatgttattaccttgctcatttttggaggacttttacaagtattttgagaagtatctggggatggacattcattcgtagttgtgggttctggattttcaggatcagggtctataaagcagaagaaacctatagtaagtataaaattacacaataaacactgttttaacaccacaaa

SEQ ID NO: 5353 - DNA, 527 bp, Homo sapiens
tccattttattgctgaatgctattctgttgtattgatataccacattttgtttatccattcatcagctgatggacagttgggttgtttctgttttttggttatgaataatattgcagtattgctaagaacgtgtgtataagtttttctgtgggtatatgttttcatttctcaaggagatacctttaaagctgcatccatccatatctctactttgtggttaacattctcctaggttatgcagtttgtttgaggaagaacagtgttttagtaaactcttgatcctactgtggtgttgcggatattgccctgaatcaagaaaaggtgccaccaaaaaaaaatccaaaacccaaaaacaaaaagagagaatcctgtttttaagtttgaactctccagtagcattgtttccaaatatttggtgcagaactttaaccattggtgagagttgacagacgcgatagtgcctaaattcaatgcacatgtactgctgctttaaacaaataaagaggattttcaatgcgaagcctca

SEQ ID NO: 5354 - DNA, 1589 bp, Homo sapiens
tggcttcccgcaagctgcctgttttaacactctttgtgatttatttcaatctcatcttttacaaaggtacggcaatttgttccattttcctgcttccttctcctcttcctccttcttctaagatggcagagagaaactttcttacaggtcccagcaacactgccgtatagcttagaagactggagatatttattctcaatgtactcagtttactttccaactggagcattatttgaaagacggtctgccagcattcaactgaacagacacaaatgcaggtatgaatagtgaggggagagagtggtttgaaggctggggttgctgtcaggtctgatgaaccctccagcactcgccatcatcggctacaatgttgaggagactccatcacaacctcagatcaagagtgtttctttgttcctccaagccttccaaagcactttatggaccttgtatttggacaacacctccatgaagcttggaagccaataagtcacatcttcattgaacaattcatgaaattacagggcagaggtgaaatatgaccttcgagggaaaagctggcggtggagcccagaacttcattttgctgggatggttccctgccgttattctcctttctcacgaaaggatcctgcagtcaatttacggcatttgtaaataaaggcggctgtgtcagcctcctgcctggagaaaggaaggcagcaccttgaatgctgagagtgtatctcaggcttactctatacttccattacaatatctcagaagttataacagatgaagatggggcgaggtggtcaaggtaagaccggggtcagcagggcaatggcgtgtgaggagtttctcattagaaaacacaaatggggatttggattggttgtttttcttgtctcagaaatcttcttcagaatgacctccccacccctgctttgtctttgaaagttttgccatgtttgaattggcatacttacacattgtaatgatttttctttcatcaattaaaaacaaagctattttttggccaagtgtctcctgaagcaaagttaagaaacagaataagaaggttttgagtcacgcacaagactgaaaattagctaataaaaacccttttcccccctatttcctcaaaactcagttctcagaaaaacaattctggatgcaccctgtttaccagcaaggttaaaagttcaagaaaagaaagacatcacaatatttacactcaggcaaatcactgttcatctaccacgtctgaccctgcagatttgggagcgggccgctgtcctgcctgtcaaagggagaggaagcagtgcctgtctggctggccctatatttgctcctgttgtctcactctctgccaccagttttgttttttgttgtttgtttgtttttgtttatttgttttttctaagactgccggcatcccttctttctagatcgtcttgtctttcttttgatattttattttcatggataagatcgctaggaccccatcagagtatttttctgatggcacgatgctactactttctgatatatttatttcattctcaatatttgaatctatgaaataaaataatagtgataatagccac

SEQ ID NO: 5355 - DNA, 1998 bp, Homo sapiens
agatttgcagcattactttattccaatcttttgttgctaaaagtcttaaggcattcacccatttgttaaaacctttacagccaggcgcggtggctcactcctgtaatcccagcactttgggaggccgaggcgggtggatcatgagccactgtgcccagccctttttgttttgttttgtttttttgttagagatgaggcctcactttgttccccaggctggtctcaaactcctggtttcaagcagtcctcccatcttggcctcccaaagtgctgggattacagatgtgagccacagcacctagccaaaaatgcattttaaattaatttttaaaaagtgaatcatactgtgtattcagaaaatatacgaaaacatacactcaaacatttacgtatgcatcagataattcataagggagagtaattttctgtttgtactgaatgtgggtagggttttctttacaagtcatacctcattacatatcagaaaattcatgctggagagaaactttatgaatatgatgactaggaaatcttccactgaaaagttaatgacctgaacatagtaaattcacacatgagaaaaaataattcaaatcccattatacactaaaaacacaatttggagaacaaagcctataagaacagtgactggaaaacacttcacttggaatatatcagaaagtttctaccagaaggagacagggttaagagcaaatgtggcagtagcttcacacagaaatcaggttttagtattcttcagtatttacacgagtgaaattgtatttcttgaaagtgagaaagtcttttcacagaagtcagaaccagttttaaattattcatactacagagaagccctgtgattactgtacattatatattgtatatggaaaaatcttcatctgtgagtcacagcttactgtataccagacaagtaattgttaagaataggttttgtaagaatatatcgtcttattaaatgccataaaattcaaatagagaagaagctctatttgatacattggaaaaggtcttcctatagaagcagatttcataataaacatagttcattttgtttactgatttaacttcaagcccatgtctcaaaccagtggagaaaaacagaccatccaacactttcctttctattaaaataaatatttacgtacacacacacatgcatacatatataacttggcataaatgtgactttatttatttactttagagacaggatttcaatctgtcgcccaggcacccagatgggagtccagtggcacaatcctggctcactgcagcctcgacccctgggctcaagtgatcctcctgtcctagcctatagagtagctgggactacaggcacacgccaccacacctgctaatttttttagttttttagagacagggtcttgctatttttcccaggtcagtctcaaactcctggcctcaagcagtcctcctgcctcagcctcccaaattgctgagattataggcatgagccaccacacctggcctaactgtaacttttataatgtattttatgtcttcttgatttttgaacttccattcatagcaattccaaccactccaacagtctgtcaacagataatcaattggacaaggacaatcatgcccttaagtactagagattatttttttctgtagcatatgcttgtaggagtgggactgatcaaatggtatgtgttattttattttaacagatgttgccagatttctttgtcctaagactgtagctttttatgtttccaatattagtgtataaatatacctctcccgcactacaagtagctgttactcttttttttttttttttttctgagactgagtcttgctctatcgcccagactggagtgcagaggcacaattttggctcactgcatcctctccctcctgggttcaagcgattctcgtgcctcagcttcccaagtggctgggattacaggcgcctgccaccatgcccagctaatttttgtattttta

SEQ ID NO: 5356 - DNA, 8827 bp, Homo sapiens
cagcgaggagtaaagcaagctaaagccaaagcaagcagaagagaaaaaatcacggattttagtggcaatacagaatagaaatagaatagagaaaaatcaaaagttactcctttgttcttttcaagctttttagttagactgaccaagaaaaaaagactcaggttactaaagtcagaaatgaaagagggcatcacaaatgcccttaagattaagaagggctataagggaatattatgaataattttatgccaacaaattgtataacctagatgaaatgggcaaattcccagaaagataaaattaccaaaccttgagaagaattagaaaatctgaatagatttttaacaagtaaggagattgggttagtaatttaaaaaaaccccaaaaccctcccaacaaagaaaagtcgaggaccagatggtgtcactggtgaattctacctaacatttaaagaattaacaccaatcttctcaaacttccaaaaaacaagagaagaaaacgcttcctaactcattctatgagactagcattaccatgacaccaaagctagacaaaggcagtgcaagaaaactgtagaccaatattccttatgaacatagatgtaaaaattctcgagaaaatactagcaaactgaattcagcagcatattaaaagaattgcagatatttgtcacttatgaggaggaaactttctgagaaatgcatcattaggcaattttgttgttgtgtagacgtcctagagtatacttacacaaacctagctggatagcctactacacacctagtctgtgtggtatagcctatgctcctaggctacaaacctgtacatgttgctgcattgaatactgcaggcaactgtaatacagcggtaagtatttgtgtatttaaacatagaaaaggtgcagtaaaagtaaagtattataatctcaagtgagcaccatcatatataacgctgttatgcagcacatgactgtatataccctgaccaagtgagatttgtcttgggaatgcaagcgtacttcaacatataaaaatcaatatcatacaccacattaatagaataaagggaaaaaactatatgattatctcaattgatgcagaaaaagcatttgataaaaaaactaacagcttttcatgataaaaacagacagcaaactaataatagaagggaattttatcaacttgataaaaggtatgaaaaactcaaaaagaacagtatactgagtgttttcaccctaagatcaagaacaagacaaggaagggcactcttgttacttctctgcaacactgtactgggatttgtagccaggacaattagacaagaaaaagaaataaaaggcaagatttcaatgggaaagaatagacttttcaacaaatgatgctgggacaactggatatccacaggagaaacaatgaagttgagcccccacctcccaccatatacaaaaattaactcaaatgaatcaattaaatgtaagagctagaatcatagacgtcttagaagaaagcataggcatagatcttcattgccttgaattaggttatgatctcttacttataacaccaaaagcacaagcaataaaagaaaaaatgaattagacttcatcaaaactcaaaacttttgtacttcttaagataccattcaagaaagtgaaaagataaccaaaagaatgagagaaaatatttgcaaatcatatatctgataagggatatatatatatataatatatatgtatacatatatataaaggacatgttgggaccaggagtggtggctcacacctgtagtacaaacactttgggaggctgaggtgggaggattacttgaggccgggagtttgaaaccaggctggacaacgtagtgagaccccctctctacaaaatatgaaaagtcagcccagctacttgggaggctgaggcaggaggatcacttgagcccaggagttcggggctgcaatgagctatgattgtgccactgcactccagcctaggtgaccaattgagactctgtctctttaaaaaaaaaaaaaagtgtataactcaacaataaaaaagacaaaaagcccagtaaaaatgggcaaactacctgaatagacacttctttaaagaagatatacaaatggccaataagcatatgaaagatgttcaacatcattagcagggaaatgcaaatcaagactgcagagagatatcatttcacacccactatgtggatataataaaacagacaacaagtgttgatgatgtagagaaattagaaccctcatacattgttggggggaataaaaaatggtgtagccactttgggagacagtttggtagctcctcaaaatgttaaaaaacagagttatcatatcacccaggaatgccatgcctaggtatacacccaaaaaagttgaaaacatgcccatagaaaaacttttacgcaaatgtttatagaattattcataattaccagaaagtagaaataccaaaatatccataaatgaatgagtggatacataaaatatggcatgttcatacaatggaatattatttgcaataagtagaatgaagtattaatacatcctgcaacttggatctaccttgaaaacatgctaagtgaaagaacagaagaccagtcacgggagaccacatattgtatgactttgtttatatgaaatagccattatacagaaatgcatggagataggaagtagagtagtggttgctaagggctgcagggaggggggaatgggaagcaactgttaaggagtatggatttctctttggagtgataaaaatataacacttgatagtggttgattattgcacaattctgtgaatgcattaaaatccactaaattgtgcactttgaaggatgaattttatggtttgtgaattatatctcaacaaagctgttattaagaaaaaactaccatgggacttgaaagcagattaaggaaataagtattctttgtaattttccaacatgctgtttgttagaggttcatttcagaactaccagttgtgttggagggataaactgtgaagatctctggtgttccttcatttgtgcttctaaaagcttattgaggacaggaaccacatcagttttatctgttttctaagactttgggagtcccgtgacattaaccaagagtctgcaattacccctatgagccccagatgcacaagtcattaaagaccaagtcctcacatccttcctaatacagcgctgctcaccaggttcttttcatttgccctgtttcagtcagactggactgcttattctctatgttgttgttaccactatttctttgttcaagcttctgtttctacccagaatgtttctctctgtcatctctacctgttaaaatcctacctactattccttatatcatctcttaatcatatgttactattgtctggtattgtcattttttataaccttagtagacatgattattctttatatgatcaatgtttatttatagttgcccacacatttattacttcttttttttcatcttagaacttctaactgggaactcttttctaatgcctgaagcacaatttgtagtattgcattcagtgaggatctactgatacagactctcaattttgtttgttgaaactattcttattttaattcttgaaaattttcttggcagttcttttctttgagatgctttcttacactgtcttctgatctctctcactgctgtggaaaatcaatctatggaaaagcagtcaatgcttctttgaagggcatcccctccatacacacttttacaacttttttatttgattttttttttttgcaatttcactatgatatattagatgacagtttctttttgtttatcttgtttgagatgtactgggctctcaaatctgtggataagtggtcagactggtgaaactcacagcgttatctcttctgttgtttcctctgcttggttttcccagttctctctttctgggactttgagcaaatacattagacctccttactgtatcccacacatctcttaccctttcctcagtattttctgtcttctccaggctgcattctggataatttcttctgcattgactttcagttcattaattctctccttgactgtgtccagtctgccactaatagtccatagaatttgaaatttgggatatcctatttttcatttttaggaatcctgtttggctctttttcaaatatgtttttttcacattttagtttcatgctccctgaaaatatttttaagtttgtcatttgtttcatttaacgtggtaagcataattgtttttatttatttatttatttgagatagggttcttgctctgttgcccaggatggactgcagtggcatgaacatggctcactgcagcctcaacctcctgggctcatacagtcttcccagtttagcctcccaagttgctgggactacaccacgcccagctaattttcaaaaatattttatagagacagggtcttgccatgtcattcaggctggtcttgaactcccaagctcaagcaagccaccagccttggcctcccaaagtgtcagaattacagtcgtgagccaccatgcccagctcataattgtttttaaaagtagccttgataattccagtttctaaagcctgtgcagctctatttgtcttgtttgtggtttttcttggcctttcttcatgttgtcatattccttttttttttttttgagacaaaatctcgccctgtcacccaggctggtgtgcaatggtgcgacctcggctcactacaacccctgcctcccaggttcaaacgattctcctgcctcaccctcctgagtagctaggattataggcgcccgccaccacgcccagctaatttttctattttttagtagagacggggtttcaccatgttggccaggctggtgtaaaactcctgacctcgtgatttgcccactttagcctcccaaagtgctgggattacaggcgtgaaccaccacgcccggcatgttatcatattgttttaagtgcctaatatctttggcgttttgccgttaccctggaggaattatttgtgtgggttccctgaggcctgggaaggaccttcccgtctcttcgtctgctagattcttaggggcaccatcagatgataactctagccaagttaaagtttcaggagtccttggcccaaaaatgctacaagtgccctggatgccagtccacctgagggctggcccgtggccacattctcccaaaggctgcttattttcttttttgaacttcagtttcattccttagtctcaaggcttcggtctctgcattcccagtagcgcatgcgcgcgcgcgcgcgcgcgcgtgtgtgtgtgtgtgtgtgtgtgtgtgtgtgtgaaaatctggcttgtatttttgtatttgtcgtgctgccccaaaccaatatgggcagcgtcttccatgtgatacccacccaggcaggtgggtcctgggttctgatctctgtcattctggcctgagggccatggaacaggaccacaagtccagtgtattagaaaacatcctcattgcacaaatggcttgtgctctgagacactctccctacctctctgggtacagcttctttttagtctcaatgttcttagcggttgtgtggggacagccagctacatggttgctctgatccctgtcccctgttactcatgccctgtgtaactccaggatctgtgacttgcttctaacacatagaatactaatgggatgtttgtttaatccagatttttagatgttttcagtggttgggtcagtcctagcttgcctgtcattactggaaatgagcaacttgattccctttgaatcaaagaacgatttagagttgggggtttttcatttcttttttctttttttacattctcaaaggaggtgacttttcttttttccttaaatcagacataaaatatctcaagcatatggaaaaatacaaaagaatttaatacacctgcgtattcaccattcagactgaacaaatgttaatattttaccatatttacttcagtttttttttttttttttttttgagatgaagtctcgctctgccacccaggctgaagtgcagtggtgcaatctcagctcactgcaacctccgcctcccaggttcaagcaattctcctgcctcagattcccgagtagccaggattacaggtgcccaccaccacacccgggtaatttttgtatttttagtagagataggtttcgccatgttgcccaggctagtcttgaactcctgacctcaggaattcctgggcctcccaaagtggtgggattacaggcatcagccactgcacctggcccagattttttttttttttttttttaagaaacataacattgcagtgtacagcccactgtctcctcttctccttccttcctcagaggtaactgctgtcaagtaaatgtataccccagggtgcttgcagcctcataggtcagagactctcaaaacttcttcccccatttatttatttatttgtttgtttgtttgagacagagtctcgctctatcacccaggctggagtgcagtggtgcaatctcggctcactgcaacttccacctcctgggttcaagggattctcctgcttcagcctcccaagtagctgagattacaggtgtctgccaccaagcccggcaaatttttgtatttttagtagagacggagtttcaccatgttggccaggctggtttcaaatgactgacctcaagtgatccacccacctcagcctcccaaaatgctaggattacaggcgtgagccacagcacctggccctctatgtttttatgagtggcattatttgatatcagtttatgattttaaaatttatactgcgtgtacctgtttttcaccattttaacacatttttggaggtttatcatatttgatatatttatgtcctctttatcattttaatagtaatagtaggctattctgtttatccgttttatttctatgtgttcatccccctatacaaccactggtgtgtggcaagcacttactaaatgtcagctgttattgatggacatttagaaacaattgtttctatttgtttttataaacagtggttggttaaccatccttatcaatgtctttgtgcccgcatgcaggagacctctctagcataggctcctggaagtcggattgctgggtcccaggacagacattcaaacttcgctccccaaaatggctattccaatttatattcccagcagcagtatgagtttcttttcctgaaaatcctcactggcacatggcattaccagacttctttttaaaatatgaaatattgagtacataaagacatacggagggctgagcgtggtggctttcccctgtaatccctgcattttgggaggctgaggcaggcagatcttttgagcccaggagttcgagaccaacctgggcaacataaacctctacaaaaaaaaaatacaaaaattagctgggtgtggtggcacacgcctgtagtcccagctacttgggaggccaaggtgggaggatcacctgagcctgggaaggtcgaggctgcagagagctgagattgtgccactgcactccagcttggatgacaaagcaagatcctgcctgcaaaaaaaaaaagacaagacacgtggggagtaagataaggagtttccatatactgtctttccagctttagaaataaaactgcaaatacaaatggagcccttcctgcactccctgacttcatttccctcctttgccctccccgatgaacgtcatcccgagtttcatgatttttattcccaggcaggttttcgtagtttatattatttacacatgtgtctatccataagtatgccttacaacattggcaaaacgattttaaactacatgaactttataccagtaataacacaccctgtacaactttctgttgattttttttttatactgaacttcagctcttgaggtttatctatgctgatgatgacagtgacaatgatgatgtcatcaaacacttatatagtgcttgtatgccaggcactcctcatcacagctatgaatcgtggtccaccaaataagtgcaacagagtttatctatttttaaatctttgccatcactactaatgttgcagcgagtgttttcttgtacatacatccttgcggaagtgtttgggtatatacctacggtagagttccttggttatgtggtaccagcatcttcacctaccaactctgtccaaatggttaccccaagtgtttgtatgaccctgtcagtatgtgcgagggttttttactccacatttcctcccaaacttttttttttttttttttgacagagtctggctctgtcgcccaggctaaagtgcagtggtgtattcgcggctcactgcaacctccgcctgctgggttcaagcgattctcccgcctcagcctcccgagtagctggaattacaggtgcatgccaccacgcccagcaaatttttttattttagtagagatgaggtttcaccatgttgtccaggctggtctcgaactcctgacctcaagtgatccgcccacctcggcctcccaaagtgctgggattacaggcgtgagtcactgtgcccagcctccctggaaacttcattgtgttcaatttaagtttttcctttctcctaggtataaaagagaacctcatcattttcatttgcatttccttgattaccgatgaggttgattttcttggtcttttgttccttcttctgtcaaatgcttatttaaattttccccaatttttctactggagtttttggcccttattatatagacatatatggattattatatatacatatattatgtatta

SEQ ID NO: 5357 - DNA, 5316 bp, Homo sapiens
agagtgagaaacagtgtcttcttcctggctggagagcccgtgtcatgaaaatggggacagggtaagggatctgaaaggagcagcatagaagctgggaggatgaggcctgtcttcctggcattgatgctgcagaactacaggaaagaatttcagaggtgtcattatttttcatataagcagatgaaagagaagaattctttgaaaaaagaaaagtaggtgaaaaagggagagacagagggatgccagcagtgaaagaagccaggactgagatacaagattgtgatgctgggagagctgcaagggctcatgctgtaggtgaggagtgaggctgcacagggagctcactggcagcttggagagaactgggtgtcaaagttgtcctgcagaggtctactgtcagtgtgtcaggctctgaagagaacaggctgcaacacatgaaaacaggaaggagacacaggggcgagtcagctccactgaaagtctgtagctgtgactttctggtttgccactccaatttgagtactaattaagtggtagtcacatcttcaacataaaaaccaaaataatggcatcctcgtggaaggaattttgtcagaaaaatgctgtgtactttgctgtcttcctaggatttgttctgtttttgtttgtttgttttttttaatggttccacaggctgcataggaatacaagctaagcaatattttaattacagatcattaagcagctttgagtctggaaaatttgtcaaatgtaccgagcaattagaattgttaccaggagaaaatatcaatctacttgctggagggtcaaaagaaaaaatagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgagtaagtttactcttacggaggtaaatgtacattgtgtatatcatgtgataaacatacatggggtgaagagggctggaaggagagttactagattactaaatactagtgctaatagcttcattttagttgtagaagtcatatgatatatgaatgctgcttgccaacaaaaactgaggttgaaatgaaataaaatgtaaaaatccccaaaagcaaatgtcttgacttgctgatatcattttattatagagcaggctgctcctcttactgccccctaactttggatgtcagtttgatagcatcttatcaattgctttattctttgagtggttatgaattgtaatttttattaattgacagtaaatattttgtttcagaaatgtggtaaagtacttgaagcaaacatcccgcatcactattggacctctgagactttctactttaacagtttcacagtctttgccagttctaagtaccttgtagctgtattgctcgtttgctttggagaccacagtttctaacagactttcaacagaggtctgtatatttttacaagcacactcttatgactattaatggtcattactgtagaacaaagaccttattttttgagttttttggaataggatttgtagttgggcaagctggtaaatccagaaatctaacatgccgttttcaggcagtctttcatttgggaagtacatggggcagatggaagaacctgagataatcgcaaggatggcaaattgctcagttttttcttctatttttggggtgggaggtggtgtatgtaaagacagttcctttaggcggattacgtaaattttagatttgctgcaaacaaagatctctcctcttcatcctaaatggggtaaagttcgaccagagatgggggcttctgaatgaatggtgatcttcgagaacttcataataaagcattagttgtaatgtttttctgcagtctgctttatagtaaatgtgctgtgacattttttttgtaatgtgctttattaagtatattgataaattagacttaatattctgaagaagatttcccttcaaaacaaaaggctttctcttactgtgtgcttgcctcttgtgagtagaagataaatgatggaagggtatagtgtaatagataaaactactgcaatcaatctgaagtagccaaactatattgcagtcttggacttaagacttgctatatatctgcaaacatatcaacagcctgttttacgttgagtaattttggtttttctctggcaggactgtcttattccactcttcggcgaagctttacgttcatgtaaacagcatgacgtgaggccgtggatgcaggcattaaggtatactgtgtaccagaatcagttgttggagaaaattaaagttaagtggttttccttttttttttttttgtaagagaaaattaaaggtggttttttttttttaattttgctttattgaggtttatattacacattctaagtgtatggtttgatgagttctaacatgtcttcacttgtgtgaccaccaatacgatcgagatacagaacagcatcttaccccagaaggttcccttgagatcatctcctcatttgcccctgtcagcagttactgatttgctttctgtcactatggattagacttgtctttactaaagtttcatgtacgtgaaatcataacaacatgttctcttgtgtttggcttctcttgctcagcatgatatttttacggttcacccatattgcatgtatcaggaatataatcctttttattattgagtagtgttctattgtatgtatataccacagtttatttctcccttcatcctttgctagattttggggttttttcacattgcgctattcagtataaacctgctctcaacattcatgtgcaagtctttgagtggacatatatttgcgtttctcttgagtgaatgcaccttgttgggtcacgtggcttaacttaaaaaaattttaatcactgtggtgcatatgtagtgattattagtgattatctcataattttattttcttgatgactaatgatgttgagtgtatttcatttgtattttagtttgcaaatgtttgttcaaattcttcacccgtttttaatgaagatgtacgacttatttttgtgttctgaacagaagttctttgtcacataaaatgtgctatgaatgttgagttttaaatactccaaatgaatggctagagaattactatttgtagaaatatttatatgtcaaagggatgctaacaatttactttattgctctaaaatagaaaagttgccagaatgctgtggagttttagtggaaaacatgatagctggtgttactgagtaaatttgagtgttaaatgtcaatgtaagctaacggccaagatagggaccactgcagggtggttacttgcagctgtgactcaactggtccttcactgccaaacatacctggggttggatcattggcctgacgtttgcaaattgaggaaccttagggcaaatcagtgaacttctgaactgccttcgtcttcagttatatggggatttccccacttttgagatccttgtaaggattatatgagatgaagagatgagacaaggtatataaaagtcctagcacagagcgtgtcatataatatggcttcacaagtaccctcatctcctttccagtcgttttttgtttttgtttttgtttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacatcaaacacggcgacccgacatagtgagaccctgtctctactagaagaactttaaaaatcacctaggtgtgggccgggcacggtggctaacgcctgtaatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaatgcgaattattttctagctcaatattaatactgcttatgtcagctgaatttcagcctttcaataacagctagtcaagtatttttttagttggttcctattgatcgtcatcttattttagtggaatccattatattgaagatgtcaagttcctcatttcccatacaaagaatgtgagattcatctttcttgaatctttgctaagtgttgaaggggacttttggcatcttttcaggaggactataattgggccctctaactaaaaagtctcctatgccccttagatagatgagattttttttttttgaccttgtacccaccaacattggtgggaggctcagaagggactgtgtttgtaactttgtagcactttctaaacagtgacctgttgtatgggcattataggacagtccgtggggtggggcgggggatgggggagatggacaaatgaggtctggtttaaagaatgagaagtgtgaccaggcatggtgactcatgcctgtaatccagcactttgggatgctgaggcaggaggatcacttgagcccaggagtttgaggttacagtaagctatgattgtgccactgggctccagcctgggtgacagaactagaccctgtctctaaaaaaagaagaagaggtgtgtatccttctaaatgataaaacagatcactcccctgcttacataaaactttccggtggctggccaggcacggtggctcacgcctgtaatcccagcactttgggaggccatggtgggcagatcacgaggtcaggaaatcgagaccatcctggctaacgtggtgaaatcttgtctctactaaaaacacaaaaaattaacccaggtatggtggcatgcacctgtagtcccagctactcgggaggctgaggcaggagaatcgcttgaaccagggaggtggaggttgcagtgagctgagattgcgccactgcactccagcctgggtgacagagactctgtctc

SEQ ID NO: 5358 - DNA, 5274 bp, Homo sapiens
ggggtttcaccatgctgctcaggctggtctcgaactcctgaccttgtgatccacccgcctcagcctcccaaagtactgggattacaggcgtgagccaccgcgtccagcccattttttctttatatgtcatttttaagctttcaggagagcatgaacttatttattaaaagttaattttgtattttaataggggacttttacaagtatttccaaggcagtttgtaattccttaatatcttagagtaacctgtagagttagtttcacctttaaagtgattatatttgatatgtatgtgtgaggaatcatcacctctagtaaatgctgcattctgagagtttggcatcttgaggagactccagcactcttctgtctgtaactagtccctgtcaaagcccctagcacagcaatatgcactgtgggtagattttttaatgtaataaatggcccctattgccaaggatctcgcagtctagttgagaaagcaagacgcacaaaattaaatagtacaagaattaacaatgtaagacaggagaagtcatatgtgagtattgccaaatgaacgacagcattcataactcaaatcacattcaaagaaagagatcactgtgaattgtaaatgttcagggagggtttagtgaagaaaagttaagctttgaacaggcttccaaaaatggagaggggtattctaggcaggaggaacaccataagcaaaggtgcaaaaagaatttgtggaggttcaggggatagtaaggagaccagttttgtccaagaggtggtagatgataaatctagaaaatacaggctgggcgtggtggctcatgcctgtaatcccagcactttgggaggctgagacaggcagatcacttgagcccaggagttcaagaccagcttggccaacatggtaaaacactgtctctaataaaaatacaaaaaaaagttagccaggcatggtggtacacacctgtaatcccagctacttgggaggctgaggcacaagaatcgcttgaacccgggaggtggaggttgtagtgagcctagatcatgccattgcactccagcctgggtggcagagtgagattctgtcaacaacaacaacaacaacaacaacaaaaagaaagaaaaaagaaataaaatacattcggactgagattttggaaggcgctgaataccaggctaatggtatttggagtttactcaataggcatgagagagctagccaaggtttttaaacagattacttaattaaatgttatttttagaaatttaatcttttatattgctgccagatgtatttgaggtagagagacatggaaattaggaaaccagttacatagatattgcaataaactaaattcaataaacctctagatgtgagtgatatgacaagaatggagaagaaaggacgagtcccagagacatatatggaaggactaggtaagactcattggatggccaagggaaaaaaaaaaagaaatgtgaaagataattttgtgtcctgtggccagggagtttgccatgtcatggcacaagctcactagatttatttttccaactctcagactaaaggtagcaagctgtagagaacaaggtgggctcgaacagagaaagctaggtaaatctgttttttaaacactacatgtattaggcattaaagtgtatatagtttaatgatttcttgaagtgatttgtcctctacaaattaattaacaccaaagaatacatttctcctatactgattgttttgcagttaagcttgagtccaatttcccctagaagttgttgttttgatagtctttggacatactgtgaaatgtgattaagtcacccttggtagtgttagtttatcactacggtgaaaaaccatagagaaaataagaaattccatggaaattttcctagtaaccagttgtcaccactggcatcatgtatatagatgggattgttattgttaccgtatttatatgatttggctgcctatcaaaatattatatattttcaaaagtgaaacagaaagcagcagtggtagtaatgtccttggaaccttgaccaacaacacatcatcctagaactagagatgactctaattaagaaactagataagtcatgataataagaacgcacatttttaaaaaactatttcgtatctttttttcttctaacttttaggttcagggggtacatgtgcaggtttgttccatgagatattagctttctctgagatgaagaacctgagtgatataatggattaataggaatttccaaactcttcaaaacattgataattagacatatgtcttgggcttctgatctccaaaatgttgggctacctttagtctcagtcttgttctaacagtacactagttcagctatcaaaagacaaggagaggaaaggagtaaaagttggttgtgggtggggagtgggtttgtgtaacaaggctatacccctgtcttgggagttggtgagtaagagtgctttatttatcttttttttttttttctaagcacttaatggtcactgtctaaaaacagtgtatctatgtttgttcatctcctaatgggagtcgtggctaagttctaagattttgcctctgtgcatagcattttaaaacttttccaatgttctttttttttgctttgtttttcctttttattgagatataattcacataccatacaatttacccatttaaagtacacaattcagtgttttttaaaattacatccacagagttgtgcaagtatcactacaatttaaaacatgtttatcacctgaaagagaccccatactcattagcagtcactcctaccggtcatcatcctccagcccctggcaaccactaatctactttttgtccctacaaggtttacctgttctggacatttcatataaatgcagtcatacaatatgtggccttttgtgtccagcttctttgacatagcatatttccaaagttcatcgatgttgtagaatgtatcagtacttcattcctttttatggctaaataataatccattatatagatacaccatattttatcttctcatcagttgatggacatttgggttatttccactttttggctactgtgaataatgttgctgtgaacactcacaagtttttgtgtggacatgtttttagttctcttgggcatgtacacagaagtggaatgactggttcatatggtaactccatgtttaaccttttgaagaattgccagactgatttccacggcagctgcaccactttatattaccaccagcaatgtatgagggtcccagtttctcaatattcttgacaacacttgttattatctgcctctttgattattgccatcctagcaagtgtgtagtatctctttgtggttttcatttgaatttccctgatgtctaatgatgttgagaattctttcatgtggttactggccatttttgtatcttcctcagagaaatatctcttttaagtccttagaccatttgcttttttgagacagggtcttgctgtgttgcccaggctggagtgcagtggtgcgatctcagctcactgcaaccttcccatcccgggctcaagcgatcctcccttttcagcttcccaagtagctgggactacagatgaacaccaccacacctggctaatttctgtagaattggggtttcgccatgtttcccaggctggtcccgaattcctggcctcaagcaatccacccaccttggcctcccaaagtgctgggattacaggtataagtcaccgttcccagccccttagcccatttttaaatcaggttgctttactattattactattattgttgagttgcagggttctttattcgagatgcaagtatatgatttaaacatatttctcctgttctgtgtgttgccttttcactttcatgatggtgttctttgaagcattcaagtttttaaaaattttgatgcagtccaatttatattttcttttgttgcctgtgctttggcattgtatctaagaagaccttgcgtaatccaatttcacagaaatttacacctatgttttctcttaagagttttataatcttaactcttacttttggtctttggtccattttgagctaattttgtatatggtgtgttgtagggattcagattcattcttttgcatgtggataaccagttttccctgcaccatttgttgaaaagaatctttcccccatccaattgccttggcacccttataaaaaatcaattgaccaaaaatatgtgggtttattctggactcttagttctattctattgacctctgtatctgtccttacgctagtgccacaaagtcttaattactatagctttgtagtaagattttgaaatttggaagtgtgagtcctccaactttattctttttcaaaattgttttgtatattctaggcccctcgcatttccatttttattttattttatcttatttttttgagacggagtctcactctgtcctccaggctggagtatagttgcacgatctcgggtcactgcaacctccacctcttgggttcaagtgattctcctgcctcagcctcctgagtagctgggattacaggaacatgccaccatgcctggttaatttttgtatttttggtagtggtgggatttcaccatgttggccaggctggtctcgaactcttgacctcaagtgatccaccctcctcggcctctcaaagtactaggattacaggcatgagccacacgcccaggcccatattaattttagcatcagctagtcaatagctgtttaaaaaaaaaaaaaaaaaaaaaaggcaggctgggcgcagtggctcacgcctgtaatcccagcactttgggaggccgaggtgggtggatcacgaggtcaggagatggagaccatcctggctaacagggggaaacctcgtctctactaaaaatacaaaaaaaattagccgggcgtggtggcaggtgcctgtagtcccagctactcgggagactgaggcaggaaaatggcgtgaaggtgggaggcggagtttacagtgagccgagattgcaccactgtactccagcctgggcaacaaagcaagactccatctcaaaaaaaaaaaaaaaaaaaaaaatggccgctgggattttggcaggatttgctgtgaatctgtaattcaatgtgcagagtattgccatctcaataataataagtgttccagcccccatgaaataggatgtttttctatttatttagatcatctttaatttctttcaacaatgttttacagttttcagtatataagtcttac

SEQ ID NO: 5359 - DNA, 781 bp, Homo sapiens
gtggcctggggctgtcagacagtagtgtcgctgcaggacacggaggagactggcagcgaggcagcagggtcggcaggagcccataaaggttctgatgacgcattcctcaggcccaatccgtagagcaggaggtaagctttggacaatgttaatcttttcttgtaaatatttaaacattttatatttggtggcataatccatctcattgtatccttgagattgaacagtattatgactatacaaatttcagtatatgtctcaggaaaaaatcactgaactaagaaacagaaatatcggtattatacttattgcaataagggttttcaaggaacaacatttaggacaaagattttatcaaaatcacaaaactaaccatatgtagtagccaatcacagcttataaaactaaaatgcaactcaatggctgctcaaaaatgcctgagaattcctaagaatgctgaaaatgtcgcaactctaaggggaagggtttgcagtgcggcaagcccggctacttcccattctacctgagtgatctgagccactctctccagctccccacagtgcagatctgagtgagaggctcttgtactgggtattgtctgaagtctaaaggcagaacccctcccttgtggtctgctttatattcacacactgacgtgtcaaacacttgacgaactcagtcattcatggctgccttttttgatctgtccttaatggggaaaaaagagttaactgaactggattgaattagcttggtgaaaaataaaatgtctctatttatt

SEQ ID NO: 5360 - DNA, 770 bp, Homo sapiens
gtctttctggccctatctctcaacatctctatctctgagtctgtaactgtctctctggttctcctgtctgagtaggtgtttctctccgcaaccccgcgtttgtctctgtgtgctctgttccgtctctgtctctctcttttgtctctttgtgtctgtcaccatctctctgcctctcagttgctgtctgcttctctgtctctcaggaggccttggcatctctgggacggggtttggaatctcggttcccacttactcgctgggtgaccttggccaaacacttcccctctctgagccgtttcctccttagtgggagtgaagagacgcacccggggcagggactggcactcggcaggcggccaggaacgattcctctccctcccctcttccatctctgccactccacgtgcctcatcagctgtgggtctaaaggggctgggggtggggtgagggtggggagcgctccactgattgtgtctctgcactcgttgggggccctgcccccagccggggcccgcggggcaccggggtgggtgctcggaaaatcctaggtgcacagagagaaagagacatggagacaggcgcagagatcttgagagaaagagagatagcaagagacacggacaccaggccagagtcagcgcgaccgaggccggtgctgcaggagcggggagcagtttggcttccccccgacttcccctcccacctcgaggaggggttgatgggtggggaacaggctaggcgggttgggggcatgactcaggctggagatg

SEQ ID NO: 5361 - DNA, 2363 bp, Homo sapiens
acataatcaaattttatttgacacataaaatgtttaagtgatgtgttttatactttgaaaataaattcatgcaccaatgttttaactcacatatatcatacagtgcaggatttatgaacatacataaaatcaaaatcataccatataaacgtttacaaataagtttttcatgacacacggacactattgctctttaaatatggttgtacatgtcatcattaatcgattcattgttcttccacatggttatttcaatgcaagatccgatcagcatgaagagtctagtacaagatagggactgcatagggactctactgcgggcccaacaacctattagtggattgatgtaaggcattagtaaattggcatataaaaatagcttaatgagtgatctaatccatttagaatgctgaagcacttctgtggtaaatgttagtctattctacaattgaaaatgcctcattttaccttttctctaaactgacaaatgcaagtagccagtaactgtaggtctagaattttcgttcactgaccagaaggactaataggcgtctatgtgctcagaaccaccagtcccgcaccaactctcctttcagtgagcactgtcagccacatcctgtagtcactggtcagctacatggaaagtgtgactgaggggcttacggatggcttctggtaaagattgtccaagtcatattccgtcatacaaccaactccaaggaactctaactcactttataattttgatttaccagctattccttgggtttacaatttgttctgcagataatttttttataatctggacttgacctatatagttcgcctgaagcaatcaaatgaagtcacctcaactccactcagggtggtacaccaaggtgcagccttgggttaccctcatttatcttaagatttaacgagataagtcagctcattctcatagaccttcctgagcctttttccccttccattttgtagtagaagtttgtttaacttgaattctattttggattttgtgggtttggcatgaaacacaatgaaaacccataattctaccctgtcccgaacttcaattcctttgctgctcaccttcccataagcaggtaaccgatgtctttcatttaggaagccttggcgtgaacacaggacaagggtgacacactgaatctgctaagggtcctgcagccctcctcagctttgaggttttagcaccatatggagaaaggagaaattggtgggaggtgagacagcagcccacacaactggaaactttcaaaggcacttaatggatataaaactctgcaaatgaaacatttaaaaattaagtttctcaactcctttatacatggctcatttggttttgaaagctaaactggagaacagaggctagcgatatttctagtacttcggtgcatctaacttaggctgtcttgttcaacttatttgtaaaaatgaacattcttgaagtatatagaaacaatagcaaaacatctttgtaaaagttttgatgcaaattaaaagctacatattggttagggtaaccgaggcttcaaaattcgtcagcgggctacattatcagataggatttctttgtcaatgtagttagtatgtatactgtttagtctcaggaacagaggcaagcagtctttaacattttaaaacttgaccttccttcgtggcatcacggttttggagagtccagattatgggagcagttgtgtaacttctgcagcgttttgagcttgtgcatccggggcagcatggtaggcatttcccaacggctggtggcaaggaggcacctcagcatggcctctgcagttgctggctggtagcagcagcagcaataacataagaggcttctggcattttacagacatcgccacacaaatacactgaaaaggcagatcaaacagtcattttgcatagctggacatcatacttgtgtcaagtggcaaaaaacaatcttgccaagtgctcaaaagtcaagctcgggtgatgtattgaacattttgacttcaaaaggtaaaccagggatcttgccaccaaattaagatctattgcttttcttaaaaggtctgtttttttcagttgagttctgtttggttctttcagcagtttgaatgtctgtgctaaatgttggtccgtgaggacttctggcactttgatatcacactctctcctgttactattgaaaaggtttatcacctccacttgagtcagagagcccttttgagtgtttagcacagaaccagggatcacagcatgctcccatgcctacaaaggcctgcaagccctgcacggttaaggccacttcttttttatattaaaacaagtctgtatcccctgcattggggtgaccaatt

SEQ ID NO: 5362 - DNA, 658 bp, Homo sapiens
gcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctgtcggcttcctttcccttttcctccctccgcccctctcccttggctcgtaccaaagcgcagaggaggagagggaggaaggaaccattaacgtcaagcaaagttagaaacggaaaaggaaagggtaaaagagaagaccgaataaaaatctctgctttccttt

SEQ ID NO: 5363 - DNA, 924 bp, Homo sapiens
ctcttccatagctcagtttttccaaacttactgttttcctgcaccctggccacgaagcctgtgagaggtatctgtggagtcaactgaggcatagggggagggggtggagcaatagaaactggtagcaacaacacagtatgggggaagtaaaacagataaaggaaagaaaaggaaacaaacaaaaagcagaagtcagttacaaggaccacaaacataagtatgcaaagaacagtttgcaaatgaaacaaaacaaaacaaaaaacaaaacaaaaacctgcagaaccttggagtacatttcccacaagcaaacctaaaggccaagttgtgcttagccaattaattaattttataaaagaacaaatatacttaattcaatcctaatgttacattgtttggggaggatttaaatttaccatcacattcactttagtaaaataaaattttcaaattctaaggaaagacttctaaaataggtaacaatgaaatacctacataggtttccagaatattgtgtctttgccatagctataacaggtttgtctagctttaaggtaatgttgtaaattaggacccaaataaataaaacaaatatataatagctatttatttcatatatcaataaaaatattaatcacaggtttcctttaaagacagttcttattatatatctaaattcacacacagctctccaggaaaaactcttgtttgtaaaacaaggttgttatttttttaagttggcaattttatgtttaaaaatatcagtcctaaatttacaagggaatatatcatgttaatcagtcagagtttcatgggatatctcaaaagtgaccttttcatcactgttctgaaaaaggaaacctgatctccaataagttaaaatacgtagttctttgcattaaagtaatttttaacaactcattggat

SEQ ID NO: 5364 - DNA, 8372 bp, Homo sapiens
agggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtgggctctgcgggacgtgggcgagaggttaccagggaaagaatggacattgacggcagagagcaagtttagcctggagaggaggaattgagtgagcaaagggggtagtctggggtgcgatgcacagaaaggcccgtccagggtaaccttcacgtctccgtatccgttgctgtcgactttccagagcctttgttcccagtgacgtccctattgcaatggagggacacacttcactttccccagccccccacctcgagaatttctctcaccctcccaccctgcggggccgcagagcttgctcctcacggcaggagttggagccctgacgcttgccttcacctagtttttgtttggtttggtttggcgttgatgggacaaagtcagccaaactactttgccatcagcagagaaggaaagctttgaggctctgcttggcaatgtatacaagacaccctccagagggatggcagctgtagtaacgtacaggaaaggggtcctgatccagaccccatgaaagtgttcttggatctcacgcaagaaagaatttagagcaaatccacagtgcaaagcaaaagtactgcccagtaggaacaggaggcagcaaagacctaacaaaagtggaccatatacatagtagcagccatcggtgtccataagccgtgatatcaaagagctggagttttcccacttcttttccgagcactgcctgaaccagaaactcagatgtgacattaccagtaatgagtggtgaagcttcaagaaagctttctgaactttccttttccatccattgtgctagagagaaaactgaattatattttcaatctctctagagaaaatgttacaaaatttttcatatgaggagataatcaaagtgtacaacccaaaaatgtagaaaacaattgttacagaggtgaaaggcagttaattaataacttatttttctggattttgtgatgtttgtgctattcatgtgctttttaaaaaacgttgtattttgcgatttcctcattttcatagctaattttgcattcataatttcatgttctttttcttaaacaaggcctacccatctagctctggtctgtccaacacaagctgatctctggctcccatttgggctgttacgtattgaaggctaacctttctgggacagacgcagaaggcacatctcatctttatgaggtccaagttaattaaatcaattgatcataaatgtaaaggtttatatctgaactctcaagtctctttcattgatctgtgccaattcctgtgccaatatcacactttctcaattcctgtggctttatagtaaattttgaaatcaaatgtgtaagtccatcagtgtcagtctttttattcagaattattttggctactctatgtcttctgcatttccccataaattctagaatcagcaagtcaatttctataaaaattcctattgggattttgatagagattgaatggaatttgtagatccatttggagatatctgccatcttgaccatatttagctttcaatcaataaatacaaaatacatctccaggtatttagatatcttttgatatctctcagcaatattttatagttttcagtgtacaggccttacccttcttttgtaaaatttatttctaaaagcattatacttttttgatgctgtgaatcaataatttttttcttaattttatttgtagaatattcataagaataaaattttcttaattttatttgtagaatgttcattgctggtatacagaaatataactgtttttgcataccgatcttgtatcctacaactttgtaaaactcagttaatctatttgcttttttgtagacttctgattctctacataaatagtcatgtcatctgcaagtaatgagttttacttcatttcccatccagatacctttcgttttcttaccttattgcaatggctataatctcaatgacaatgttaaataaaaatagtaagaatgaatatccttttcctattctcaacctcagaagcaaagcactctgtttttcaccattatagatgatgttagctttgagttttttgaagataccctttatcaatcaagctaaagaaatttcttttctttctagtttgttgagagtttttatcatgaatgaggattggattttgtcaaaaacatttctaaatcatgtgggtttttgttttattgtattaacatattacattaatcactttcagatattaaatcaaccttgcattctaacatgtgtttttttctttttcctttttttggaggcagagtctcactttgtcacccatcctggagtacagtggtgcaatttcagctcactgcaatctccgcctcctgggttcaagcaattctcccgcctcagcctcctgagtagctgggattacaggcgtgctccaccatgcttggctaatttttgtatttttagtagagatgaggtttcaccattttggcctggctggtcttgaattcctgacctcaagtgatccacccacctcagcctcccaaagtgctaggattacaggcataagccaccacatccagctcctaacatgtgtttttaatggctatacctagtctttcctcatttttatcctactataactaatttttatgagcaaatacagagctacatcaactggggatcctccaaaattgacagtaagaaacatgctgttgcatttgcaggcatgcccagggtccagataagtatgcataaatattgtgttgccatagtgattaagggcattcttcccaagatgatttgacaacagcaaatcttttataagtaccttctctagaagtatttggcaatgatcctaccacttctctgaatattcagtagaagtacagatgaagtaggatggtctagtaattaaaagtatgatctctgcagacaggcaggctccccagttcaaattctggctctagcatctacttgctgtgtgactgtgggtaagttaaactctttgagccttagatttctcatctgtaaaatccctctttggtaaaatgggataataaaagctaccccaaagggttaatgggaagattgccagtaaatgttaagtagaacatacagttcagtacctggcatgcagagctcaacaaacagtagaaattacgactaagacagcttcaacaatcccctcagcttgactaaacttcagacaggtttctttgtgagcataggccccttttcttagatcatttactttagaaaacttgcaattataatttctttctctatccctttgtgaagtaaatcttctacaacccaggagcatctttctccaaagcctaagaaccatgccttagaaatgtaatcaccaagaaaaattgcacctttatttctttgtatctgtgggaaaggagaagcctaacttcagtaggtgccaattagcaaacacagatagcctgatcccatttaccgatctcacctctagtgtctttcagtacttactaactcacctcaatgcttaaaattctcctgtctgtttcagtgtgattgagttcaatttctcctccattgtgatagtcttgatctcttttgcaattgtcttgaataaagtcttccttgcctaacttgtccagtgtaacttttcttacattataatggttattatacggagaaagaagcatgggttctcctggttgtttcagctgtataactttagtcaatatccactggagagaatttcaataaaagaaaactatttctttatgggttaaaagggatgggcatggggggcaaaataagaagcactgtggttcaattacagcgttctcatttcttctgaaatcctctagttgagtattgtaatttaaatggaacaacttatctccctaaaagactgattttgaaagactatttccctttccctgttaactgctcccaacccaacagccatcatcatttttaaaggaattctaagggcaaagaaactaagaatctaagagaatgtaatacaattgatgacccaaagaaaagcagcacatattaaattgtgacttaaatgctattcaaaacataaaatcgtgccattgtagtatgtgtttgcctgtgtgtctgtgcctttatttctcaatgatgaattatatttcaatgaaaaagaataatgccttccaagtaatagtatcgttatataagagacaattatgccactaaatttagataatttagaaatagtcttaaggagagaaacaaaaattaaaaagtattgaaatacaaagtaaggaactgagattattgtttttctcaatgaagataatatttacttttgctttaagatctagatatgacaaatgttttctggttaacaatttatccaaaaagaaaaaagaatgtcaaccttttttttttctctattccagagagctccagaaggtttttagatttaaaaaagaaaacaaaaaacaataataatactcaaatgtcatattggaagccttaggcaagagctgttggtcttttaatttgctcttaatactatgatcaaataaaaagaaggaaaattttacaaatcattaacagcttcgaggatgagggaagaacagattttcaagcattcttctttatttagtcagaaatgactggctcaacctcagcctacttctctgaggcacattcctaccaactcttgcatattaaattttgccagagcaatgggcctgacatggccttttgaatcacagtgaatcacagtgacccttatccaactgaatgtctcctccaatcatgtttaatgtacatcaagcattctacagtgccaagatgaagacctgcattgtttttttaaaacccacattaccttgtcattgtgtaagagaaagatatatttaggattgaagggtgcttcttattagacccattcaggaagaaagtaagtctagaggagccaagctcaaaacatactcttcaccatacacaatcaaattcctctcagaaataatgttcttcttctccatctatattttggaaaattacatgaaaatcagtagatacttgtaatgcaatcagtgctgaattattactcaacaagctgagtcttcgagggcaccagcaaaacagcaggaatgactaagaaaagtttaactttgatgaatttatgtagcgtcttgaaataaaatgtaaaaatgaagccattttcatttcagtattcagagttttataacattttgaaaaagtaaattttcttttgaagattttataaattacacatggggttgttattacaatctcttcagtgttcaaggtttctaaaattctcaattcagccctggatacaaaaactctaaacacagagggttaaggtattaaagatgaaagctagtacccttacaactatttatattgcaaaagctttgccctcctgcaagaacatgcagtttcccaaacagtaacctctctttacaaggttatgcttattagctgggattcgaagctcaatagcaacactgttcatccatggttcaattcagattgtaatttctttttaaactacctgacccttataatcatatggtgagttggtctgatcattcatcttctcgaggccaagtacttggtctgaacacagagtcacttgtgtttctgaagcctctctgcatcaagatgattggggtgaaaaactgtcaattgaaaaaagtttgaaagaaaccttttatacaatgttttcattgtcttgttctttttctggaaccacaatttctgattgggaaaacaaaagtcttcctagatacaagaatgaggttttaagagataatctttgtttctaattaagtgtggaagctatcaactatcgcattgtccccaatgtcagaatgtgctgaataagattttgctttttctcagggcccagcatttattaagcactcagcaaatgcttactaaatgaatgaatgactctacccaagcttgtgtctttgtctcgaagctgtatcttccatcacagtattaaaatgttttttatgaacatgagcatctggctgcacatacagagcagcacattccacacactgccctaattggatcaccaattggaggaaagtaagtcacaagctgattgcctagagtgggtttttccccatctctgaaccaatctctgaggcaaaaagaatgctattaggctgactgatttatgtaaagcagtgcctatcatttctgcagttaggatggagtcaattccatccaaagccaatagaagagagacagtactctaaaagaaggcctaggagccatgaataactgccgagggtaccatagacactgggttggacaagcaagaaatagtgacgatgtgacttctatttttatgatggctcagcggaaaattagtaaatacaaccagtgtgttagaaataattccgtatctcctaagatacattggttaaaaagatactaataagtttttgtgcgtgtaacatttgacaccaggcttttaagtaaaacaccctaagatggaacttactgtgtagtggaaagagttagactcactagacattgattagctgactgacatagagcgtttcttatcagtcaacaaaactatttccagagaggcttgaaataaaacagttgactttatgtagattatggttaatatcttttgcagattttctaagaaatctttccctatcagaggtccccaaaacattcctttatcattttccttctaaatcttttatacatgcttaagaaatatgcacatgctctaaattgggggaacatgatcctttatgtattaattgaatcaactttggttaccatgttgttctatttacttttttgctgctcgagctaaaaattgagtgacttcaaatacaacataatagtttttttttccgttttgccctctacatttttactttaataactttgtttagaactgttatacctacttcagttgaaatttttattatttttgagagtctccttatccttattaatgcttttcactttaatatttgtaaggctaatactgatacagctatcctaaccaggtatatttgcttgttttattttccctaattctactttttgtctttctctgtccttgtactgtcttttgtaaactgtatatattgaacaaggtagacttttttttttattaatctggtgagataggcaatttatatttattgtaaccatttattatatactatgccatttctttgctttttctatgctttttcttccttcttgcatttttgtggtctatcaaagttgggatttctaaagtgtttttcccttatttcagaatgtttcctctctactggtttgaaagttatattgtattgctattctttaaaggttatctgaaaattttctgttaagtacttagattaacaacatctaaagtcattcattatcttaacttccatcctaaagagtatcaggatcttggagcactcacactaacttctaagtgctcccggacactttccccacatatacatttcctgagttatgtaaaatgttgctagtattttaattacgctcttttttactccacagagtaaatacttcttaatatagacagtatttatttacatttcccatgattactgattttttagctcaccataccttcttgcatctcagactttcctcctagtcattttgctgtactctaaaattcatctttattcttaagtgaaagtcccttgtttgtaaattctcattttgagaaaaaagtgtttttaatatacccttgattttgaaagataatttcactgggcactcattctattgagttattctctcagtaccttaatgatgttattccactgtcttttgccttccagttttggcactgaaaagtctactgttggccaggtgcagtggctcatgcctctaatcccagcattttgggaggccaaggcaggtagatcacctgaagtcaggagttcgagaacagcctggccaacatggcaaaatcacgtctttactaaaaatacaaaaaaattagccaggttgtggtggcgcacacctgtactcccagctactcgggaggctgaggcaggagaatcaattgaacccgggaaatggaggttgcagtgagcagaaatcacaccactgcact

SEQ ID NO: 5365 - DNA, 324 bp, Homo sapiens
aaagtttgaaaaaataattataaagtttatttaaatgttgattgtcccaaggtctacagtttcttttctgttgtgtcatcagtgacaaagagtaaaaaaaggaaactcccatatttagcactttagagtaaaacacatggatcatcgttattaacagtcctctgggcgctggaatttctggtgtttgtttaataagcaaaggaagtcattttgcttactgaacctggggacatactactccccagcactgcctaagtttctggaaaaaaaaagttttaaaataaaaagagtcctgtaaaatagagagactttattttaaaacaa

SEQ ID NO: 5366 - DNA, 487 bp, Homo sapiens
ttcattttagaatgttatcttggtatgtttaaaaggaaaaacttaagatgtgttgcaattgcagtatgagtttcaggtatgtacatgttatgtgtgtgtgtgagagacacacacaaacacatttcaaatatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctga

SEQ ID NO: 5367 - DNA, 3778 bp, Homo sapiens
ctctaaacaatgtgtggagcgcgcagctcctgcaccagggcctggtggcttgtcctgcccgcccgtgggggccgtgtgatctgttttcggtaggattgctttggaaaggaattgccgaatatagatagtcaaatgtccgcagcttctgcatagtttagaagaggctgaaaacggcagaaagaaggcaaacgtggtttgggaattagtacatatacctgttttccaattctcagtagcataggaaacggacttttcatggcccaagttatcctcacgacttgtcagttgattggctttggaacctctgaaccgtccctagatggtattgacgcttcacaactgtgtgtaaaggttttcaatggaagggtcatgcaaatatcccgtagggtagtgaaggaggaaaatttcataaatgaagggcagtaattatttgtaatctgaagatctcacaaagcggcttagtgataaacattatcccgaaacagatacatggaaatcagatacgagggaagaaatggatttgtccaaggtcacttaagtgaggaagagacctaggagaaacaaacagacaaaaatccaggcctcccgtttcattattatttcatgaatgttaagtgtccatggttgctgtgcagaacacatgcaatctctaatcctatcctaaaagcacatatgcaatcagcttggaccgagctgccagcaaagaatttcctataattcaagccaagatgagttattttgcttgttttttgttttgttttcaggaaaccgaaatatttattgttggatttatccaggaaggctgttctgcattagttaaatgcatcatatcttcaagaaatgttaaatgacatgggtaatgttttctttgtatgctggatttttcaatagcttctacttcttggctttaaaaaatatttctaaccaagggtcagaccattttaggtagagtaattatgatcttagatgatttgaactaactcagctgtctgtccatttgtgaaatgggaataataatatttatctctatgaagttaggccacaaattctttctagtaggttcaagtatttaagcacctggagaggtgactggttaccctcctagtggcttcaggaagttttctcactgaatgaatatttattgagtgccaactctgctcagcacaattcaggggtgctgggaatgcagcagtgaataacacaagcagtgttcctgccctcatggggcttatgatctctggaagcactgctttgcacagggaagtagcaccaggagggggtaaagaaagagggactttggagccccaagattggcaaaaactatagctaatgagagaggtgaactgtagagtctagataatggggaaggagaggtgccagagcaagaagggattctcacagggccctacgggtcagtcctgaattggctttactagaactcaggcccagcacaatggctcacatctgtaatcccagcgctttgggaggccgaggtgggtggatcacttgagatcaggagtttgagaccaacctggccaacctggagaaaccctgtctctactaaaaataaaaattagccgtcatggtggcacacgtctgtaatcctagctacttgggaggctgaagtgggaggattgcttgaatttgggaggtggaggttgcagtgagccgaaattttgccactgcacttcagcctgggcaacagtaagactccatctcagaaaaaaaaaaaaatagaattcttgggctaataatggcctcaacatttgcagttaaaaaagaaatggggaggatgggagcaaaaggttttaagttaaaatattttccttagaatagagtacttatggccatgaatttagatttgtttataagtagaaaagtagaatggaaaggattttaaaagcaacgctattcatatctgcttggctcctgtcaatcaactgcaaagattactgcctcatggagatgcttctggtcactgtaatgctatctccatgcacactttatcacattgatttcacatcacctttttatcacattgatttacatctatcatttgttcacttgcttattgtccagttcctccccaaagaatataacctctgaggtaatggtggtcttgtctgttttttctcctgtccctgatcatttgctgtacctttttattaggtgatctcatccagttacatggaaattatcatgtagaaaaatagaataaaacaatgaaccccttgtacccatctttagaaattactgactcatgaccaatattgggttccctctatactctactcacttctacctcaccgatttgaattattttgaagcaaatcccagcctgcattatttcatctgtagataatttagtatgtatcataggagtcaaatagatgattgatgtgccccttaaatctcttataatctacagattctttctctgtatttgtactttgttgaaaaatatggattggccaggcgtggtggctcacacttgtaatcccagcactttgggaggctgaggtgggctgatcacttgaggtcaggagttggagaccaccttggccaacatggcgaaaccctatctctactaaaaatacaaaaattagccaggcgtggtggctcacgcctgtagtcccagctacttgggaggctgaggtaggagaattgcttgaaccccaggaggcggaggttgcagtgagcagagactgcgccactgcactccagtctgggcgacagagcaagactccgtctcaaacaaaagaaaaatatggatcatttatcctgaggctttggatccacactgtctaaaactgtcctttccctcagtcttgtccagtaaatagcactaccatttactcaactcaaaccaaaaagtacagacagcctccttgagcctctttttctttcaccccgatagccagtctattggtcttgctctgaaatgcttatcagaatgacctactcctcttctcatctcttacctgcccttcaacagtaactttctgtatgacctttctctttccactcctgcacctctgtattttatttgctaccaagcagacacagattagattatagaatataaatcagattaggttgcattcttgcttaatccattcagtggcctcccactgctcttggttaaattccacatgtgtgggccctggcattacccctctttcccctccgcactgtgctgcagactagccacccctggtccatcaagtcctcctctgccttaggatcattgcatctgttctttctgaagcttgaattctcttccaccagcttttgataggactgtctcaccatcttctaaggcaaactttctaacctttcccatgtcattttcttcttagaaaatgatcatatttggccaggtgcagtggctcacacctctaatccctgcactttgggaggccgaggttggtgaatcacctgaggtcaggagttcgagaccaacctggccaatataatgaaaccccgtctctactaaaaatataaaaaattagccaggcatggtcgtgggcacttgtaatcccagctacttgggaggcctgaggcaggagaatcacttgaacccgggaggtggaggttgcagtgagctgagatcacaccactgcactccagcctgggcaacaagagcgaaactccatgtcaaaaaaaaaaagaagaaaatgatcatatttgtaagttgcaccgaggattagtggagggtatttggagccactcatatggaacttgatttttaaatttgggcttggcatggtagctcaag

SEQ ID NO: 5368 - DNA, 2824 bp, Homo sapiens
gtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaa

SEQ ID NO: 5369 - DNA, 2822 bp, Homo sapiens
gtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatg

SEQ ID NO: 5370 - DNA, 9619 bp, Homo sapiens
accgcgccgggccgctgaggctgctgggtggaaaccgccgccgcgggcccgggactgtgagttcgagccctggcgagcccgccctaccccaccctccccgcagcaggcccctccgagacgccgtttgggagcgctttcccccatgtgcctcccgccgctttgggtcaggggctgcaagctgcttgcccagcccctgtgcttgctccatcacggtgaacctgcaaaggtgtgtttcagaggcttttggccccagactttattctggccgcctggaaagcggaggccgtgtctcctgagtttctatggcccagcgcggggtggaggtggggcgcgcatacacagggacatgtctgggagagggatatgcgtcctcttcctgggacccctctccccctggacgctcccataaccgaactgccaacccagcccagcccagtccagcccatgttgggttcctaagtcccggaagctgggcacaggccccaactcggttcccatggacactattgcgtccatatgcagtgccaggcgctttacacacattatctcacttatttcacacgtccttgagaacaggcactgttcacggcagatatttattgcacggccacccccacgctgccacgcctcgctctcagatgaggaaaccggggggatggggggtggatggaggcaagaatggcgctgggatctggccaccgtctcagcagcgcccccgtggccgccgcaccctcaggcctggaggcagagccggcgccggagcgagctgcggatctccaggcaggccttgcggagttcatcgcagtcggggcccagcacctcctgctcgcacacccgcctgttgacctgaggaccacacccagcctgcgcccggggttacagccctccggggctcagcctgccccaggggagagcccctggcttggtacattgcaaggcctaaaatttcaaggactgcctggacatctttgaggctcgcagagctccagaggcctaacggtgaattcctctgctctggccagacatgtccccacccagcaggacaggctcccaccccctaggtcccctctcagcagaccagctgcaccccacctggtcgtcaccctaatggacttcagccccctgacaggccttggaaatattcaaaccaaccaaccacatctgcccgtgggaaccagggggcatctcactctcttgtcactacaaagccagcttcccactggccctgcaggttcaccctgctctgagcacaagcccaggtggccccgcatgacatgcagtgtcctcctccccacccgactgcagtacgtgtgactaagaactgcagtggatggcatctgtgcagcgtcggccatcctgcgtttggttatcttgtagtattgagggcagaggatccctccttcgccaatggagttcataggaggtgatcagaataccagggctggggagaagggcaaacccagctccttgccacttgtcaccctggaaccccccaacacacctcagtcagcagctccagaaggtctctcccggggttggctctgaggacctccaccagtgtctggataaagtctgagcccttgtcatcgcgataggccacatagcctaggtcaggggatcagggccagagcatcagaccaaggccccaaccctctgccttccaatcccaggggtcctattgttggtggaaagtggggtacaaggaggcaggacccaggaatcaggcaagagaacagggcagggagcagggacttcttgcatctggaacaagttgttgctaggtatttgcagaggtgagcctatggagagattcactactgaacaaacatttactgtgcacctactatgtgccagacactgagcagggccttggggcaggcaggtctaccctggcctcgtggaactcacagcctagaggaaacctgcacacacagtggttggcacagctgcgcctcacagcactcaccatcactgctgttactacacatcctaacccatgtagggaacatggctggaccacagctgggctggcatctctgtgccccaaccctaagccctagctgcccctaaggctactccagatcttaggccaggaagctgggccctgtgtaaccacaggctcccgatgacccatctccttaccctctgcggctgagtagaccgtcaggatgtctgcttggtcagagctccctggaggggtgcccctgcaggagctgcctgcaagaggaatcaattccagtgatcaacatcgtggaactccatcagccccgggagctccccatctgtggcttaagggcagcccagggaggtggaaagagtgcagggcaggaatgacagacggaagttcaaagctcggcccagccacttaacagctgtgacctcagaaaagctatttgaccttaccgactccagggttcttgccaggctccaacaggggaagaagctcccacttcccaaaggcccttgcggtttaggaagattttttttcttcccattgtcttggcaaacagaggatgcaggtggcagccataccccagcttagagccctggagatgctctctggacggtccccacaaccagccctgcccaagcccaggccctggaaggaaggcagaacccaccttgggcctcagcgtagatctgcaggacatctgcatgggaggggacagatggaggtgcccgcagccagctccagtaccaggggagagctgtgggccccacaccagcatccctgtttcctgaagagggtggggagaggcagatagtctcactccggggatacctgggggtgctcaggggtctagtgtgaatgtggggtcaaggtgagaacccaactccagagctccagggcaggcttgccagactggagacattcagagcgctgaatgacaggtgttgagagttaagggttcaaggtcgtggacttgacctctaggagaggacaggagagggggcagggaagggcaggtacccgggctccctggagaaggtagacagtgagtcccgggggctgaagcttggccgaggaaagtgagggcagtaggaggccgggccgctcacccccacggcaggcctgcaacaggaagatcttggggcggccctgcagcacctggcagcggctcagctcctgcatgagtgcctcgggctgcacctcttgcccgtcagcccccagcagctgaccccgtggtcccccatgggccatcagggccacaagggcacagctcacagggcccctgcaggtgtccagttgctcccggaactgggccagctcctcctggaaagcctggggtgggaacaatgttgaggcctgggccaaagccaccgcctccccagccactggctgccctctgtgaggctgacaaggtttcccagaccctgccccacctggcctcccaccgcctgccactcacaggtccagggaggaagccctctttttttttttttttttttttgggaaggagtcttgctctgtcacccaggctggagtgcagtggcgcgatctcggctcactgctatctctgcctcctgggttcaagcgattctcctgcctcagcctcctgagtagctgggaatacaggtacatgccaccacacccggctaattttttgtatttttagtagagatgaggtttcgctgtgttagccagaatggtctcgatctcctgacgtcgtgatccgcttgtctcggcctcccaaagtgctgggattacaggcgtgagccactgtgcccggcctgtttttgttttttgagacagagtcttgctctgtcgcccaggctggagtgcagtggcacaatctcagctcactgcaacctcggcctcctgggttcaagccattctcctgcctcagcctcccaagtagctgggattacaggcacgcaccaccatgccctactaattttgtctatatagtagagacgaggtttcaccatggtagtcaggctggtctcaaactcctaatctcaagtgatccacccgtctcagcctcctaaagcgttgggattacaggcgtgagccactgcacccggccagaagcccttttctaactccctcctgcaaggccttggcatggcctctttagaggtgacatagagacccagcttcctggagccagttctcctcctgccctcgtggggaagccgcaccaagaagttgagaggtgtgaggagagtggagtgggctgctgggagccaagagggaaaccaagacttggagctaaagctttgagctggggagggggcgggggggccagagaaccagccagtgaggaaggcctcggggaccctggagaccaggcttccagaggcagggaagtgacgggccagatgcaggcaacagggagcacagaggttagacttgtggtgcacttcctgccagtgatggagagaggccccaggtttctagggaggggtggtcttccttcagagcaccagtggaagttctcggcttcccctcacctgggctgtagggtccgttctcacggtggtctcaaagcccagggcccagcacaggccccccagcgcctccacgtcatgctgggccccaggccggccttggatcacagccaggaggagggcagccctggccttggacaggtcatactgtgtgctgggaccgggggccggctgcagagagggttaagacacatctaaagtggcctgagaggactccagctcctggcctccccggccggggccccccctaagcttctgtcccactggaaactgtggccatgtgattggatccctgccctgcccccctcacctcaggcctccagggctccacgcctcccaggcacagtgcccccctcaaggagctccgaaggacggggcagcaggtgccccctgcggactcttcagccaccctgcggaagagctggggatggggccgagaaaagactcagccaggcttgtggcttctatagtctcttcagggtcacctgccagaatgcagacaggaggaggccagcaaaggacagacaggcaggatggcctcaagcagggcccaggctccagttcaggctcaaggttatggacttccctgggcatggatggcctcgagtggacagtggccacaccattaacccctgccccgggatcagtgcgcagagaggtggggatgttccctagagcggggctgggcctgtcgggaagactcacggggtgggcactaccctgctgggcgatctgtggaggagagctggggccccctcatccccagggctgcccaggggccacccaactacacagtgagaccttcagccttggagaccagacttgaagcattcccagtcccagcctccagggtcctgcgatctaacagggcggacagccactgcttggtgtagaaaggggcagcctgaagtgcaagcgtggatgcaaggaagggcatcgctggcagcctgcagaggactgtgcagggctcccgggacaacaggaaggcatagcaggcagagggaactgcttgggccaaggcatggagctgggaggagtcgagtgtcggggatcctgagtgggttgtcaggggtcccgagttgagggtgaggggctgagaccacttctgtagaaaataaaggaggtttgtagaatgaatcggagggaggatacaagtgaatgaatctaactgtaactggcttaggggggcacagcagaaccagcggagacagcaggaccagccccgcttccctgggcctccccctccagcgtccccaccttcgtcagcagctgcaccagggaccagtgaggagagcggccacacagctctctcaggccagcaaggaaggctccgggctccagggaggctgggtagagaagcagcatgttggcctgcagtgaggcccgaggctctgcccctgggtccctgcccagctcctggatcctgacccagctcactcacacccaggaccacttgagagcagcaggaagactttggggcagccccgcagggcccggcagccgctcagctcccggaccagctgctgtggctgcctcagctgccctctgggggcatcaaggccactaaggcacaccccacagggcgcccgtgggcatccagctgctcctggaaccaagccagttcctcgaggaagccctaggggcaagagtgagaccgacctgagtccggggaggttttgggtggggaggagattctgggtcaggggagagtggggaaggggtcggtgctgggcctgagggtggatgtaagaggcagaggctcacctggaccgggacctccctcctctcgcagctctcaaagcccagggcctggaacacgtcctccagggcagtgactacagcggccgccaccccagggctgctgagcatcagggctgcccttggaccctggacgtcatacttcccctggggaggcaaggccagagctgggctgggctgggctgggctggggctcagcagggaggcaggagcagctgggctaggcggtgcctcctgctacctttctccccaggctgtctcgagtgtctgccatctgcgtggccagccgcagggtcccagccaccaggaaggccatagggcgagacggggcttcctccaagcaccaagctcggagctcacctcctggccctgggctctcagtgccctgggtcctaacccttgccctctaccctaacgagtactatcagctctgcttatgagctgagctggactctgccccatccctggaaccctgggtcctggccccgctctcccagcctgggcttcattctctggctcctgctggtgacttctttgctggcactgacatgcccctacccgagccaggaacctgtgctcaatcctattcttagctcctggcctacgtgcttatctgatctcgttacacccgagtgtctccatttggagccagccaccgccaccaagaagtccttgtaccatcccggccacccgccacacgcatgcacacagcaccaggcccccagaggtaaaaatcaccaactggaatcagccttgtccacagcgagaccttgcttgcttcttacgggaaacggagaccatgacagtgaccgcaggatgatgtgtgcatggaaggttggctaagaaaggcctaggggcagagagggctggcacatgcacacctgttaccaagggaccagagcgtcttgtccaccggcccccgcctcccctcagccaggggccctgaggccactagcaggtgaaagagaaggaaccagcatgggtggaaggaggggtcgtgcctggatgatcactagttttgaccacgcacccaccagcccttggtgggtcccggcctggggctcctggtagggagaagttggatgtcaggggctggtgggaagggcaagcccgctgtcagcccctcctccaagggactcagcctggggcagccttgagttccagatccccaacacgcagcaagagggtcccaccactgaccaagcagcgtctatgggcccttcttcctttcacagttgtgggagaggagtggcctggtgaagaccctgagtcctgctcagctccccgttctgctggagcaccgacggtgctcccagagcagggcaggcactagctgacacagggggacaagagtcccaggggacacggctgcccattggggcccagccgacctggacgccaaggacgcagctccgcctggtcacggtgcagcagcatgtgccaccaggacacaaggccagggcaaggggcatatattccaggtatccccaccctccagctaccgaaagaacagaacagcctggaggtaagttttcacgtttattaatactcttctgttgccctttggaggtctgagggggagtccttgcagggcctctggtctgtccctgttcatggaaggcagtgctcaggaggcagcagcaaagtgccaatgaagcagggcgttagtgccgatggagcagggagccagtaccggtggagctgggcgttggtgccaatggagcgaggcactggtgccggtggagcggggcgttagtgccgatggaatggggcaccagtgccgttggagctggacgtagtgatgatggagcagggtggtagtgccgacggagctggacatagtgatgatggagcggggtggtagtgccgatggagccggacgttagtgacaatggagtgggacaccagtgccgatggagcagggcgttagtgctgatggagtggggcaccaatgtcaaaggagcgggtcattagtgccgctggagttggggcgttagtgccaatggagtggagcattagtgctgatggagtggggcgccgagtggggcattagtgccgatggagcggggccgatggagtggggcgccgagtggagcattagtgccgatggagcagggcgccagtgccgatggagcagggtgccggggccgatggagtgaggtgctagtgctgatggagtgaggtgctagtgctgatggagtgctagtgctgagtctggtgcagccccacctctggaggaaaagatggcagccaggcgccctgttcttggtctccagggttggcctcctgtcgctggagccaccattatcctcaccagattggtgggcaggtggctctcagagcctcatgctagggcaagtaggccgagggcaaaggcaggccgagtccgtatggccaggacagggcagagtggtcatggcctggaaacgggagtgggagggggccagaaagcccctgccgccgtgactaagacccgcggtcccacaggtgtgggctgtctctcccaaagtccagcagccccctggggggccaaggccagtcctccacgcccactgaaaggcacaggttggtagggcagaggcctgacccatggacccaccccacagggtgggggccaaagagccacacagtcaaatgaggctcgggggcttctgggaagggacctagacctgagtccttgccaccctgctgtccctgccaggaatgtgttggggctccaggaaactagaggggaagaggaacgctaggcgcagaagggggaaagaggacaagatcgggggcgggaggggaaggcttccgttccctttgagcgctgggcaggtcctcagagccaagcagggcaggcgagctccgagtgtgaggtaccctggggtccctcggacagcccgggaggtggccacagatggaaggagagtcccagtggtgaacaaagcaggatgtgccgtggctgggcctcccccgggtttccggccaagccagctgctcaccccacgggctgggccatcttggcgtgcaggctctgatgcgcgatgaggtgcgcgcgctgcttgaagctcttgtcgcactctccgcagccgaagggccgctcaccggtgtgcacacgccgatggtccagcaggtaggagcgcagcgagaagctcttgccgcagtcgctgcagccgaaaggcttctcgcccgtgtgtatgcgctggtggtcggccaggtaggcgctgcggctgaagctcttgccgcactcggaacaggagaagggcttctcgcccgtgtgcacgccttggtggcgcaccaggtccgaggagctgcggaagctcttgtcgcactcagggcacttgtgtggcttctcgcccgtgtgcgtgcgctggtgccgcgccaggtccgagccccagcggaagcgctttccacactgcccgca

SEQ ID NO: 5371 - DNA, 4971 bp, Homo sapiens
ctccttggcctggcaggggtggggcctgccagggagtgccttgctgggaagggagggcaaagggccatgtctttcgcttgctccacccagctgccaagagtcccagtcaccaggccaccctaagtcccagcccttgagggtccatgagactggggcagcagcaggggcaggtacagagcacctcagccgcctctccacctgacagcaacatcaaagccgaggccaaggcgggagggcccagagtgagacacctcttccagacaagacttggtcgctgcctcctcctctgtcaccctgcgacacagcccagagtaccaggcggctggagcactgggggacacccggacagaaccctccctggaccaagtcctccaggaacgggatgaagccattgccaagaagcaggcggtggaggcggagctgcagagatgcaaagccaggctacacgccatggaggcccagctgctggaggtcctggaggagaaactgaggctgaggcgggagctggaggcctgggaggaggacgtgcagcagctggtgtggcagcaggtccagaatcagctgcagagagaggccaagggtactcggggagcccacgtggaccctggagctgccagcaccccccgatccagattctccctgggtcggggacgttggtggtgacacagacctcagcccaggactttgggagtagtgtctttattcattaaagcctgaggtctgaccacccctgtaaaacctcgtgcccacacagtgcctgtctgagtccttctgtgcccaaatgtggagcaggctgcagagacttgaagcctggggttttgtgcctcctttttgttttgttttttttgagacagagtcttgctctgttgcctaggctggagtgtagtggtgtgatctcggctcattgcaacctctgcctccagggttcaagtgattctcctgcctcagcctccagagtagctgggattacaggtgtgcaccaccacgccaggctaatttttgtatttttagtagagacagggtttcaccatgttggccaggctggtctccaactcctggcctcaagtcatcctcccgccttagcctcccaaagtgctggaattacaggcatgagccaccacgcccggccatcttcttgccagcaactcttagaccaggaagcctcggatggcagctatgaagtcctgtgggcggtcagcgtggatccagtggccagcgttcggcaccgtctgcatctgggcccgagggaagagccgcataatctcagggtggtggctgggactgtgcatcgcagcgacggccatcaaaaacgggtgaaagtgggatgaggaggagtgaaagagacacgtggaagcagaacggggagaaatggagagagctgtgtgagcccatatgcccggtggtatttctggcctctcagccaccccccttccacacccaaggcctcccctggtagggtccccaggctggggcctgggcgagtaaagcatgcccctcctactacccaggctagcttactgcacgaactgggagtttccaccaaggagaaagagtgttggcccgaggtaggactcctgcctctgtgggaaagccaagatcttgtctaggtgctgggtcagggcatccaagttcaccctccacacgaagcgcccgtctacctctaccaggttagtgagcaggtgctgccgcacggccatgtcctgtgggggtgcagcagttgggggaggttccttgtgcggtctgggggtgccactcttcccttgacaggtcctggtctacaataccatccggggcaccttgggtgtatcacctggatgacagaactgagctgttcatccgccagttttcgggcacgggagcggggcagctcatctgcgatgttgatggccctcatggctgccacataggttgcaaagtgggagacacctgtgctttccactgggctgatatctacagcaatgagacgttccaccagctctggctgtgggagagaaccgaactgggaccagtcttaggcagacatagggagtctcaggcatggctcctggagcctgaacttggtcatccaacgatcatgtgagtcccaggttgcctgcagggccctcagggtatatactgaatgggaggaggccccagacatgggcggctcaccctctgtagtgccagcagcatggctgtctttcctcccatgctgtggccaacgacgacgcagggcaccaggcccagctggggcagaaggtcctgcaggtcctggctcatgatctcgtagctcatgtctgggctgtgggggctgtcaccgtggttacgagcatccaccgtcagcacctggggagtggggtgagacggggctgcgttgatatccccattctgggggtagacagccaaaggcttgtagggacagcaggtcaaaggtgtggagagcctggggatacaccctgtggaggggaagggcccagtttccagacctaggaggcccagatgaagaacctggggccactctgccagagaagagcaggccccagggttgtgaccacgtctctgaagggctggcctggctgggtggcaatctcggagaatgccaggaaggagactccaggaatttccaacagtaggagcacagaagaatgggctgccataagaggtggtgagctcccggtcatccctagtgaacaagcaggccccttcatggaaagggtgcaggcgcctaggcatgggccagccccgatggagatctacaacatgaattaatgaagatggcaacgtgagggaataaatggggttgccgttcagggtccatactcagagtgagggatctggaagtgagcgtgagaagcgggaccccccctgccccgcctcctctcaggccccgcccactcccgcccagccccaaaggagccccgcccactcgaaagctcaccctacggcctgtctgctgggccaagatcttggcgatggagttgaagttagttttgctgccgaagagcccgtgcaaaaagacgacggccgggagggctgcctccccgtccagaagcctgtaggaaagcggaagcggcctggcaggggaaggatcgaggtcagagtctgagccggcggagacggggaaaggggtagggggaaagagctttgggggagaggcctgggaggtgacaggcccaaagggaggagatggggccgtcggggcccggcaggaaaaggaggacagaggatggcctcccgcccggtgcccttgactgacctcggctcggcgccccctcggccgccgctgctgctgctgggtgcgacaggcaccctcgcgaagctagggccgtgggggccgagtccctcacgcgggagcctccaggctcgggtccagcggagcatgcttgcaagctgttggccggctcgcatctcacaagcaacctttcccatgtgggaatggtaatccctgcaggtctgctgccggctgcgcctcccctactactcacccaacactttgagaacactggctccttcctgccttgcttcaacaagcccagatccattagagcctctcactgcacgccaagcaccttcctagacgcagccgtgaacaaaacaacaaattaatctcacaacaaaggattatgtccgagtatttattttcttcggaacaggttaggttggccccagtcatccagagaaggtggggacggtacaggatcaggccagggctctggtatccagaacatctccacaagctctctctgccacctccctgcctcacccgcacctgctgcccaccaagccttcccacggattgtccacagattcccaccagccccacagattctcctgcttccagtcattgctccctctgctccctaacctccaacaggccctgctgacagtaacagttgtcaatttttttttttgagatggagtctcgctctgtcacccaggctggagtgcagtggcacgatcttggctcactgcaacctccacctcccaggttcaagcgattctcctgccttagtcttcagagtagctgggattaccggcacgcaccaccacgcccagctatttttgtatttttagtagagacagggtttcaccgtattggccaggctggtctcgaactcctgacctcaggtgatccacccgcctcggactcccaaagtgctgggattacaggcatgagccactgtgccccactggttgtcaactatttttttctgcctcctgattctgtggaagacccagtgtctcccaggaacagtctcatcacatgtacagattctttcttttttcttttttattgagacagggtctggctgttgttgcccaggctggtctcaaactcctgggctcaaatgatcctcctgcctcggcctctctaagtgctgggattacagatgtgattcttaaagtggcagggtgaggacaccttcctttttggaatgaatggaggatggtgagagagtctgtgtattttgacacccagcaacctctaccccacttgcctgcaggatacagctcagtctcctctgtctgcattttggtgtctttattttatttatttatttatttatatatttatttatttatttttattattattttatgaggcagagtctcgctctgtcccccaggctggagtgcagtggcgcgatctcagctcactgcaagctccgcctcctgggttcacaccattctcctgcctcaacctcccgagtagctgggactacaggtgctcaccaccatgcctggctaatttttttgtatttttagtagagacggggtttcaccatgttagccaggatggtttcgatctcctgaccttgtgatccgcccgcctcggcctcccaaagtgctgggattacaggcataagccactgcgcctggcttttatttatttattttgagatgaagtctcactctgttgcccaagctggagtgcaatggcacgatctcggctcactgcaacttctgcctactgggttccagcaattctcc

SEQ ID NO: 5372 - DNA, 1962 bp, Homo sapiens
gtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccagg

SEQ ID NO: 5373 - DNA, 2993 bp, Homo sapiens
cctctctctaaggggttccccagccctggatctggcctgctccgccttgcgaaggccccacagcttgcttacctcagcaattcacagcggaagtgtgacaaacgttcataggcaaatgtcaggtcagatgtcaacttgttgctccacagcctttcggcaacagcccctgctctgggcctggaggaaaaggggcatgtgccagattgggccctgtattccctgcaaaggtgctggacatccacaggctgctacctcttgtctaggcaccctggactcactcaggccaaaggaagtgatcaataccttgttatgagccacagccaggttggatggctcccagagagttctacggctcagctccaccttcattaaaatgtgggtagcaatcccactctcttcctctctcaaagatatgggaataagaataaaccttaaagccatcattaaccacaatgacagtggcagcagcagaggtccttaaaatgtaaactttgcacacccaaccatacttggtaaggctgcagtgaaaacagcagagggaagccttattacaggaatcatggatgcttgtgctgggtcttgagcaactcacctatgttctccaggcctcattatctctctgggaagtaaggttaacaatccctatcccacataccaaagggcagctggagggatatagacggaagtcatgtggagagtgaatattgcacacaaatcttcagaaggctcgttgcacggcctgctctctctcaggcctgaaagaagggtactagtccagaggtggctagatgggattgggtctctaagggagaactcctgctctcaggcccaaccctccacctcccccccgaaaacccttaccagagcctggggaccaggtttgtgttgtccacatattctccccacatacaagcctctccaccaatcaccagagccttctgctcaggggtacctgagggaaaacaagcaacaacagtctggtgatggtggggtaactccagggtccctctcaaccaccttcccaatgtggccctcaccccagctaagttgtttcatttactaactggaaatgtctggcccagaccttcctgcctcccatcctgtgccccaacccagcctcctttggttagcaaggagagctctctgctttcaccttcaaatgccaggggttccactatgtagaaatccttccagtcagggccataggatatacggttcaggtaccagggggcagagagaagggcccggaagccggccttggtgaccagttccagctccttcatatagttcactggaatatcctctcgccacacctgtatgattgtgtctggctgaatctgttataaaaggtcaaatggcagtaaggacacaaagctgaggagattcctgggccttattcatacacaggcaacatgggacaacagattctaccctggtggtcagattcctcagcatccactctaggcacaactacctgcaacggcatctgagaaaaatgtgcccttacatagtctaacagtacatattttaatagtaagaagcagcctccattgtccaaagtgagttcttcctatctaaattcccaggtggaagaagtcgatggaaaacattcttctaaggaccaaggctgggatatgccacttccatgagccagtgccctgaagcttcactctgagcataacaagcagagtccctctggtcccagacatcattcttacctggtccccaggacaaagtgtggccaggagtgtcaaactctgcaagcacacggataccccggagccgtgcgtattcaatgacctccttcacatcctgtgctgtgtagatgtgggtgacagggttgtaggacccctgaaaggcacaagacacccttcaggttcacacttcctgaaagctagcagagtagaagatactcaaaatgcccacaagactccccagatatcagaaaacctgcccatagccctttggtgtcagggactatcttcaaaaaacttgatcataatttcccagaagttatcacatctgttttatctgagtatcataatgccagtgagataatcatggtaggtattaatactatgtccatttaacagaatataaatacataaaaagggaataaggccagaagagattctctcctgaaggtcacaaggcaaattatcggcaaagttttggacttgaactcaagtctcctgactccaaatccagtgtccttcccctatattggtctaaaactggctggttaggatgagagaccctgttcttgccagcagggccacagccagattcagacattgacccataaacttggtctgagtgaaacgggaacatacctttctcatgagctctggaaaagtgaagctctcatatgggaaggaaggatcatctaccagatgccagtggaacacgttcaatttattgtacgccatgacatcctgtaggttaaagtgcacactgtgaacccatcacagtctctccggtttcagcctcaaacttgcgatgttgggcgagctctcaggccgctccacacacccctacaggcttgacctgcctcagctctcaattaagtatttatggggtctatcaaaccttcccatcagggagggatggcatggagggaaggcccagcacacttctacttttcccagaacacatccaaagatggatgatagaagtggtctttcctcttcttgaaataaattctggccacattaagaggagggctgcagctactgtggtagcctggaatcttccaaaagcctgaagatcaatacttcctcttgccatttgtgttcggttgtctgactgatgttaagcccaactgtgagacctcctgggaacttagtagcctcttaactcataatctcagaagcaaaggctggcagatgtgtggcctcctttggttccgtcacaggagcaaaggaaaaggcagacacaggaactggattgggaactgtcagataagactgcacattaaactcaagagagttagg

SEQ ID NO: 5374 - DNA, 1714 bp, Homo sapiens
cctcagccacctgagcagctgggattacaggcgtacaccaccatgcctagctaattttgtatttttagtagagacgaggtttcaccatgttggccagcctggtctcgaaatcttgacctcaggtgatccgcctgcctcagcctcccagagtgctgagattacaggcataagccaccacgcctggccttcaaagtactttttaacaccacaatctcaggtcagattcttgggtgcactatgatgtaacgagcaggaatggtctggggaccagcttttaagagcggtgctgtccaatggaactttatgtgttgatgaaaatgttctgtatttatgttgcccaatatgtaaccactcagcatatgtggctcctggacacttgaaatacagttagtgcagctggagaactgaataattaactttctttaacgctaattaacttaaatagccacatctgttttgtggcttatgtattaggtgaagttggaatcacctgaggtgcttttaaaatgaccaattcctgacccccagaccaagtgaattagaacttgccttgcggaaaaggggattggtgtctgtgctttaaagttctacaggtgaccctaatttgcagccagagttgagaagcgctgactgtgggttcccacctctgtctgaagattggaatcacctgtagggtttgttgacatggcaggtgcccagactccacacagtcttaatgggagtgaggcccaggaatctgttttcaacaggctcccaggtgatgcttggtagtaggggtcatgaacctctagatagggctgggcgcagtggctcatgcctgtaatcctagcactttgggaggccaaggcaggaagataggttgagtccaggagttcaagaccagcctgggcaacatagtgaaatcccatctctacaaaaaatacaaaaattaactaggtatagtggtatatacctgtagtcccagttacttgggaggctgaggtgggagaatcacctgtgcccaggaggtcgaggctgcagtgagctgtgatcatgccactgcactccagcctaggcaagaccgtaagacccagtctcataaaacaaaacaaaagcaataacctctcgattggataattgttactgttttggttgcatttgagtaagagacattgctgactatgaagagtcctgtgtttcctctgttggacaaagctggactctgtgactactcagttctccatggaactagccatagaatctttgaatgtccgtgaaggatcttggaggactagtacactcccctcatcttacaggccaggcattcagcgcatgcgccgtcctgacagtgcggagcccaacagctatattccccggtgtctgcgccagaggagttcaccagcagcagctggctgcactggctgaagtgcttgattctgaaagacagatggtaggggcgggacgggcaggcgatggggatggcccgatactcctagtgggcagcatttggtctactgacagtcctccctcccatcaccaactttcatcacccacccacccacccaatctttccccctttctcaatggatctgttaggatttgcattggccccacccgtagtttctgattggctcgcctaaccctccttccctttgactttgcacttcacgaatggaatgccacaagcgtctttgtgctcctcggcaccttcctgatgtctcttggtgcaagcctg

SEQ ID NO: 5375 - DNA, 1812 bp, Homo sapiens
ccacccaaagtccctggggtttctctactggacagcctggcagaagaggccagtgccttagagaacagcaggtggggaggtgagggagggcagaagttggagggaccctggcaagggcctggactctgtcctgagtgatggaagaagccctaacccaggcccccaaggcgccaccagccatagcttcccaagcccaccggtgggaagcagaccaacgcatcgtgtgcccagctgcgcactgccagcccctgcctgcccgccccgcagcgagctcaccatctcgtgaaggatgtcattggtcaggaagctgtcctggacgtaggccatctccacatccatggggatgccatagtcactgggcctttgctggcagggacacagaccagtgagagaagcctcaccagcccgcagcccatggcagctggggacaattggcagtgcccgggctgggaacgggagagtgcacaccccggctcagctctgcaccgggatcggcacctggtggtgggaccagggaggcagtgtagcatccttactgtgggagaggcccagaggagagccagggccctgaaatgacttcccagggctgacctctgacttcagggcaggattggggaatgaagccaggcagggtcaggaagggagccctctttgtactgagcagccaatgacacaacggaggccccacgcccaggacctcaccaaaatatgggcagggcagcagtcacgtccccatttcatagatggagaaactggggccccaactctccagtggagcctggaaccaggggcccctgcctagtcgtgacccaaatgccccagtgctcccgggccccccaggctctcccaacagccccacctacctcgggaggaggcatcacccagaaaggtgagatcttggactcggggcctgggttgccagaatagtaaggggctggcgggagagagggagaggggttggccctgggaggctcggctggcccagcatcccccctccttgctccccccacagccccatcccgcgtacagcagagcagggcgaggcagggctggaagccattgctggagccctgcagccgcagctggtagtccatctgtgcgtcgatgtcctgcagagatggcagcgccgggctgtgtgggtggctgtggtaccagcccaccagggacaggccccgcaggaacaggctctggtagatctggggacagaggcgcagctcagcgggcacaggggcctgaacggctctagtgagcttatgtggctggccagccctgaacgaattcctgctgtgtatcaggcctggggacacagtgatgaccaagacaggccctgcccccaccgccactgagtccagtgggagctggagagacagccaacaaggacctcttttaatataaaagatgcaccctgccacaaagccaggacaccaaagtcattttgttcactgctgtagcccagcttacagaataatggtcgccacacagtaagcactcaacaaacagttaaaactaggctgggagcagtggctcacgcctataatcccagtgctttgggaggctgaggcaggcagatcacttgaggtcacgagttcaagactagcctggccaacatggagaaacccccttctctactaaaaatacaaaaattagccaggtgtggtggcgtgtgtctgtactcccatctactatggaggctgaggcaggaggatgttgaacctgggcagctgatgctgcagtgagccatgattatgccactgcagtccagcctgggcaacagagcaagatcgtgtctcaaagaaaaggaaaaaaaaaaaa

SEQ ID NO: 5376 - DNA, 1161 bp, Homo sapiens
gcagcgtccgtctggttcacctactctgagccaggcctagagcaagtgaataagcccagcaggaatggggtgagatcaggcttcctgagccctcagagctgaagtcccggctctgtaagtcctgccactcactccacccatgggtgccgctgagccacccttaccaagctcctggcaggctcagcgcctccaggctgggtgcctgggaattcaaagtagctcacgtaggagcagaacagatacttagagagataaaatcgcctgagataatggctggctggagtctgatgctctgggcacacaaacaaagggatgttaggactgcccagggcactgtgggcgcaagagttagtctgaagtataaggttccaggcagcccagccagtccctccctcctcaatgggtctgtcctggatgtgtagggtccatctctgaatataaagccacctctctgccctctgggggcttacattccagtcagggggacaaacaagaaaacaataagaaaataggtgtataacataaggtcagcggtgacacgctgtgaagagaaagacagcagggtgagggatggatagaaagcagctggattaagacatttggccgggggtggtggctcacgcctgtaatcccagcactttgggaggccaaggcgggcaggtcacttgaggtcaggagttcgagatcagcctggccaacatggtgaaaccccctgtctaccaaaaatacaaaaattagccaggtgtggtggtgtatgcctgtaacctgtaatcccagctactcgggaggctgaggcagtagaattgcttgaacccgagaggcagaggttgcagtgagccaagattgcactattgcactccagcctgggtgacagagcaatatctccaaagaaaaaagacatttggccgggtgcgatggctcacacctgtaatcccagcactttgggaggccaaagtgggcagatcacctgaggtcaggagttcgaaaccagcctggccaacatggtgaaaccctgtctctactaaaaatataaaattagctcggcatggtggtgcatgttcataatcccagctactcgggaggctgaggcaggagaattgcttgaacctgggaggtggaggttgcagtgagccgagatcacgccatttgcactccagcctg

SEQ ID NO: 5377 - DNA, 2887 bp, Homo sapiens
agcagaggagctcaactaaagggctaaataaaagcacgcgggtggcacactgaaatgtcgtagaaggcaggaagccccgctactatgaacctacaactctccgtttgcggctgacgcatcgctcctgcccgcacgcacctgggtccgtgccaacagcaccgggcagccctcgccaggcacctccaaggactctccacctccccggcgcgtcctacacctgacggccgagttctaaacctggcggaaaggtgacaagcgacgccctccgcggaacccgagggccggctgcagcgagctctccccgggccggggcaggggtcggggggcggctctcactcccaaggggtcccgcgccgtgccctagcctccccgcgccgctgacagccgggagcgggcgacagacgcagcttgcgccacctccagagcccactccccgccgcagcccagagcgcacgccctcgggtgcccagccgcccacgccccgccgaagcacgccgtcggcctctggggccaaggacgcgggcccaggcggaccgcggcgcgggcgggaccggacgcccaggaggcgcccccgcgggaccgcaagatggcggcggcggcggcgccagggccgggctcccctccgcctcgccccggccggcgcgcgcaccgcagcgagggcgggcgggaggggatgaagcgggccggagcaaggggcaggccggccgaggtggcggcaagaaagcagccgggaaagggaaggcgccggggcgtgggggagggggcgctccctcgggccagggccgcggacgtgccctccgcgcccccccgccgacagccagcggtccgcgcgccccaccccacccgggggtgtccccgttctgcctacctttgaatttgaggtctgtgggcggatcgaggaccaggatctgctcgtgcttcgccatggcccctgaggcggacgccatcggagagacagcgcagagcgggggcgcgcccgcggcggcggtttgctgactgggggcgggggacgacggcggcgacggctcggccgagctctaggacgaggccaggctcgcggctcccgagccctaacgcctgccgctgtgtcaccggttcggtgggccacccgctgggtcagcagctccgggtcccacaactgactcaaccccacaccagccgccacggccacgcgcacttgcgagcctcggcgacccacgtgacggcctctgcgtgcctacgtgcgcgcccccggccgggagcttctagcgcttgtcccgccctccaggccggcctagcgcggcgcggggctgctgcgcctgcgcgctcgcggcttgccgcggcccggagcgcagcccagctgtcaagggaacgggtgtggaaggaggcggggcaaaggtccgcgggaccgacgcgatgcgcagcgcagggctggaagcgcagtcctctgtcaccttgagctccgagtacggaactagagaaactgctctggcagcgcatcacactcttccaagtgggaatgcccagtggaagggacaagtagtagtagggaagcgcccactcactacaactcccggcatgccccctgcggggcggggccttcgccgagggcctggccctttgcggccctgcgcggtgcttgctgggaactgtagtaacggctgtttgagggtggaaaggagagctaggtctgttggaggcaatggggtggggttcgcggacgctaattttggctctcagagcgcgtctagtttgcgctaaaaaagaaaaaacttgaagactgaaacgaggccccaatgttagaaatatattaataaaatctgccctgtggagaacaggcgtggggggatgtgtccgtttgctctaattctatccagtcctctgttggcagggctgcattccccgtggtatccaattcagcctctcctgcttcctgagttctctccagtgatgcaaaatcagataaggaaacacacctcgtctaggaagcaaggggaaatatgacaaagcacacagaaactagaaataaaagtcaaaaatctacaccatcgaacccaaataatcttcttcagttttaatgatggacccaaaccaaaacagttctcacgttcacatgttagaaactaactccatctgcatcacttacgataggctgtagtaaactgaaccaaataagaaaaatcccagcagcaaacttgctgacaaaactttagccgattgccagggtagtccggtacaggaacgtcaaatgaaaccaatgtgctgtaaataaacctttattgtattttgtgatacggtttgaatttaaatccctaggtagcgccacgaaacaaaagacatattgatgctactgccatggagcagcacagtttgtctagaaaataaacgagacgaaacagcagtctagaagtaggcaccaaatccaagttttcatgtgcgatccaggtattagggtccatccaggaacagcctgctggaattgctagcctggcattcacagaagattgtgccacccacgaggaatgtgttttcagccctgaaattcctgggagtgagaggtgaagccagctggatttctgggttgggtggggacttggagaacttttcttacaagaggattgtaaaatgcaccaatcagcactctgtagctagctagagttttgtaaaatgcaccaatcagtgctctgtaaaaacgcacctatcagcactctgtaggtagctagaggtttgtaaaatggaccaatcagcactctgtaaaatggaccaatcagcagggcatgggcagggacaaataagccaataaaaactggccaccccagcctgcaggggcagcctgcttgggtccttttccacattgtggaagctttgttcttttgctcttcacaataaatcttgctgctgctcagtc

SEQ ID NO: 5378 - DNA, 4298 bp, Homo sapiens
ctgagagaaggccggctcctgtgctctgcactctggcccagggctgctgttccgctggctgacgccctgtccccaccccagcatgtcctgcttccaggctgcttgacccggctgggctgggtgcctcttccccacccccgccccagtctcccgggccccatcccagcctggcccgtcataactgccgatccccagaactgtccctggtgtgcagcaggcatgcagggtgggcctgcagagcgaggtcccagcaccggcggcatctggcgctgaacacaggaagatgggacgtttgctgaatgaatgcacgtccctgatgaggcctggacttcgacggatgaaggggctggtggggtggagtcagggttccccgaaagccctgggtggagagggtccccaaagtggggtcagacagcctgtgaggctcacagtcctgccctgcagccctttggtttggaccaggtgccacctccccatctccctggccccagccctcagctaaccagcccatgccaccgcctggaaatgggccagagggcagtggcgacctgcccaagtccacacgcaggccacaggccacactctgaaccccggggcaggctcagacgggctttgctcagcctgccttagggcatagagggagactgagtcagggccctcccaggaaggatgggtgtgcggccttccacgctcgggactttgggccacgatgtccaccccagggtcttcgcagagcagcgggaaaggaccctgctggcaggcacagtgcccgtctctgcccccggctctgctccaaccgcccccagcccaagggcggcacgccgcagggggtctgtgatccccccacgtccccggctcctttcacccacacaccacactgggaggcggcagcccgagggcaggtttattgacaacctcacgggacacaagcaggctggggacaggacggcgacaggctccggcggcggcggcggcggcgctacctgcggtaccagatctgcagcctccgctcccgcttgatcttcctctgcagctgcaggatgccgtagagcagggcctcggccgtaggtgggcagcctgcagggaccttgcctcagtctcgcttcccgcagccggagcccgcgtgaccgcgtgcacagcgcagccggctcggctttggaagggtttcccgggccggcctctgaaggtggaggctgacagccctgggtgggcgcagtgccagggactgggagccggcgcaggggaggtccctgcaggaagagtggggtcctcccctgggcaaggccccactgccctccacccgtggctcatcccgggctgtcacagggacctctcggacaagacgctgacctcactaacccggcccccggccccagccctcaggactcaatgggggccagcgctcagcagacacacttagcagtggggagcagggcccggggctgccctggacggagatggaggcagggaggctgggcggagggaggggaggtggcccagagcccgggcatcccacgaggacccgatgaccctctttctgagccccaagccagagctctttgctggggatcccccagtcccggctgccacgcaggttcagaacaaagggcttgagcaagaggacgaagcccagggcccaacggggacagcaggagtggaaacaggtgagaaaggacaaggccactgcagggcctgggaaagggcggccaggccccacctggcagagctctggcaagtccaggctgctccaagggagggagaagcacagtccgcagggagggagcagcacagtccgcagggagggagggaggagcgaggtccccagggagggaggagcgcggtccgctgggagggaggggcgcggtccccagggagggccgagcgcggtccgcagggagggaggagcgcggtccccagggagggaggagcgcggtccgcagggagggagggaggagcacggtccccaaggagggaggagcgcagtccccagacagggagcacagtccgcagggagggaggagcgcggtccccagggagggaggagctcagtctgcaaggagggaggagtacagtccacactcgcaacttgccccattggtctgcactgcaggggaagacgccaggggcatgggcagagctcctgaccccaggatggacctctctgtgctgtcaagtcacagggaggcccaggctgccctctccactgcccccggggtgacctgaaccgtgcagaacgctgaacaaatcaacgccctttccagggaagcggaatccaaagtcagagcctgttcctccacttttgagaggcaccaggatgtgcctctcgcttgcccaaacccccagactcgggactcagggctgggctctctgcgcatgagctaatgccgcacgcagcacagggtggccaagaacaggactctgtcccctgtcccacatgagcgccacctccaagcctgcctaccgtggaccactgtcaaggtgaacgcccggggggatggccctcgtgggaccacgtgaggtgcaagagtcccacgggatcaccagatataaagaatgttcccggtgcgatgtgaatttcaggtatgcagccaatgctctttttagtgtcagtatagcccaaatattgttgggatatactcgtactaaacaattactactaacagttttcctgatggtcaaattcaccctaacctcacagtcaaactaagcctcccacgttttcatttgccaaatccggccaccccgggtcccagggagtcctgcgtgcccttctgtaaggctgagggcgcgggacagtgtccttggcccccaggaaccttctcgcttggtatttctaactgcaggtctttggtttgtgccaggtaggaccatatgaaactgctgtaaaccaggcgtgtgtcaggaattccactcagcttcccctgctccctctgatccctctgatgcctgaatacatcgccgacttctcacaggggacaggctccactaagaggcagcgctccgagtcggcccatccataggatgggggagcccgccgtctgctgggggtgtgggactccctcacaggggccgccgggctccgtgtggcgctggccctgtctccagctccctcgtgggcggtgcggtcccggccctacctgggatgtagatgtccacgggcacgatgcggtcgcagcccctcaccaccgagtaggaatagtggtagtagcctcctccgttggcgcagctgttggggaggcaccgtgaggggagtgtgccgaagacccgcctgcccaccctccctccacgaggcctcgccccatccccacccgccttcaactgcaggccaggcacctacgaggctggaacttgtcacggagaagcaatgagcaaacacgcacaggctcccagagcctctgtgggaccagtggggcgcaagctcacacgtggctgataactcggggaaaagtgctcccctcccgagggggctcctgaccaccgattcccggggctgggatgtgtcagatcacatgtgtcaacaaaaagccacttcagacagccacagtgccaacacccagcccctgtctatggggcggctgagcctcaccctcgcctgattccggctctgtcagtgaggcgctggggtccacccggggcagggagctggaaaccccaggagaccacacagactccactcccagcactgcttcccacagccgtaaaaatggacataccctgaatgcccagcagtgggagacggttatgaaaactctggaatattctaattaactgtttagaattagattagtaatatgtccacacagtgggatattattcagccaagaaaaggcacgaggctcggacacaggccacagcacggatgcaccttgaggacgtcgcgctcagtgagagacgccggacacagaaggccatgcggcgtgtgatcctgtttctgtgaaatgtccaggacgggcccatccacagagacagggaggggaggtgtgggcaccggggctcggaaggggatgcagagtgactgctgatggggacagcatttcatttgggggtgatgagaatgttctggaattagaggtggtggcctaaaaaccactgaactgctcgctttaaaagggtaaacttatcaagacctgatctctacagaaattttaaaaagtaggcacagtggagtacatctgtaatcccagcactctgagaggctaaggttgggggaccgcttgagcccaggaggtcaaggctgcagtgagctatgactgcaccactgcactccagcctgggcaactcagtgagactctgtctct

SEQ ID NO: 5379 - DNA, 3674 bp, Homo sapiens
ctttacggttttgcagcattcataattgatgtgaaataaggaagataatcctttttttttttttgagacagagtctcactcttttgcccaggctggagtcagtgttgtaatcactgctcacttggcagcctcgacctcctgggctcaagtgatcctcccaccccagcctcccaagtagctgggaccacaggcatgtgccaccattcctgattttttttattttttgcagagacagggtctcactgtgttgcctaggctggtctcgaaccttggcgtcccaaagtgttgagattataggcatgagccactgtgcccagccacttatttttctgagtaacctttaaggatgtattgtggacattttcaaacatgagtcatatatttttgctggtactcccatctacctccccaccattctccttccctggatatatatataaccatgtttgtccactgggacaaaaccattttcacaatcatactaagctgtcatttcacatttttgctgtgcactgatagtgtgaaagcaatggcaggtaaaactgctgagcctgagttcaaagcagggcagtagccctgaggttggttgttcatattcttctccactgggaaatgcagtaaagaaaaagaaaagctaatttcacttaatttcttttcttttcttttttttttttttcttttgagacggagtctcgctctgtcgcccaggctggagtgcaatggcgtgatctcggctcactgcaacctccacctccacggttcacgccattctcctgcctcagcctcccgagtagctgggactacaggtgtgcgccatcttgcccagctacttttttgtatttttagtagagatggggtttcaccatgttagacaggatggtgtcgatcttctgacctcataatccgcccacctcggcctcccaaagtgctgggattacaggcatgagccactgcgcctggccctctttttctttttgagatggagtattgctctgtcgcccaggctggagtgcagtggcacaatcttggctcactgcaacctccgcctcccgggttcaagcagttctcatgcttcagccctctaagtagctgggatgacaggtgtgcgctaccacacccggctaatttttgtatttttagtagagatggggttttaccatgttggccaggctggtctcaaactcatgacctcaagtaatctgcccgcctcagtctcccaaaatgctggcattacaggcatgagccaccgtgcctggcctactttcactgaatttctgtgatgaaacgggaaaaattaattttgttaaatctcaagtagaactatattgtcattatcacatctaaacagatatcatcaaatacctagtgttcagatgttctgggttgcctcataaattttgttttctatttgtttcatagtaatcataatctaaacaagatccacacagtgcatttggttggaatttttcttttttctttttcttttttttttttgtgatggagacttgctctgtcacgtggttcactgcaacctcccaggttcaagcaattctcctgcctcagcctgggtgacagagctagactccatctcgaaaaaaataaaagaacttcccgtgtccgtttttgctttttggatgctgggagtgtcacaactcagctatccaatcaaggcagagctggcctccaggatgccagagccagagctttgtggttcatctctagaggttcaacaggaccctgtggatggcccaagttcgtttctctgcacttacctcttcggggttgtcctcaaaacgttgccgtgtcagctctcacttttcacagcaactctggcctcctaccttggactgcgccacttctgtctccttagataacctccattcgcatagctaaatgctgcaccctccgacactgccacaataatagttctgtgagttagtaccattttatagataggcaaaatttggcacaggacaaaagttagtggtaactagaacaaaagtaaccagcccaagctaggaagtggtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttccccactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgt

SEQ ID NO: 5380 - DNA, 3493 bp, Homo sapiens
aactgtagtgctaagactaaatgcttcacgatccttggaggggtaagaggtgacgtgagccacggggaagccacctaggtcaccctcaaaactatcctttgcatgtcccacagcaactccaagaaaacaatctgaacctaagacaacagacgcagctgcacctgggacagcagacacagctgggcctgggacaatggacacagctgtacctagaaaagcagaaacagctgtgcctgggaaaaggaacacagctgtgcctggaacagcagacccagcttcacctgggacagcagacacagcagaacctatgagaacaaccactccaacagttctggcctcctggccttctctcacccagagcaccaacagcacccagcccacggctcttaccagccccctcaccaggtgagcagagctgggctcccacagacctttccctaggctgccccatgactgctccttcagatgctctcaccagggaccctcatgtggcgctcgtcaggggagaaacagtgaagtctgtagtgggccttcccctccctgtctacacctgagcactgcaggagattctccctgatgagctgcaacaggctgagctccagagagcaggctctgggctccatgcttcaccgagtccctcaagccccaggaggcaaaagcgaggtgaagctttgggtgctctggaagggcagctgtctgggtggctttcctgtggctgctgtaactgatcgttacaaactttgtggcttaaaacaacacagtctcatgatcatacagctgtggagaccagaagtctgaaatgggtctcactgggctgaaatcaaggtgttaacagggctggttccttctagaggctccagcggagggcctgttcccttgccttttccagcttctggaggccacccgtgttccttggctcatggccccctcctacccaaagccagcaaaggtcggtggagtctcccacagagcatcgctccactgtctctcctgcctccctctttcatttataaggacgctggtgattccactgggctcagccagatgatccaggataatccaccctgggtcacctgacgagcagtctcaaatccacccactgccttaattcccccttgcatgtaataaaacatattcacaggctttggggttatgacatcgtgggtggggttcactattctgcctaccacagtcacaggcaggggtgtgcccatcgctccaactctccagccaaggctagggaagggcagggcgggagagcgggaagctgggcctcttgcttttctttcacattcccagcatggtagatgggtgtggacatcaatccgaagcccacctcctttcgagggatcaataggatgtctcatcaccgcgcaaatgcggctgcccctgtttaaccccatcacagcctggtgcttcaggatccctcaaagtccagggtcaaggcccattctctccctggatcctgccttccctgctccaccggctcccttctccagcccaactccgttcctttcaaagggtcttgttccctggagcctgccagcaccgatcctgtgttccctaggagtccggaagaggcgaggcactggggatgcttcctgacctggccttcgtctcgctccactgtttgcagagcggttgttctgctgagtggggatggcagtgccaggacttctagcgagacgggagaggcacaaggggaaacttggcgggaagagaccaagggtgcggcggctccacggggagtggaacttgcaagaagaacacagtggtttaaagggtatttttaggatgtgcaatatggcaggcctgctctcactcaagaaaactctgagttaaattcacatgactcatcactgcttccatgccctgggctggaggccagcttcggggagagaacagggatggcctgagggaaagggccctggcactgggtgtaggggagtggatgaggaataagactggggaatcagactcttacacgctgatggggactccccagaacccactcgtttagctagaccaaatattaaacatgtgggtgatatgaggcagcaggtctcagatctgctgtcataaagtgggtccaagcaggaggagacccctcccaggagaaccaaatagataaatagccaggttgttagaagtgggggaatcttcctgtgcttcaaagaggtaataataattagatttgagcttgaaagatgggcagaagtgacaaagggagacacaaggcagagagaggagcagaagcaggaatacaggacacagcagaccctcgagcttggcgggacacaggtgagtagcagggactgtgggaaagaagaccaaaggcaggcctggctgggtgcagtggctcacgcctgtcatctcagcactttgggaggccaaggcaggaggatggcttgagctcagtagttcaaaatcagcctggggtatatagcgagacgccatctcggcaaataatgttaaaggctgggcagtcacggccaagggcagcgaaggggccgggccccagactgagcctgtgggaaggccactggaagctcagcctccgggtggcatgactttgccccttgcatggggcttccctggttggggaccaggcagctgaccagggtggcaggtgttggctcagggaagaggctgctcactcttggcatcttgacccctttgtccaggatcctgctctgcaacatccacttcctgctcccgatctccctgaaggggctgctgctcgtgggcctgctctgcactgtgctgcaagtgagcagtgctaagggggcctccagggggaaataaagtcacagcctgagccggggaaccgcagctcccacaccatcaacaccctcggagggggcaagcagaacctctggcctcctatcaggtaataagcagcaattgcagttccccaggagacaagggtccctgcagagatgaaatatccctcatcctggcctcaggaaggcaatcccactcccagctggctctgcacagcacagggatgctgacggggcctctctgccttctgccacctctgcctcaggagcagataaaagaaaggacatcccccttgcacactgattccttggaggcatctgcatctcaccttcatggatcctccctcaggcctcctttccttgtggctccaggatgaccctgtcagagatactggactatcgttcagttgcagaggccccagggcctgtctggacttttccatcccaagaggggctcggctctatcccctttgtgcctgtgaccctctccatcccccacccggctcagaactggcacagccaccaccaaccactcctgattcaacccaagcttcgccctttccacctctcgagctgtgcaacaacaaatgcaggatgctcagccctcatgtgtcagtcccctcaattcacttgtaattaaataacaacacacctctttttctaattttcaaaggtgtatatatttcccctcaataaagttgttaggatta

SEQ ID NO: 5381 - DNA, 610 bp, Homo sapiens
agtgccgcccggcctcggttgggacccctcccctcctcctccgcccccttgggtgtcggtggctgcggccagggtctggacctgggcggcggccccgggcggcggggctaaagggtgtgggcaccggcagagcttcgcaggctgcatccggctcggtgctgctgccgtcgccgcccctgccgccgcccaaggccctcggcgttccccggagagaggccagagggatttcgggctgcctcggcactcgcccaggtttgttaagatgaaacactgcagaaaggctatctgaagaaaagtagaaggaaaaacagaacgttgcaaactctggaaaaaaacttggtcccagctactcgggaggctgaggcaggagaatcgcttggacccgggaggcggaggttgcagtgagccagatcgtgccactgcactccagcctgggcaacagagtgagactctgtcccaaaaaaaaaaaaaagtttttattttacttattgtaaggaatgaaatacattttaatcgttgtttactgccatggactttattgttttttagctttcactttgttgttgaattgattttttctttaagaatattaataaaagtagcttagcta

SEQ ID NO: 5382 - DNA, 574 bp, Homo sapiens
cctacctgtgcactgctggatgaagtgctggtactccgctccctgctcgccggggacgatggtggagccgtcatatttaaaagtcaccctttgggttgggagaagaaaaaaacacacacacacatcagcgctggtggccgcgcgacgcggcgcttgcagaggacaatctaacagacgcgctggccacggagaagcccgcgggggcctggcacgccgtcccggaataaggcgaggaagacagcgcgggaggcccgaatccgtcccgcctggaggccggctcggtgcacgaggccccgcgcgagcccggggagcggggcgtggagacgaatgaaaagttcctaccagatgacggccgagccgtcgtcgcgcaccaggttgtacgccgcccggcaagcctctttgtcgatcttggtggccatcgccgcggagccgcagcgggacactgtccggggcggccgagcgcgcccctggccggcggcggggatgggagcgcggcgggtacgcgccgagggcgcacgggctggcggcggtggcgacggctacgcggcgcctgcaagctgcgagcgcggcggcg

SEQ ID NO: 5383 - DNA, 2666 bp, Homo sapiens
ctcccacaacctccacctttcgccccgttttgttcaagctcaagttcccctgctgggaattggtgttcctcttcctccactgccttttaagcacggcctacactccttccagtcccttcccaagggcaccttctcctagaagccttccctgacctttccaccccgggcttaaacaccgtgtgacacaaccatgtggctctcactgatcatactgcacgagggtcagtcatgccacctctgtcccccgactcccagcaccctaaggacagagctgccttctttcaaccccagcacctagcaccatgccagccagccacacaagacactagacagatggtgatgagtttcagttaggattttcagtttcagtttcagctaggattttcagttaccttcgtctagatatgtcttatccctccaaccagatctcaaggacagggggaggtagggaagtgcaccccaaacttggagaaaagggtggcattatcagtgatttaaagatatttttgtgaagcttaaaacaggaaaaaaaacacaaccctgtaaacttgaaagtgacctcggttaaacattaaaggcggcagctctttgtttatcaaaatgaggcatgtgttcaaaaggtttccaagtcactgaaccagggtgtgggctcccagggggactggtctcagcgtgattcctcttggtatcctcacagcaaagcctggcccaaggctgagcagcaccctcagtgcccagccaacacccccaaacccagctcccttcatgctgcttctccaaaggatcctcttcccaggacactgtgttcctcttaaattgtttcccattgtcctcacaacagccctgagaaaggggcggagcagggttattgagccccactttaaagatggggaaactgaggctcagtgaggtcaacatacttgccaaggtcacagagcaaggtgagcctggactaggccttaagtctcctgtctcactgttgaaagctcttttcaatgtactagctgctcaacaactaaacactcctcaaaacacacacacaccccccactgccaccatcccagccgtcacagagccatgcattccaaagggccacttctcctgtagatgcactgtctactgccaccactcccacgacccccaccaaaacttgggctcctgcagggccctaaggcctgcctcatccattctccccaaccccatcagggaagccggctgaatattccactggacctccccgaaggcctctcttcacttccagcctcagtcaacctatctgcagagtggggtctcagggccacctcctctgtcttccgtaccctcgaggccggggtggaactgaccctggggaaggagacaagtcctacttgcaagagaccccacccacaagtcttttccacaggcagctgcactgacatctgcaaagacagatcatcaaagtccccttggccaatctcagcccggccctgtgactgggcagcctcctcactctccccagctatacccctgactgaggccccgcctgcacgccgaaaggccccccgtctctcccccaagttctttcctcccatgccacactcacagcccagctgagcccctgctcctccggtctccggccgcagctctttgctctacagtctgcgctgctcaacgcaaatacggtaactctcccgcagcgacacccgcgccccttctccccgcccccataaagacggcaagcgtcccgcgacgttgctcttatcaaatagctgcattaatcgggagagctgaccccaccccacccgaccttacacacaaccttgccaacttctgcggccggagcaaccctggagaaatatggtaaactctgcgtcgcaaccccacccccacgaaaatacgtaggcctccaccctgctgccgcaacccaccccgcccgactgcaagccccagctcccagagggaatgaatgcagcccaccccccacggccgcagcgcccccccgcggagccacgcaaccctggataaatacgtaattaagtcccggcgctcccactcccggaaaggacctgcgcgggacccggcaaatacggtagcacgcccgcagtgacccgcccccgagggtccggctctggcctcggccaggcccacaaaccgcccccagcgacaggaaagagggtcggacggaggcgccggcctttccccgggtgacatgggctgagcgccggagcccggcggcggagcggccctgggcgagggtttcaggactggagacaatagtcaaaggggccgaatcgaggagctgccctcgctgacagtttcgccaaagtctgcctgactatatggcctgggttatatcactagagtgaccagagggaaaggaagaagacatcaggcccctgctgaccccacctcctcagaacggaacccgcagtcaagccagagatatcccataaaagagcaacttacgacgtctggagtagcagcgggcgtgagagggcagaaccaaattacagcttccagctgccatttaatgataatgtcccttactcggacataactttgccttttacaaagcccttttccatgttatgatctcgtgggaaccttccaataaccatgtgcaccctaccttgtgtgggttttatcccattttatagacgggaaaataaaattgaaacacagagtgg

SEQ ID NO: 5384 - DNA, 700 bp, Homo sapiens
agcttaggtgacagagtaagagcttgtctcaagaaaaaaaaaaaaaaagaaaagaaaagaaagaaaaatggtgaaagaggagacaggaaatgagatgaagcatgatggtttatccacaggtccattttctcagggaatgcattatcagcagacactacatataaaagtttaggatctgaaaagtgattgttcttaacctcgcttgcttgtatacccctccgattgtcttcaggcatcttgaaggatatgcaaatcctggtataaaggatggtgattgatacaataaccacgttgttctttgagatgttaatggactttctgataagattccatagttattaaatttgagaagccctgggaaggaaaaaagttaaattttctttttaatagcaggactgtttagaaactttaatatgctaaagtatgtgatacatttcaaacaggggagttgagtatatattgtttcctaaagttatgtgattctggaattctttaaaagtgcaatcatgggaccagtattgcctagaacacactttgtattcctagggcaatgtcactttcaatatggcatatgtagtaagatgctatatcttaagcatatttaaggaaaataccagtatttacaaataactaattttgaaattagtaaaagctgtatttcttctgaatgtaacacttattaaaattaagtgaagaatga

SEQ ID NO: 5385 - DNA, 546 bp, Homo sapiens
gtgtacagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctgggtaagtatgcaaactgttcgtacagggaagcaggatgacaattagtaatgacataagggtctttattgttcacagaggaagatgctttattggggttacagcaccccagaaaccttgtctcactgagtttcccacagcataagtcagtttatgattcttagtgtttagaattcagctgtgggttattattaagatagtaaatattcattttgtgtttatctacaagtaattgtcgtttcaaaacttattctcaaatagacattttaatttataatgaaattttacatggcattgaaggtctagtaaatttaatgctagacaatactataggaagagtgcagtgtatgagtgg

SEQ ID NO: 5386 - DNA, 2280 bp, Homo sapiens
tgtagagatggtgtcttgctctgctgcccaggctggtctcgaacttctggcctcaagcagtcctcctgccttagtttcccaaagcactgggattacaggtgtgagccactgcccccggccagcacccgtcttctggaacatttgtaagcatttctgttgggtgtgtacttgcgcgtggaattgctggctctcagttatgcacatttcttagaagatcctgccagtccttcatcccagaccccgaccccagcgtggaaaacgcagtgcatcctcaacgcctagtgtttgcggctgtggcggctcatgatcgacttggaaggcccacagtgtgtggtgtggagttttgcagggagccagtgacactgcccaccttcgatccagacctaaccttgatcctgttctctgaggccaccttaccaaaaccttgacttacccgtcttagatcacttaccctgggggaaatgtgccgcaagctcacgagggcactcagccagcctacaaaggttaccatggcagagaactgaggcctcctgccagcagccagcagcagctgaccagccgcgagggcccctccgggaaggagagctttctgtgtttcttcctgtaccccatatatgttgacgtgatacgttttactttctgatttcccttgtgagatctttggtctgtgggttatttggaagtatggtttaatttccaaacatttagggttttcctccagattttgttgttgtttctggtttctggttttaattccactgtggtctcagaatatactttgctgacttccctctctttagatttgttgagccctgttttgtgcttcatagtgggagggtgattgtatgtgcacgtgcagatatgtgtggcccccacacggtatctccagctatccgtgtcttgcctctccgtgcccagtgcacccttctcagccctgccgtgtgaccctgggctgggccctccctgtaccctcctttgcaggttggcacagtgtttggctctgtcactggaaggagctggagggactccacaggagggaggggcctgccctcctggttccagtgtgcttgcttttcctggcttccgtggtgtgtgcctgccagcctcatggtgggggcgggggctctcagtgacagtctgcaggagtttagcaacacccaggttcattcaccacggtgggaaggattcctgctaagcttccttgcctctgtccagctcccagggcgtctgcctccctcctgccccagggagagcttctgggtgagtctcgctggcactcctgccccgggcttcctgctctcaggccttggcctgctgcaccttggccaactgcaccacccggcacatcatagccccactcaggtcagagctgcgtctcagccgacgtggggttccgaggttctcaccaagatccagactcaacgcttgtgggtttgttgtctcagtcctggcggtggaggttctcccgaggcctcagcgcctccgttctcggaagtctctttacatgttagtggaaccctctgttcctgttgaatcattcttcgtgttaaatgtttctatctcttgactgatacatgatagtcatcatgtatgtattctgcggctgcttttgtttttttctctttatccctggttttctgtaatttgataagctttagggtatgtgtgtgtgttttgggggtttgtcaagatttgtaggctttgtcatttttatgcaatttggaaatattctagctattcggtctcttcccctgcctcctgcagtcccaggtactcgaatgggctgcttgctgtggactcatgggtccgtgagtctgctcatcttcttcagtttgcgtttcatttttggtagattctgtttccacgtcttcaagcccactgatcttttaagctgctgttaagctatggccattttctgtatgagccattgtgttttttcatctctataaatttggttttggtatttaaaaaaatgtcttccagctaggctggcggctcacacctgtgatcccaacactttgggaagttgaggcagggggattgcttgagcccaggagtttgagactagcctgggcaatacagtgagacctcatctttaaaaataattaaaaaggtcaggtgcggtggctcacgcctgtaatcccagcattttgggaggacagtggatcacaaggttaggagtttgagaccagcttggccaatatggtgaaaccctgtctctactaaaaatataaaaaattagctgggcacatgcctgttgtcccagttatttgagaggct

SEQ ID NO: 5387 - DNA, 438 bp, Homo sapiens
ataacactgtgattctgaggtgccaagaggaggggctttaccagcccttgggtgattactaccaaacggcccagaggccagagagagagggcaggaatttgccccactacctgctcagtattagccaagctgctgccttcagcttgtgcctgtgggtgcctccagcccctctcccttccagaacaggtatggctggaaaccagtcctcctgacagaagaagtcagttccaggaggtcctttctcccccagcctgggaggatgggttgtgacgcctgggacagctacacaagcttcttggcttcaaagaagctcttgaggtgccgcatctgccagacaccgatggccacgaggatgagggtctgcagaatggaccaccacagcacccgctggttggtgctctcactggtctgccggaagcgctcctctcgccactgcag

SEQ ID NO: 5388 - DNA, 430 bp, Homo sapiens
tacagctccccaacctccaccaggccaggatggcagcagccctggccccctcacctctggaaccaagccatctacactctaccccatctttccccaacctgaccctccccactcccaaccaggacccacggtgggttgcagagaagctgccaaaagcctgggacttggattagacagctccctacccagaaaggcaaagacccatcccacacttgcttccatacacaaaagcacacactgcgtggcatcgaaaaaacctaggaatcacagtgaaacaatccagaagccgtaccgccctctgctccctatgcaggggttaaagtgctttggctgcctgagggcaaacaagtgagcaggggtttttcccctggcctcctgtcgcaactgcgtggtccatgttcagcccaggagcccagcccattccatgacc

SEQ ID NO: 5389 - DNA, 1143 bp, Homo sapiens
gcagcagcagcagcaactggatttgctttttcaccagaggatccagatttccctgtggccttgcaaacaaaaaagaaggaagacggagcagcacagtcatccctttgtgaaaaaagcattcagagacggggtttcaccgtgttagccaggatggtctcgatctcctgacctcgcgatccgcccgcctcggcctcccaaagtgctgggattacaggcgtgagccaccgcgcccggcctcagctggtttttcaaaagtcatggcgtgtaattgtcagaacagtgaacttcggagatccaccggaggggcgaggccacagctcgaccgcgagcacctgagcatcctgcaccgcctgcgacggccgtcagggggcgcgatgccgcctcacagaacctcaagcggcgcccgggttccggcacagacggcctgcggctccagggggcggagccgagccgtctcctcaggacctacgcaagaggcgccgtcatccctacagggacacctgagagggcccagcctcctcctcctcaggacccactcgggagacgccgctggctctctaggaacacctggggaccgtggccagggacgacccagcctccttctcctcagctcctcaggaacgactggggaagctgtggcttcatggtccccgaggctgcccgaggaaaggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgattccccaacagttattgctgtaccagatttgcagtgtcccacaaaatactccggtatattgtactgaaagcatggacactctcccaggtaactaccacataacccctagatcaggaaatcagcgttgttcctacatgataattcggtccacaaactcacttcagttttacctcatgccacacttgggagtataatgtgttttttttttttttttttattaggatccagttttcttttcctggaactgttccccagactttcctgcatatttatgac

SEQ ID NO: 5390 - DNA, 1173 bp, Homo sapiens
agcttctcctcgagcccacccccgcagggccgcggggaaggagaagggaaccgctcgtctcctacacgcggtccgcgagcgcggacggcccccggcggccccacgcggcagcggagcagcctcccgcagccacgattctctccacgtgctctcgccggaactcgcgctgcagaagggggctccctcccacgtgggcgcagcaatccctgactacctgcggggtgacccgcccctccagtaacagggaaaaagggactgggggagagagcgtgagcgcgtgccggagctcagggagggagggcgcccggcggagcgcgacctcggctccccgcccgcgcgcactcgccggctgtgcttagcggacgtggctcctggcgcccaggagtgtcccggctgcccaaactttttccgctcccaggcccggagtagggaggaagcgggtccccgcagggtcgaggaagagactgatggaggccagaccactttgccagagcccagcctgccgccccgcccgcgctgacttaccttctgcacttggtcatggttgagctccgtgaagaagtaggcaagcagatgcgaggcaatcatcctgccgcggcccgacggcgcagagttgggaaaccgaggcggagacgcgagaggggaggcgggcggcgcggtccgactgctttgtgctggggctcggctgccgggccgggagctgggagtccggacggcgcacaaagaaggctaccggcgagggtgcgcccggctggcggagggcgcgggtctccggagacgtgattttggcgtcacaactgctagaaggcgcctcagttctctcctggcgacgtgtccggttgtcccacgtcaaggcgctaacttcggccacaggatcactgaggctcaacttgagaagaatctcagcccggctccactcgggcagtgggacctctccgattcacaggcgcgtggctcgggcccgcggattttcttagctgggtgacacgatgttgccagcggcagcccgggactcctgcgccggagtttcatgcaacaatgtggcttattgaggggctgccggcccgcgggcctccggatcagtgacgtgcgcacgcccattggctgcgcggggagggtgtgtgcgcccacggaccgcccgccgccgtggcgcagccaatcatcgctcacggc

SEQ ID NO: 5391 - DNA, 454 bp, Homo sapiens
tttaagttctgttttattgagaaccacaaaaggtaagaactaagagagtcctcccaggtcatcaggtcccatcccttggtctaaggatggtgaaaccattgtcacagccagcagctgccgtgttctgggactgtctcatggggcaatgtgtcctcacccccagcagtgccagcccaggtcagaaggcttcattcagaaggggggtgtcacagcacctggctgagcccccatggaggatggagacccacagatacacacaaacacacagagacatctccaaatctctgactcagactcgcacacaggcacacacagacgcacgctcaacacagacacacgcaggcctttattctattacacagagtagggctggggagcagggatgtagtgcggctcggagcagtgggagtttggtggcgtgtgtggaggggacatgacacactaggcccagcag

SEQ ID NO: 5392 - DNA, 5305 bp, Homo sapiens
attctcatgtctgagattgctttataatttatcatactagcattattccagtattgatgtaaggagttttgctagccttctagaatgagttggagagttgtttgtatttttctatgaacgtttatgtagtgtaggagttatttgcttcctgaaattataatagaatttttaaaagttttatttggtgctttctaaaattttaagtaaaaaagtgtttcagacatgcaggaaataatacagcagacattgattatctcattaatagatattcatgatctcatttcccaaatttaaaagataccaacgttgctgtgtttcagttagcattaagttctccccctcaacacacacacacagatgcacacctacccacttcctgtgagtaaggaataagatctcagaaacgtttagcaagctgcgtttcttgggtttgaagaatgttgtataattgtgtgtgtcacaggcactgtggagtgactgatttgtctctgtcccttggtggagaagataagctcacttttaacatataaaaaagctgtgcacaagctgcattcccttttttgtcttatcctaataatgtgtatcattctcatgcatgtgttcatcttcattttacttatgtgtatttaaaatacataggactatttcgtgtttttaaaattttttggaaaaaagacatcatagttatcattttgaaacctatttttcacccaacaccgtgtctttgaaatatagccatattgacatttgttgatctccatttcttcacaatataacatcttttaaaattgggatgcttcctaaatcagtggtgtcttaaaattggcagcattttcttaatgacagaataatgctgtaccttataatcgatgttatcttagatttgattacatccagtagttaattcctcttaattgctgtaaagcattctgttgtttgaatatacaacagttaatccatttctctatcatagttaatcatttttcttattggtagataatcaggttgtttgcactttcacttttataagcagttcgaaagtaagcattcttcctgtctcataaacaattattctgaatgaaaatgttgaatttagtaaatatggatattctgctttctaggtattgccaaattgcattcctaagtagttatattactttatacttccgccagcaatgtataagagctcctgtttgcttttcatttttagatttgtatcagtttgaaactgtatttatgttgtgagctaaggatcttattttctccttttcaaatggatagccattcgcctcagtatcattagttattgaatagtttattctctacttgacttacagtgctctatccgccatatactaaatgcaggcagttacagattaagatctgtttctaggcttccttttctattgcattagcttatgtatgtagtatatttactgtagttttatagtaaggcatctccttattaatactcttcaaaattgtcctgactattgtctttttataactacaagaatttttaaatcatgttgcctgattctggggaaaaatctttaggatttttattagaactacttcgaatttaaaaatatatatttggagaaaatggccatctttatgatgttgaatcttcccatttatgaatatggctggttagttggtcagtctctttgtaatcgatcttgcttctttttctatcaataaagttttacaattttcttcataacagtcttgcacattgtaactttctttaaaagtacctttctaattgtttgttgttggtggataagaacactagtttagtctccatttcatcttattaaaaactgtgtgactcctttggtgcttagtagatttttttaggagctgaaacttttattgtctttttagctgctccatggttggttaagccagattgttccttctacctggctcaattttggtaatcttttccttggaaatcatgcatttctaggtttgaaaatttgttaggaaaagttttaacataggctgttttattttgtaaatctctgcagcatctctctctatttttttttcttgagtctaagttttttgtcaacattttttcctttatcattggaatcattaaaaatttccaagaagcagcttttggttttatttattgagtatttatttctataatttttgcagtgatcctcatttcttttttcaacttcacttgcacttagtagttcttttagtctcttgggttgaatgcttagttcacgtatatcttggtctttcttgttttctaatatatgcattcctcttataagtacttcttgattatatcacataggtcttgtttggtggtgttccactttttgctcatttccaaatagtttgtcgttttagttttgattattaagcctagtgtttttttttttcctcccaaaagaggaaaaaaatgtggggataggcttgaagggaggggcgtattttttattttattatccttttgttattcttacgtagctaaatttatgggccaagaatgtcacttgtataatttcggttgtctgtattactgagagatttttctgtgtctttatgtatgctgaaaagaaggtttattcacagtttgtgtgtatctgtattttagattgagcttgttaatttaggttatttaaatttttatatcttgttttgtctgtcaaactttctggtttagggtagatggttttgttaatgtctcccataaagattatgaatatttctccttgtatttgtatcagtttttactttatgtatttcaaagttttgatgtgaggagtcctatgactgatatgtattcttgatgcattgtatcatgtcagcagtattaaatacctgtttttttctccttaatgctttttgattgaattctatggtcttaatcttgctatgctttttattagtatatgatactcctttttatcaacttccctgtgtcattttgtgttccatctgattcaaaaacagcatttagctatttttattacttattttttcctccattttctctattcttcttcaggaagtcttagagtttttgagattttagagccagctgtcttccacatctcagctttaccctggcaacacttttctccagcatgtgctttgggctataattctttctcaagatatacttttttccccagaatttgtcaagatttgtacgtttctttttctcatcattgcggatttatctagtatgtttctgtgtttttatattatctcccatcattttatgagggagggtagttgccagtaatcattgttctgtcttgatcctgtggtgtccctccctgattccagcacttaggttttattcttaacctgtttggtttggggcacaagagtttcataaacctgtattcaatccatcatctttgagccttcctgagctgcttcttaaaaggctgttatcttacagcgtgtcattattttactactgttcatctcataagttggagtcacttcagttcctcagggcttctgctagccaccccagatggagagcagctcattttttggacctattattggagagtgtcagtgactatatcccgtccttttttgtaggtcctattcatgacttctgtatatcccttcctttttactggcctctgtgacactattctaatagggttttcttcctacctttctctatcccccttattttcactggtggtttttcttcactcattacttaattggcattgcaacttaatgtaagagtcattggctttttgtcctctttttaaaggtaaaaaataattgtactgacttttatacaatagtaattgtacttttattatcccttgagaaaatatgtatgtatatagataacagacatattactttggtagagccatatcattaatatacactgattttaaaaacacttgctttgaaagatctcactttactatcttctttaatcatcacaacaacatatagtatgattggataagtatgaggcagataaaatgaagtaaatcttgcaaggaagcaataatattttataaatttacctgttctgaagggtacttttttttttttgaaatggactcttgctgtatcactgctggagtgcagtggcatgatctctgctcactgcagcctccatctttcgtgttcaagcgattctcgtgcctcagcctcccgaatagctgggactacaggcgtgtaccaccatgcccggctaatttttgtatatttagtagagatggggtttcactatgttggccagctggtctcgaactcctgaccagttgtcaggagttgtcaggagctgatgaggtgtcaagtgatctgcacacctcggcctcccaaagtgctgggattacaggcgtgagcccctgtgcccggcctcaagggtacttctgaccatacctaaacttaggcagtaactttagatttgccatgctctataagtttttactcctccccatgtacatttgaatgatattacatttatagggaaaatagtcgccactttattttggtgtagatgtgtttattacttgtgttaactccagatgtaaagccaagtgtaaaatagctgatggagccttcattctgctggctctgtaaatgtaatagatgtgtgatcacaggcaagtcatttatctgtctgcagtatggtttcctcatctatcaaataggcaaaaaatagctcttaaaaacgagtgtcatcaatcaaataaaatatggtgtgtgtgaaaaatctttgtaaagcataaagaacccatgacaggcttcactgtcagccatgcctacctcatataacaaataacagttaaaattgttagcctttagttatcaaagcatatgtcacgaattcagttcatggggatccttgcccacttatggataagagggtaatagttggtatttaaagaaaacattaactgcagagatatgatacagatatgtagctatagatatatctcactgaaatttatatgagtcagaggtggagaatatccaagccatgttaccatcttccagtatccacttcttatgggctctcaaatatcggacctttgcccattgcctaaactgcagttcatcttgccaactggttttgttttgattcctatttattatgtcttaggctgtaatctcatccagacctgattctgagaccaagctctgtgtcttcttgccttacttgctgcttttgacctcttaaactagagcttatcattttaaatggcccaacttgattacactgtagataagactaaatactgtgactctgagaaaaaataaactttatttgtgcgacaaatta

SEQ ID NO: 5393 - DNA, 383 bp, Homo sapiens
ggcaaggaggcaaggaccccgtctctcccacggatggggagagggcaggaggagacccagccaagtgccttttcctcagcactgagggagggggcttgtttcccttccctcccggcgacaagctccagggcagggctgtccctctgggcggcccagcacttcctcagacacaacttcttcctgctgctccagtcgtggggatcatcacttacccaccccccaagttcaagaccaaatcttccagctgcccccttcgtgtttccctgtgtttgctgtagctgggcatgtctccaggaaccaagaagccctcagcctggtgtagtctccctgacccttgttaattccttaagtctaaagatgatgaacttctgcctggtgcctgt

SEQ ID NO: 5394 - DNA, 1767 bp, Homo sapiens
aacatgtattttaccactactataacaaccctaatccccttaaacttaccaatcattactaccttagccaacccctgcaaaaagattcatacccatactatgtaaaaatatctattgcatgcacctttattatcagcctcatctctaccacaatatatatatttatagaccaagaataatctcaaagtgacattgaataacaatccaaactcttaaactctcactaagcttcaaactatactatttctccacagtatttatcccagtagcgctatttgttacctgatctattgtagagttctcaatatgatatataaactcagaccctaatattaatcaatttttcaaatatttactcattttcctcaccaaaatattaattctaattactgccaataacttctttcaactttttatcggatgagaagatgtgggaattatgtcttttttactaaatggctgatgatacggccgaacagacgctaatctagcagccctctaagcggtcctgtacaaccgcagaggcgatattggctttattttagctatatagcatgattcctcttattctccaacacatgagagcttcaaaaagtatttattctaaatcctacctccaatccctttccattaattagtcttctcctagcagcagcaggaaagtcagctcaatttggctttcatccctgacttccttccaccacagaaggcccaactccagactcagccctactccactctagcactatagttgtagcaggggtttttctacttatctgcttctacccttgaatagaaaataacctattattccaaaactttacattatatttaggggctatgaccaacgtatttacagcaatctgtgatctaacacaaaataactcaaaaaaatcataggattctctacctcaagccaactaggctttataatagtcacaattggcattaatcaatcacacctagcatttcttcatatctgcacccacagctttttttaaagctatgttatttgtatgtttaggacccatcatccataatctcaatgataaacaagacatctgaaaaataggaggactattcaagactttacccttcacttcctccgcccttattattggcagcctcacacttacaggtgtgcctttcctcacaggcttttattctaaagacctcattatcgaaatcgcaaacatgtcatattccaacacctgagccctttctattactcttattgtaacctccctaacagctgtctgtagtacctgaattattttctttgctctgataggacaacctcacttcacaactctgattcatattaacgaaaataaccccttcctaattaactcaattaagcatctaataattggcagcatcttagctggattcctcattaccaatagtattactcctacttcatccccccaaaaaactatgccacttcacctaaaactcacagccctaggtgtgactgccttaggcctcttactagcaatggagctaaattttataactaacaaccttaagctaaattatccattacagacatttaacttctccaatatattaggtttttactagccacaatccaccatacaaccccccacctcaagtctatttacaagccaaaatctggcctcacttctactagacctaatttgattagaaaagtccacaccaaaaaccatttcacaaacccaaatatcagccaccattactgtatctactcaaaaaggcctaattaaactttactttctctccttt

SEQ ID NO: 5395 - DNA, 574 bp, Homo sapiens
gtggtttcagagctcccagaactttgcacataactccctatgtcagagtgggcagaaaggatggaatgtcagctctggggagaatctaaagatccaaggaactgagctgtgaaaatcagctttgaggtcttcagttatttgctggacaattccctgatgatattaaagcacccagtagaagaatgtgccttatcaaaaacatatatcaatcatgatgaacctttaaaatatattagttgattgcttacggctgttttagactaaaagaccaacacaaaatggtaagaatagactagtagtccttatacatgctaaataacaatcaagagttcatattaatgcacgtaactttttgcagttattgtcagaagcatactttgtgcatacggcatccattcttaaacttttgaccttcacagctacagcatgtctattgtctttacaactccagttttctctcataaagacctaaatgaccttctgggtactatataagccccagactttgaaactggctttacttacatactataatagatattttaataaagaccagtaagatacataaagagaa

SEQ ID NO: 5396 - DNA, 16111 bp, Homo sapiens
actctcctgcctgggctgctgctcaacgggggctgggggtgtgtggggcgggggtggtctgtccagtgattcagccacatgtgatagatgaccaagtgactgctttcttggagtccgcacaccagtggaagactctcaaagtggttgtgaccgacttgatcaaactctaggcttcctgaactggaatgaaatgcagataactctttagaaaacttttgtaggaaaagcgcctcgtgtgatctggaacaaagacgttttataatcagatttatcaagctgcgaagagggagttttagtgaacggaagcagcagcattctgtcaccaggaaatactcctttatccagaattggtaagtgaaaagtggcattgctccctaatagatatcatatgcgtgtgtgggaattgaaaaattgttcacagacccctaacaactgtgttgaacagagaacacataaacagtgaggagttctaaaaaagagcagcacgagaataccgcataaagactgagaagaagccaggtaattaacaaaaatgagctgagtgctatcagtttagctaaacatatgtaatacagctagatttggttgttttattttttcttgttagtggaggagaaacataaaatcagaatgggctgtttagtagaattgcgacattaactttccatggatgtagatttccatttagtctgaatagcatgtatgaaatttgaagggatgctttcagaattagtctacttgccctcctttcctttcctctgcattaagatgtcaagtatttagttagaaccttacaagatgaaagttgtacaaaatgaaagttcaagtaatgcgtcggaaacacctctcctgattgggaagggtagattacaatggcaatagatttttgttttttgtttcttacatttgtgtcacgaattttaagtttgttctattggattacattagtacagcaaaaggggggttatttctatctatatggttcatgacattttgagaggtcgtgattagtagttcttactggtttcgtatgcgtgttcctgcctgttgaattcagttttctaatcttgaatctgagctgcctttatgttaaagggttctagaaaaagacaataaagctttgaatacccgtgttatatacaacaggttcctgttcatgatgtataaggtaacgcaattttattttaggcatgaatgtctaatttcttgatttggcttcttaagaatatactgaaaaggttgaatagaataagaaaaagaacattagaaaagaatggtgggtgactgcctgattttactagtttcttattggtcaatagaagtaatcatgtgatgtctacttatagaagcaaatggaaaaaatttttcttctttaactgctaacaagtatataggcaattttagcaatcttcatttattaatttgaatatataattataactgttattaacagaataagttttgggtaatataggaaataataattatttctttctttttaagccaaattggaagttgaatctacttttggttcctgttctgttactttcaaaatcttaaaatccttaactcaaaagggaaaatgtataataaaacaggatagcagtgctgaaatttctctctcttagcagtggagtgggatgagggtgggggagggagatgaatctagtgagatatattaattgttttttccccctcttgtatacttggataacttttgagatcagttttctcagactagcagctctcaagacttttgcataagtatttattcttaaagaaatagaaagacaagataagcacggctcttaagggcaggtcctccaataagtcaggaaacgggtgatccaaacttgtgaacatgacaagtcaatttgacttaattaaggaatggcattagttttcttgaagcacatgaatttataggtttttagagtcttgaagacagaaaaatggcaacaaagcattaaggtatttacagataatttatattcaactgctagcttatgttttcaactctgtatttcatgtaagtaaatacttggggagaacatgatgatttaataatctggataaatactgccgtgcctgttggaaaaaagcctctaatttttaggttttcctcatccatttaaaatccattgttttgaatgacaaaatgtgatagaaacaggttggaacagtaaatgctagaaagtatatcccagaagaattaactgagaacttcatgttttcaattctatttgccgttctctgttctcaatttgttaatttttaaaagtacatcgaaagtgagtagcattgcttgctctgaattctcctctggggtcattgagagtattcacattttcgtataccctgttaaaagatattaatgccatgcatatgcctttgtctttgtgggtgtgtaaaacaacaaactgaagggatctggtcaagagacagacctcaaaataatttctctgaaatagtgtttgaatttgcatgttcgggaacgtaaatgctttccctttgggcttgtttcttaagtttttggtgtagtatacagttttacccaattaaatttttcttttgaggtctgtatatgtatgggtgtctatatttgatttgaagggggagttttaatcattagtgaaacaagtggctgtttgttagaacccagataagcctcatagtgttgttcctatgacaactgagtagttgggtgttgaaatgtagctttaagttcttggtttggaaatgtcattcagacctcccactatagtctcattgagtaggaggataatgagaaggggaaaaaccatgaagcaacataagtatctccgttcgtttcatgtcttcctgacttgtctttgtgtacaggatcgccatgggagtggtaaacataggtcttgaacaaagcaatacttcaattaaaaaaatacatggaaagggtcagaaaagttggggaagataaataacaacacatgggggcaataaagaggcaagagaaataggcttccatgggtttctgcaaatcctttatccagtgctgaccagcagtgagaacatcttgaaccagttattgtatagctcttcaagagctgtgaatttccttaaaatgcaatgtggagaaaattcctttggtagcaggatggtttaccactttggcataacgtttattcatctcccccaggcagactacagaggatactgtgttcttttaaggcacatgtttttaaaccagttgttcatttgtcatttaatagcttttgtcttttttctatgggaaagacaaggttgtactattaaaatagtgataaaatttaagtattttattctatattcaaaaagtgcttttgaaaagtacttagaaaaagattgtttgagacctgttgtttgtggaaatgtctgtcaatggagaatctatggagcactgtatttgaggagagggattgttcagactaatatttggcatagcttaattatgcagttgttgattttccatgtctgaaggtcttcctatttcctactcctaaatagttttaactatttatttggttgctagaacctcctgaagttagaaagaaaaagatttcagtggggttagtctcttaataaatatatgcccaccatctcttctgtaatccaaaaagctctgaaaatcaaaagattttcatgtaacaaatttggcagcaaatcctgacctgaactgatgtgaagctaatgatagtctttgtttagctcgctcagaatgaatctttgtatgttttactgtagaagtattaatgtgtttgatcacggagtattgttccagactcccctagaggtttatatactatattgaatagtcaacctattacctttataaaataataataataatcaatctgagtgtcaggtaagcatttgtggacccataattactgacatacattgagttcatattatatgccgggtaccattctaaatgaatcactggcatctaagaacagtgtctggcacatagtaggtacttagtagacacgttttggtaggaactgctttacacttattaaattctttaactcacaaaaacagtatacaggaagtagcggagccaagatttgaaagcagacagtctagctccaatctgctcttaatgattctgatgcaggtacaagagaggactggagatgtggcactggacttcttaactgagtcagagggggtgtttgagtgatttactttattcatagtcaccctatacctcctacgatcaagagctggtggtatcaccactatggtcattagccggggctgtggttgaatgcttataacaggttctcctgggtgggagtgtaggaattccaggggtctgaactctcctcacaggcttcccaaggtgatctccatcagtaaatcagcccgactttttcatcttgaaaaattaagacataggaaataactctttccttaaccctaaggaagtttccttgaacagtgggaaaaacgtttttgtagacattccttagaccccttacccagcaggaggtgtggaatcaataaagagggcatgggtcacctccaaggttgtgagctccctggcttgggaactacactgggacacagcagagcctcttggcagaaatcaggcagcccatggagcttcagctgcatgactctttgaattcacaaaaggatacctttaacagtacttctcaaaaaatgtatataaggcatgtctcaagtccctatatgtttctagggataaaaaaattcatttcaaactgatggcaacctccccattctattccccagctttctatccttcttcctgcttaatttttcttcttagcacttgcctctgtctgacatattgtatgtcttacttatttattcatttgacattttaattagacactagcagtattgttttctttgaatacatttaaaggtcctagatttatttctttttgatgctcatcttctaactcattccctcctatcaatctcagactgctgtaaataaatgattttttgccttttttttttttttttactattagttatcatatttatttttcttaaacaagctgtactggttatacagtctgaatttggagaatagacgtcttcattcaggaggggaaattgagccaagtttgaatataatcattgggtaacaaatccagaagattaagttactaaggagaacatgcaaagtaaacacttgcattttatgaactaccttcaatttaaatagacaactgggtaactgtatatgacatgttttgggagtaagacctgttaaacctacctacttcctactgttttcatttgaaaaataaatcaattattaaacagttattctacacattaaagactgtaagtgatttaaccttgaatatttcctgactcaagttcttaaaatcctcaactctaacctcttgtttttcaaccccatatttattctagtttattctttccaacatatttagggcaatctaaaacataaagtaaaaaaacccccacatatattattaactataaacaatgtggttatgtaaatgcatcattttagttgatcttttttctttagcctagttctttttttcttttcttttctctctcttttttttttttttttttttttttttgagacagagtcttgcactgtcacccggcctggagtgcaatggtgtgaccttggctcactgaaacctccacctcctgggttcacgtgattctcctgcctcagcctcccgagtagctgggattacaggcacacactgccacgcccggctaatttttttttattttttatttatttattttttatttttagtagagacggggtttcactatgttggccaggctggtcttgaactcctgaccttgtgatctgcccgcctcagcctcccaaagtgctaggattacaggtgtgagccaccgcgcctggcctagactaattcttaaaggaacagattagatacatacaaaagttgaatttagtatgcttttgtaagttaatataatgattgggacattttgttttcttagctatgctttataacaaaatagttctagttactttcttttaaatggttactaaagtaataacttgctttttaaaaacatagtataactatttaaggtagactatgaagagtaggctgaggtttcattttaaattatctcctctttctgccatggaagagtttaattcccctgatgtgcttatggtattgaaagcccattgttggtgttggtattgaaagaaagcttagtttttctgcgtttcctaaaaggagagggaagaaagatttttaaaagtgaaaatccattgatttttttttttcttgattaggatttgtataatatatctgaagtgagactagagttcttaaagttgagagaaacagtaaatatgtacacgcccggcaaaactttgcagggaacattcagagttcggattacctgaaaaaaatcttgaaagcttcagacattttccagagagtgttagtgcgtgaaagtggtacccatgaccccaagagggtgtccattcacagcctccattgaagtagtttactccctaagaggcccaggctttggaaataagtagatttgtgctttaagctccctttgccccttgctagctgagtaagctactccgctatttccctgagccccagagtgtagagcatcagaagtagtgcacaggtttgttgtgtgagataacacatgtaaagcacatgctgtgggacctggagtaatggtgcttaacacacttgcattcccttccaaaatccctttaggaacagacttcttcagtttagtcctaaagcctgtagatccatgctaagtgatatgactttttttcacatcagattaagcaaaacactgatgatggtgactgtcgcttattgtgcagttaccatgttctggacaggcactgttgtaagggctctacctgcatcgacccatttttcctcatgacaaactattggtgcaattatcatgcccatttcatagatgaacacacagaggcacagagaggtaaaggaacttacttagggccactcatctgtcatggaaccagaatctaaatccaaataggctgttgccagtacagatggtaagtacatgtacttctggcaggaaagcagaataaaagttgactgaacctgaaagtctcggaaatggtcttctcatttctattctgtaaagtgtcacgtcttctaggcctacctctgtcaatattgaaatacaaaattaactttttctgctttttatttcacaaatcaacgggaacagtcttagtcatttgtgttttatgagttttaattaggccactgcagtccaggaggggaattccttgttttcagttgatctcatatactaacaagtttaatcatgtaacttcccctatttttttctctaatgttttcacttgaaagtgggggtgggagggagaagtatgttagcatttgagtcctagggatgcacttacatcaacctttctggaaattccttcttgctggtatagaactaatccatagaaaaatgaaatgtgtaagaatctgtatttactaatatttttcttctttatctccatctagttctggatattttctggaggatggggtaaaacttctagataaagaagtacaggaagccatctatgtgcataaaaccttatgtttgggtgtggacttaattttcagaatatgggaaaggggtttcacattgagaatttcctctttctgatgtagattgagaattttgacttagaagatgagggcatgttatcctagcccgtgggttcagagtgcttggaagtctctttaaaaaaaaaaaaaaatcccctggccttggactgagcctgctcttggaggatttattaatcatgccggccttcattctttcctttgtttgttcattccttcatttgtccatactctcgcataagtcattcaacatctacctgcaaataggtgaaagaaaggatgggagtgagagtccatcaggggacgggagaggagaagcaataaactcactctatgttcctttcacctcactgactgcatcttgtatctgattgtttgtccctttggagacaacgtatatttcacagacagacactcacaacactcatgaaggtctttaagcatcttcctttgggagctgcatttctttttttaaagtgagaggagaaaatgcttgtgagggaaaaacagtgcagagaaatggtttttctttctttctttttaatgttggcggaagaagggttcatagtagggaacgtatcagtaaatataatctaagagcactcatgctttcaaataatttccttgtttaaagatattaagtgcagtagcgtttacaattaatgatcacaaccagttacagattgctttgttctttctctactcctgctgcttcacctgcctacgcttataataaaagaacattaagagacaacaaaggccatcacaaagatgtcttcaaaaataattttaaaatagaattttaattaatttaaaggtaagaagtgttgccatgccctcaatcaaatttattatgactttttgaaaatatctctaagtaaatatatagaaaatgaggaatgaacataggggagggcttttggaatttatactactattctttcaaaaaatattactcgtctccatgttgcagttaggaatacgcttccttaagacagagtcattatctttacttgttatttaaatcttgatatcacctcctatagtttttgaaagacatcactcttcaagttgtcttcaatggcacaaactatacctgtgcattttctgaaacaagtttgaccataccagcaaaggcaatgaaaatgctttgtctttcagcatgaaatgtgaagtctacattattagtgggtatatatggcccaagggaagaaaatgttgaagtagatttaaaaacaaaaacaaaatcactcacactctaaaagaatgtctcagtatttcaaggctcttctctctctctgtgttaaaaccaataaggaggcctcaggacaagttaggttgataatgacagtgaatatctacctttctccccattccgtttgacatccatactccaaaagaccttcccttatttgctatgcatgggtagcagggagattatagagaaactgttctttttcctgctttctttttttactgctgggggagtgatcactttcctacagctcttgtccacctggcccttgaggcgtttggagttttggtaaggtgttaacaaaaattgtctcaggtgccaactaaatttcataagcttatagcagcacaacagactaagacaccacatgggaaatgtacattttacaaaaatatattatacatctaccatgtctaccatgtgccttagagagttctgggtctggtaatacagcagtgaataaagtccccgctcacatggagcgggtaggctgatggtgatggaactcataagtatacggcaggtgttagtaaacactgcggagaaaaataaagctgtgtcagagagagagtacctggggatcaggggtagagcgacgttaaccagggctaataggaaggcctctttgatgttattaggccagtgaggaatcagctgtgggagtgtctggaggaagaggattccaggcagagaaaataaaaaagtaactgcagtagagacgggagcaggctttgtgtgtccaagagacacatcatggcagatcaggtaggactctgttggccacagtaagaagctgtttggaaggtaggaaatgataactagagagagtgaagatggtattctgagagtctatgtgatttattgtagggatcccggagagtcgagccccttgtgcctcataactggagtgtttacaagccgtgtaaggccttcttgcagtaaaatgctacttttgtaatttaaattattatgctatgaaaaccttagcaaagatagataaagttgaactatttgaagcacaattacagctaaaaagcgcaaagtgggcaattcttcctatcacatctactcctcagagagatgtggggtacctgaatgtctaactgtggaatgttttgatttgatttaaatttgccaaaaactcatcttccataaggcatatctttgctgatttttgcactcagtaacaagcagtttagaattttgaactgaagggattttaaatccatgtttaaagtgctttcattttaaaataattcttagttttatgttcagtcagatgataagctcctttttaaaattctgtatgaaaacttactgtttggtacaggttaagaagtcttgttatacagtacttattttattggaggtacaaagagagtgtggaaaaataaaggcaattggccaggtgggaagggtaaaattgttttatgtaccttttctcttgtaaagttgtgttaaaaacatttttgtaatttcttaaaggtagagttgattgccataatttgattgcagccccctgtcattacttcactattatactcggatactaaatgccccttactaaatctaaggaaatgggcaagttctgtcatctgggagtttacatgttaagagacattgcacgggtgagaacagacataaaatgtatatgtaattatatcgacaacatacagggcttagaaaggggcttgatagccttttataggtgtcgtccaggtttatcttacttgaaatactgcctgagactctatacctaattcttatcacatagcctttctattagtcaatgatagatttgggttgggttaaccctcatattcttttagcaagggacccacctgcagaaaagagttattattggttttgtcatttatagtttagttcaacaagaccggatttcctcaccgcctttggctgaaactgactgactaaatcagtttcacttgtggggtagagaaatgagtaatttgggaacatagagtgttgtgtggaggagagcttagtttgctcctcttcatcctccccttaggtaagaagtctgcattgagagagggagaaagatttgggacatcatggggaaactgacccccttgggtgagacacattgggaattaagagaaagatgtaaaaatggaccaggagaggatgtacagaagccccaggggagccagagaatttctggtcctaagctcaagtgtcagcctcagttctgcctagcatcttggacatgctgtccctgctggcttatctcctgtaagacaaggggcatactcctgacttactgagcatcccatctcagaggagctgggagtacaaggaattcaggaatggactttcaagacaacatctaacccgagtcttctgcagacatttctctactgaatctactttctaagtgtagattagtgtctaagagatagacattaagtttctttttctaccagcctctgacccccttgctttgaggaaaacacatgtgttgtccacgaagtggtgagttctgtttggtccttcctctaagattggtccggggcttgagccgttttgccccatgtgctctgggatttcccccggttgtccccccatataagtagacaacttgctgtctgtgttctaagaccttcatatttttccctttgacttgagtctgttctggaacaattgtgtggtggctgggcactgcaaaatgagtcagttcctgcagtttggttacaagttctcaaaaagtatttcagaatgtggatgtggtcagcagagtcattttccagacatctaaaaggaaacccacatcaactgtaacaattgagctacgaaccgatggctctacacaaccgaatggggcctgcttttcctcaaagcctgtaggtgccctcaaatctagcattctctatggatcggaaaggagaattcatcttcatgcttgtagatcacattttatctgttactgttgacataaaaaaatgcgatagaggttttggccttcatcaccttttgaatgtgggcacaaatttgacataagaaataattagtaaaatggaatctatgggattagagtataattagtgcaaagtgtgaaatgtggcttagggatagatgcttgggtaattgaactaatgcacgaaggagaggttaagatggtttgggtaccgatagagtacatcgaaatatgcttatttggtttactaatagtctgaacctgtgcagacttagcagcaatactgataaaatatcattaaatccttttcaagctttaaaagaagttcagatttgtcataacatttggagaatattttcgctccacacaagttttggaaaataatctttgtgaatttttttatcctcttgggtatcatgaattgtaaaattttgttgcagttctcagttaccagtcttgctccactcattaaaactgatggcattttcaataataagaaaacaaaatttaaaaatgggtaaacgatttgaacagacacttcaccacagaagatacgcaaatggcagataagcacaagaaaaaatcttttcaatgtcattagtgaaacacaagtcaaaaccacagtgaggtactgctacacacctatctgaatggctaaaatttaagaagccagccatgccaactgttggtaaggatgtgtaggatttagaactctcatgtaaaatgatacaaacatgtcaaacatacacctatcatatgattcagctgtttcactcccagagaaaagaaagcatgtgctcacctgaagactcgtacgtgaatatgcatagtagttttattagtaatagctaaaagctggaaacaatcctaatgtctatcaacaggtaaatggataaacaaattgtggtgtatctgtatgatggatactactcaataataagaaggaatgaactattgataccttcaataacatggatgaccctaacccatgagagtcatatcatatgattccatgtatacagaattctggaaaatgtgaaagcagatcagtggttacctggggtaggggagatgggggtggcaagaaaggggttacaaaaaggcccgagaaaacttccgggctggtggataatttctgtcttgtgttgatggtttcatgggtgtatatatgtcaaaacttatcaaattatacaatttgaatatgtgcagtttatcgtatgtcagttattccttaattcttaaaaaaaacttaaaataagaaatcattgttatagtagatggaaggctttaaaatgcccttatttggcaaaatcagcatttcttggggggaggggggaacctgatagagttttaatggtttgaggacagaaatacgaccttctagtacagatgagaaaccaaagttaaacagtgaacataataaatgggatctctttagtcccttttgtttacaaagcatttgaacaagtggttcaggaagtatcttttccagcatggtggttccagctgcctgcccgacttctaagcattagcacttaaacaaacttactgtagcagtctaccgtgcaatgtggctaagacatccaaagttgctgtgttcagattgcaaagataagacatgaaaatccccactttcagattctatcattgttggagaaataaatctctcatatttacacagtgcatgaaaatttatgtatttccagctgtattgaggtataattgacaaataaattgtatatattcacagtgtgcaatatgatgttttggtatatgtatacattgtgaaaggattaccacaatcaagctaattagcgtatgtatcacctcacatagttatcttttgtggtgagaacgttttaagatttttctctcttagcaaatttcaggtatatgatgtagaattattaactataaagtattttcataaacctcatcctgtgaaatcctttcaatggtcctattacaggtaggatcagtattatcctcgtttgctttggcagcaaactgagacccagagaagccaagctacttggccaggaatacagagcccccatcttcttgctcagaaatcaccattctaactactacactttgcttcttcctcaaactattgtcattgagtgtttggctaagactcttcactcaccaatttgtcaggtagttattagagttcctttttaaaaatatgagatgttcaagatgataattccctctaatcctctgtttccccgtttctaaatgggtaataacacagccaccagcttcccaagtttgtgacccttacacgtggaagagtcatgaaaagtgggcaactctgtgtacccagtgggtgttgatgttactgtgtgactgccctctttgttcctgggttactgatcacacagtactgagtggctttgcaaacccaacagggagacatagcagtttagttaacattagttgccctatagcttccttcagaattggaaagttgcacaataagaaatcctatgtactggattattttaaattcttctttaaaggacactaaaccatcattagttgggtcccagagactcaccaaacagagcttagaggcagataccattgaggtttacttagctaacaagattgacccatgtctggcatcctccttttctccttggttgtgttgcctgtacatctctcctccttattcttcatcattttcgatggccttctctcttcactagccctctaacacactttagaaaatgttttgttttttttttaaataactatttgatgtattggcaaaatgagcagttttcctgagagttctctgtctgtcccgactggcacttcttttttttttttttttttttcttttttcatatattgatttcttttaaattaaattaaattttttaaaatttctgttggttttgggggaacaggtggtgtttggttacatgagtaagtttttcagtggtgatttgtgagatttgggtgtacccatcacccgagcagtatacactgtacccaatttttagttttttttttttttgagacaagtctcactctgtcacccaggcaggagtgcaggggtgcaatctcggctcactgcaagctccgcctcccgggttcatgccattctcctgcctcagcctcctgagtagctgggactacaggcacccgccaccacactcggctaattttttgtatttttagtagagacggggtttcaccgtgttaaccaggatggtctcgagctcctgaccttgtgatccgcccaccttgtcctcccaaagtgctgggattacaggcgtgagccaccacgcgcagccccaatttgtagtattttatccctcacccgcctcccaccctttccccgaagtctccaaagtccattgtatcattctggcacctctaaaaccagacatgatttgttttcttgacttcggcttgagagttccaatttctaactctaatggactttaatcttagaaaatcaggggatataatcatatggtagtgcaaagagtatcaaattttgtctaaggatgacaatcaaagggagccctatttttttgttttgtttttcatcaaatcctcgaatttattccatccctaattccgtggtccttcatggcattcataggggcagctgtgaagaaaagtggtaatgtacctgacgactctctcctgtcggtgtcagggttgcatttactattactgatcccagtaataggatgagtttgatctctcagcatgaaaagaatgaccatattagggatttgtttgttctccagactacagaaagtttgataaccagagtaggacttactggagagataatgtcagaatgaatagagactgtctgtgagaaatttgaacgggctcagtgctgttacctactagctagaaatgggaagcaaggggatgaatgtgaggttgggggcattgagtcaagaagaagatcaggcaattctggagctaggtaaattgggatcattcctggcttgtcacatctacgtgggacatttagactatccacgggctggataccttaggaaagttccttctggctctgggactcactgctctttcagcattgccaatttacatctagtgtgttcttgttagaagtggaaggctcctcttcatttttgagctccttgcgccctgtcattttctctgtatgagagggttttgctattcctttttgagtgaaaacgactcccatagcatattgccattcacactcca

SEQ ID NO: 5397 - DNA, 769 bp, Homo sapiens
ccacagaatgaatatattgaattacaccataaatgctataccatttggattaccatgagagaaagagaaagaaggaaagtcgagaagctcaagaatgttcaaagaaggcaaagaaaatgattggtctgaaggctaagcttaatcataaacagcgccatgctgagaaaatacaaataaaaaagaccatcaagatgcatgaaaagagaaacaccaaacaaaagaatgatgaaaagattccacagggagcagtacctgcctatcagcaggacagagagacaatctcgagctaaagtactttccaatatgattaaacagaaacgaaaagagaatgagggaaaatgggaagtccctctgcctaaagtatgtgcccagggagaaacagaagcattaagttattcaaacaggaaagagaaagaagaaggcatggaagaggatggttactgaagtctgctttgctagagatgtctttacaagaaaaccacctaaatatgaaagattcatcaggccaatgggcttgcatttcaagaaagtccatgtaacacaacctgaactgaaagccaccttttgcctaccaatacttggtgtaaagaagaatccgtcattcccgctgtatacaactttgggtgttattactaaagactgtcactgaggtaaatgtgagtgaagtgggccttgtgacacagggaggcaaagttatttggggaaatatgcccaggttatcaacaatcctgaaaatgatggatgcataaatgcagtcttactggtttga

SEQ ID NO: 5398 - DNA, 1963 bp, Homo sapiens
cccggcctgtttcctttggtttaaagtggattcgaatcagtgttaaatcagaaaatcagggttttctaggaaattgggaattagttgccagaaaggaaactgaactatgcagaaggagttaagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaatttttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcct

SEQ ID NO: 5399 - DNA, 5757 bp, Homo sapiens
ctcagttatgtctttattagcagtgtgaaaacagactaatacaataatattcttttttggtacatagtatttcactgctttggggtatcatatgttggtaaaatacaaatgttatcataatttattttgctgaaatacaaatgctattaaagaatgtgaagacatttaaccactatgggtcatgaacactttagttcttacttgacttatttaaccttaaactaaagacttggtgggggagggcaaggaggccatgccccaggaattgggcataggtctgctgtgttagcaggctcaggtgaacagagtgtctccagatggctgaggaaagggagagctctggacaaaggatgaaagagaagaggttgatgttgaaatggacttctctaggtagatacacttgggttggccctgtctggggctttgggcctctctaactctcaacttccagtataagtctaagccaagttcaaaggtataggttctggagcttctcccaacagaacaaggtcgtttccatatgactcaatactggccaaacagctagccagtaagttatggggaggagggaaaaaaaaagaaagtacttaattaaagagggaggaaattaactttattgagtgcctactatgtaccatcgtatatgcttacacaaaaaagtgtttggcaaaattcaatatctacttatgacaaaaatttttatgaaactagaaataggagggaacattttcaatttggtgaaaggcatctaggaaaaaccattgactaacatcagacttaatggaaaagaattgagtgtatgttatctgactactccatccaatggttctgttatccccactttacagatagaggagacaagggctgaaaatatcaattaacttgcataaagttatacaaagaaaattctaagaaatcaggaggctattgttaagaacacttgcaatctttaacgtcctgctaggactaaaaaattgtgtctatcctcttcctactttgaaatttgagtttgatagatagggtttcagcagcaacttggagatgctaaacaacaaataatatcagattcactctggaggctgcagcagaaagatcatcaaagatatggtttggaagatgtgacttgaggggaataaaaatgaagttattgaaccaaaattagccctgtttatgggtttgttcattcattcaataaatgcttattgtatttctactctgtgccaggcactgtactaggtctggcttatatacatggttacctcctggaaccattagtcaagaggcagacactaatgggatagtgacacagttaaatgctaaacacaactttggcagatgtcattagaagaaaatgtaatgtgggagcatgacaggaggacttgacttagtgtgtgaagtcaggaaagtgaccaaggatctgaaatctcacgaaacgaaggtcttgctaaaggttccctggcaggagcaagaaagaggagcagagagattggaggaaaggagatcaagaacagcctgaagcctgttcatgtgggggtagtcactgactgtggctttacttatacagcagcttgggaggtttgacattcaaggcaggagaagtacttgtaaagattgcccaaactgaggacttattaatagctgacaacttccacagattcctgggatggcttgagcaaacttttttgttatcttgaaggctgaatgtttcatgtttttgtccgcctagccatacagcactagctgtgtttggggccctccacgtaattctgtggtctgtatcatgtgtctgccaagtgaaaccccccatgaagattttcttgtgaatttccagatgttagtgtgttgaaattgaatggagaagagtccctcttatctctgtatattcctgggaattgaaagggatggcggtccctcttcccaacattgaaatcagccttggcttcttcaggaagattttgtaactatgacaaatatatatatatatatttttaaaattttcattttagggccaaagttctagaaagctagacatgtgtcagctgcagaaagtatccaccgagatgaatggttttggctctgctggctattgcatggcatgatgacctcgtgttcccagccctaaatgagtaaattaacctcagctaggagaaaaaatcttagctacaaaaccaaaggccaaagtccagaggactcgtcagcttcatcagtagagagtgagtatagctcaacacaaatccatcactgaaagcagtgcaaccaaggcagcggcgaggttggtgggggctgggaggaatcaacttctctaatgacagacaaggctgtgcttcacttccacatggccacaaggtggcagtgtttctcctggtactaaaatttgcccctgcttgtatgaaaaagacttattccctatggaaacaatgtctgtcatttcacattttgattcattttttttcctcaacagagaaacaggccagcatggggtaaggcaaggattaaatgtgaaatcgggtagtccaggttctaattctagctctgccgtgaactaactgtataactttggatttaccatgtctgagtttcaatttgctcatccacaaaatggagatacatctcgcctgctcttcttataattgtcaggcacaataataaactatatatgcaagtgtgatcaattataacgtaccataacactggttcttaacttttaatataagaatcacatgaggaaattttaaaaatacacaccctcaaggcccagcttctaaagatgtttcaagaagtccaggcctatgccttagagtttgtatactactacatattcatctgcaggtatcaagatgatgaaggcctagggaccacaatttgagaaactacactatgcaaatatataccagtagaaagtgagaggttaaggcacagaagtttctcttaccttttcatgtaatggtatttatttttctctattttgagtaaaagttttacaaacactccactacccttagattaactaactgagggcagaagtctatattttattcacctccttatgttcacagcaattgttaggatgttaattggataataatcagataacaatggttatctgaatctttgatggaggtaatctgtagagcatccctagcaatgtcactccatttacagggatatttggtgataggacctggcagactcaatagaattcacctgagctttgcctttgtacccccatgggctcatttttgtcacctagtaagtgaccagtgccatttagcaattgctgaatcatgggcttcactgtgctgaaacagttgtgcaggaaatttagcaatgaggttccataaaactcccggagttttctgtcactatggttatcacagatcaccagggcttttcaaccagcaccggcagtattttcagggtctttaagagagacttagcccccttactcctcagagggtgctccctgctgagctgttgccctaagagagggtctagttcaaaggtgaatatagcaggagagatgtgcagtctggcaccttgggcctgtggccagggtacaatagctcgaatgtgatatccccagcacctgaatgtggatattcaaatctcctcttaggtaacagcaaagaagactcttagcaaagttgtcagaggcagctacggaaacttgctgtattcaaatttcacattgatagagaaaggaaagtgcttaaattgaaccatgggcttttaaatctttcagcaaatatttattgagcaacagttgtttttcagcaggaaccattctaggcctttgattaaaatgtgagtaaaatatccaaagactctgctattctgaggttgagattccagcagcaggagatggaaaaataataaacataatgattacataaaatactttatgttaggaagggatatatgatctggtaagtaatgcagggtataggagattggggagaagtcagtgaggggaagaagcaaggtgtattattaaatagaatggtgaggagaggcccctgtgagattggaacaaagacttgaagaagagttgttcaaacagagaaaataacaagagcaagggtctagggccagagcacgccaggcactcaggaggcatagcaaagatgccagtgcagctgcagtggatgagctcagggagatcacgggaatccagaccacatagacttggtcctactggaggacaaggattttgctgaaggtatctttgtatcctcaaggacgaatattgtgttttgcttgcaccagaggctcgaatggattggcctcaggataggataaagccttgggggaggttgtgccacaggaaagagctgaaggtctagccttcagggaatgggcacccctttgggaaaagagataattcacgagaagtgggtatagtatgcatgctggagtcaattgcagtgtggagagctgcagaagagcatttgctgaattagtgggaccctaaatcagtatggggaaaggtccccactgcagcactttctacacctcatcctcctatattctacttgtgcctgtggccttttctccaccccgccccctgcccactcagcactcaactgacctatgcataacaccttagtcatcctttcactgagaaaggactttcttaagaacttagaatgcggaaagtccctttctccttttcctctttttgttttcaattgagatgaagatcacataacataacaattaaccattttaaagtatacaatttcgtggcatttagcacattcacaatgttgtgcaatcgccacttccatctagtgccagaacattttcttcacctcaaaagaaaatccattaagcagtcactccccacccctccctctcctcagtccctggaaaccactaatctgatttctgtcttaatgagacgaactcttccagatattttatgtaaatagaatcatattctgtgtagccttgtgtgtccagtttcattcacggaaatgcgtttcttaactctaaaaacaatccagtaaagatgcaaattttaattactgcacagtcaggaaggtaatgcagtggcagctagttatgtctgatggcagcagtccaaggctttcaagatttcttcagcttctgaaggtgacatgaggaaaatgaaatgtacataatgcttgtcagacttctatttcctagagccagtaagctttggataaagatccagaatatggacgacatcagtaatagctctgatagatcacctcacagccttacctcatgttccgcccttaactgtcaataacagcaagtgttagaacaggtaagtttactgtgctggtttcctgtggagggtgggagtgaagagaggtttgaggttgtcttattcttcagtctgggtgtattatcatcagtccatgcaagaacacttgaaaacattttttcatttatgtattttattcccagactccacttctattggcattcctaataggtagccattctaatgtatttaaaatgcacgtttctctttgtgtgtagtaatgtgaactatttattgctgtcttgtgtacctacatttttttttttttttttgagatggagtgttgctcttgttgcccaggctggagtgcagtggtgcgatctcggctcaccacaacctccacctcccaggttgattgtatgttaacatatctcatgatatttccactcaatatgatgttttgaagatcaatccatatatatgtacgtaaataagtcaataaacttttgtatattaacctgtat

SEQ ID NO: 5400 - DNA, 3218 bp, Homo sapiens
aatcaacacagtggaggcgagaagtctggccttgcgccggccggggagcttttcgccaaggctcctgtgggatgggatagcttgttctctgggctgcaggaaccaaaacattagaccaccctttctgtgaccttgggcatgccgccctcggttccgagccgcaagtctttctttcggggaaaatgaaaaggggtcaagatttggaccagatgacacccaatgtcccattcaacggtcgcattctgtcatccacaggaattagtcctgtatccgaaacattctctggagcctggagacagatggaggggaagacagaagagagattaaggagaagaatggtttcatttggaaggacactgactaaggaaaaacagagaaaaggatgaaacccaagccaactctgcaactctattaaaaacaccaagacttcaatatgaacctggcatggtgggcacagtcgggcactgcaggcggcttgcctccagcagaaggaatactgctactcagctctagatgattgccctgaagaaattcatgcccactgaatctccttaaagggaggcagtgcattcttcatggctagagcttcagcagctatctagaaccatatggtggaagccacttactgagaactgtgaaacaagagcctgggtccctgacatatgaagccaccatacctaccttaaagtgtctttcacttgagggaaaaatacatctttcttagagatttgaattttaatgtcccagaaatataaagaagatggcattaaaatgtcctatatgttggcagtcctaccctgaagactttttttgcttatcttttgttctgagctacagtcttcgcagagactaaattagtgactggacaacagaagaaaatagaccatcctggctaaaatggtgaaaccccatctctactaaaaacacaaaaaattagctgggcatgttagcgggtgcctgtagtcccagctactcgggaggctgaggcaagaaaatggcgtgaacctgggaggcggagcttgcagtgagctgagatcgcgccactgcactccagcatgggggatagagcgagactccgtctcaaaaaaaaaaaaaaaaaaaaaaaaaagaaaatagaaacgggaaatattcatgtcagctgttaaaaaccagttttgtaaagcaaggcctaaaagtcctatctctggcatgtttagtatggaacgtatagttgattgtcattcagctactagagaaaggtattctacaatggcagatagccttatcaaaacaattagccggctttctccacagggaatagcagtggggtaagtaagactgaagtgagagctcttatcagttttctcagaaatgatttctccatcataggtatttggccaactggttaggtctagcatgaacatgtgatttctaaaacaatgagctgagatctgctaacatgttgtaaaggagcatctagtagaagctgatctctaagcaaaatcaccaatttatttaagtttcaaaaattttttttccataaatatgttctttaacatgcacattctgcttacattgtttagggtgctttttattgtgcctaaaaatttgcaatatggtgaaataaaatatttaaaaatggttgaataccatacggaagatgaaatctcatatttatagcatgtaattcaattctcatgtatgcataattaatcaaaattgtgtctttaaatgacatcttgacattttttgaattgcactaagaaacactagtgtctaccattcattttaacagacttatttatgtttagctttattaacagtataacattttcatgcaatcttaaattttgttttaatttttacaatgtttgatttaattcaaattaacaaatattcaagcctacatgagagacaaatgaaatgagactacctttatatataatcagcaaaattctttttaagagtaaaaagttaatattgggatttaaaaacctaaatttccaatgttactgctgacaatccaatccaactatatgtatattacttaggccacaggactgcccattagtctttcttgtcggagagcaattaatctcttgaaccatttttcctcagcatcagctttctcgataaataactgaaataagaaaagaaaaagaaaaaatgttactgtctcccaataacttgaatttgacctaaaatgacagaactcacctttgtagaatatatctctcaacacaagatttggatactgtttaactcttgatgacctcttaattgatgactatctatttggaattagtaatgctcagaaattcttggagtaaaagaactactagtatcaacatcattgcttaacaattttgtaccttatatttgtgaagtttatttcctataacttttccaaaacagcagaattacaacatttcatggaagacagcaaagtatgatgttagtgatgtgctcactgataatgaacaaagtagagctcagaaatggaacttttagtgctagatttttaaacaaacacttctcatggtgctgatcaattcagctaaaaaaaaaaaaaaggaaaaaatgcttctctttgtctatttttcttaaccatagacagaatacttctacaggttaggcaacatgagttggaccctactgtattcaaatatagataacagttctaaaggcctgggggccagatgcctatttttagcaagggaatatgaacctgtttcctccaatggtctccttggtgttagcacaaaaggataacagattgaaataatttcagtaaattagacttcaactgacattcgtaaagtttaaggatattacatttggatgggccagggaattgtcatcttggtacttgatagcagtagggatgctggtaggatctatttctttttcagtactgggtggatcagcaactgctgatgctggtcctgatgttgaagttgcttgtttcacttcactaggttccactgactgaaagaaacaacacatattaatttcaacacaatacacaattagagttttacttcaaaaatatttctgattttgaataacaactgttcaattagtctcctttgagatgatacccatctccaaaaaggccctactttttgtatttgtttgttttagaaatacagttattttatttttatatttgtttgtttaggaataactatatttaggaatatagttatagatatatagaaatagaatataggaataac

SEQ ID NO: 5401 - DNA, 2141 bp, Homo sapiens
agtccggggcgttggggagggcgcggctggacctgcggggctacaagaaggcagccggacccccgcaccgcaggcccggacctgacaggaccgcgacccccacgcctccgcccccgccccctcccatcttgcggctgcctccgaggagggatgggggagagggcgcagtcttcccgagcgtgtgagccgcgcctactggtactgacccctcgggcccccgccgctgctcgcccaggttcctggtcagccggccccgaccccgctcttctgtctctgccgccgcctcggagagtctctggcccttctcgctctgtttgtttttgttttcttctacccagtaacacgggggcgagagggcggcgcttattggccgaggccgggtggtcggctggccaatcgtggcggcggagccggagctgaggaggaaaagggagaggagtgaaacggtttcatcatgttgtccaggctggtcttgaactcctgggctcaagcaatcagcccacctctgcctcccaaagcgttgagattacaagcgtgagccaccattcctggaccctcgtagtttttctggagcctcgtgatttgatatgatcttcctgccgctgattcctcacagtgttggcttgccacacctccaggggcactgatcacattctacctggcattatttcatctgagtccctgtcctagcccttctgcccattagactgtaaccttgtttagggaaagacctgtgtcttactcatctgtgattttgttgttgttgttgttttgagacagggtcttgccctgttgcccaggctggagagcagtggtgcaatcttggctcactgcagcctcaacctgttggggtcaagccatcctcccacctcagctttccaagtagctgagactacaggcctgtgccaccacacccagctagttttttgtatttttagtagagatggggttttgccatgttgcccaggcttctcttgaactcctgagctcaagggatctgcctgcctcggcctcccaaagtgctgggattacaggcgtgagccactgtgcctgacccactcacctgtcattgtagtacttaagatgccttgttcatttattgtgcctgtgcaataaatacaccttgatttgagtttacaaagattctcagcagttggtggtcatcctcatctcctgggcgggggcctcctggtgtggccagtatctgaattagtctcataactcatgttcactttttaaaatcggagcttcccagacctcagttttgttttgttattttccattatctgcagctgtctcctttcccctctctcacctatactctactgatcagtgactgctggctcctttgttacccatccttctctttctccacattttttctcttctcatccctttcagttctggactgtttccttcttcctccctgtctttcatttagtcattcattgaatgtacttactaagcacatatagcataatcaggctgtgttgggtaggcatcccgagttctatgagataaagaaagaatgggatatgattaccaattttaagaagcatctaaaacaacctgttatgttttagcaaattgcccccaaaggacccattagggaggaaaacgttcatgtcctttttgcgtatcatctcaagcagtacccatgatggctgggatcccagaacccacctttgagaatgctgccgtatttgcgtgtggttgacaaggttgggccagacactcaggaaatagggttgtcgtcctacctcccccactaacttcctgtaagaacttcagcccctctcaggacctttttctttaccaataaaattcagaaattgggctcaatcagtaattcccaagttattttccaaagaacatgaattttgtggaactttaatagatatcatgcaaaaaaaaatgtgggagggattgttccatggtcaaatggtcttggaaataactcgtttaaacaaaaataaaactgtttctttacccacaactcttctcagtggttttttgtttgtttgtttgttttttgagatgaagttttgctcttgtcgcccagtttggagtgtaatggcactattttgactcactgcaacctgtgcctcctggattcaagtgattctcctgcctcagcctcc

SEQ ID NO: 5402 - DNA, 5958 bp, Homo sapiens
atattctggagcagctcatgggcctagcatttcacggaccatattttgggcagtgctgctacagcagaaaggaaatgggtgacctcttccttgctggtaatagtaaggttgtctgagagaagaaaggtttgaaggggggcccaaacaccaaactgcttttgagtcattcctggggaaggtcaaggtctatagtgtgccttgtttcactttagagtcaacatctcgctatttggggggaacggactttagaacagaaaaaaatagctgcttgggagaaagagtttcactgctatgagatgtcaagtccctaaagttaaatgttactgatggaagaatacagctgaagaagagctcttggcttgactgagtagctgatctctttacaagaagggatacaagccctgcagtggaactcactgctgatccttcagacttgtctttctaggtttatcctgcagaccttatcactgcatagcagtagttcacgctaacatacaactgcacatgtctgctctcagaaagcctttcacctggccaaagacaaggcaaccatgctccccaaagacgctcgcccacctttactacaaaattggtatgatttctcttcatttgtagcttttccccaagtgataattttgtatgatttaaataagctcaaatggtcttttcgaaaatgcatcgaagcctaccacccccttttgttgtctcggggcctagaatagaattaatgagagaatttaagttgtactaatagctaagtgggagttatagtggatcaaaatttggaaatttttaatttttaaacatcgtaaattagacaattcaagtaatgtcaacaacaaattatgcaatatttgatttgtcagataaccatctgccaattgtgtttaattatcccccactgagcaagtgccagaaaaacaggttgagtcatgtgttcttatctgctcctctttttactccacaaatacatgacacataatattttaaacaaagcaatttacgaagctggataatgaagatgagagccaacctgaacactggcttaagtaaaatcaatgagagtatttgctctaaaactcatacctcacatatctgcattctaaagtttttttaaaaaattgctttgaaatatctattgtagaatttctttgctgctgcaactacccagggaggtggtacagcttagtggttaattaaactctaatgtcacatttcattcattcactcattcatttaacagatccacactgaggacctactatgggccaggcactgttctaggcacttagaatacagcagaggagaaaacatatagaaatacctgggcttatgtttttgcagtagaagccagatgataaattatcagcacagtaagtaaattatacagcatgttagaaagtgacatgttatgaccaaaaaaatatagacccgagtgaagaggatcagcaggaaggctgccatggtaaatagggtgttcatggctggtctcactgcagaggtggacatctgcgttgagactggaagaaggtaagaaagttacccatgcagacagctggggtagcggcaggaggaaaagcctgtgcaaaggccctgtgatgggaccctgcctgctgtcatggaggaaatgcaggaaggtccacgtttctggctctgagtaaataacagaagaagagtaggaaatggggtctgaaagggaacagactccgaatcaggtcagagccttgtcccccactatgagggttctgacatttgtttactctgaacaaaaaaaaaaagcaagccactgagggctctgagcaataggacttggtttatgtttcagagggatcactctggctgcagtgctgagagtagacagtagggggcaaaagtgaagcaggagcacagttggggaagccaccgaaaatgcaggtgagcgatgagagtggcagcagcagaggtggtgagaaccggcccaatgttggacatgttttgaaggcttcgtggacggactgggttggagtgtgagaaaagagaagtgccctggataacaatgtcgggagtggctgccaactgggacagaagagtgtgccggggacaggtttgggagaagataattaattccctttggcctgttaagtcttgcttgagtctcagctctattaccaactagctttgtgaccttgggcaagttattcaacctctttgaaccttcattttctcaccacaaactgggataatgatacctaatgattaaggctgatgtatgaatttcaataaaacaacatatgtaaagcacttagtgcagagcaaggtaacacagtaagcactccataaatggtgatcactgctgccttttccctcatcaaaatcaccaaaaggtgatgcagaccaatttattgactgagcacctgggactaacccacctgggacttagtgaccaccaagttcacgtttgaagcctatgatgtgcagggccctcgggaccggtgctggggacagatctatacatgttagtgacacacgtcactcttacgtgacaccagtggaagaggtccaagaaaagggctctgtgaggactgctttcctacaattcctttggagattttacaaaaaagatgttccccagattagtagcagaagatactgtgttaacatcctgtcccacaaagtgtgtgaaacgagggattttcctctcagaaattactgagtcttgacagcactgaaactgctgcttgccaagttaagagtaagaggaaagaaatgtaaagacatttgaagttattaataggtcagaatttagttttttcaaaaaaatatattcaaaatgtgtttaattctgtaccctaaaatatccattgccctgaggtgggagctgggccaggggtattgctgactgaatgctctagggaaaaaacttacacagaatgtctctctctcctcctgcaggaaggtagagagaaagatggactagagccagaaggtaaaagcaaagagcaaacagtagatacaaaatctgagttctggctaggcgtgggggttcgcacatgtaatcccagcactttgggagtccaaggcaggtggatcacttgaggtcaggagtttgagaccagcctgggcaacatggtgaaaccctgtctctaccaaaaatacaaaaaattagccaggcatggaggtgcgtgcctatggtcccagctactagggaggctgaggtaggagaatcacttgagcccggggtaggggaggtcacagtgagcagagattacaccactgtacttcagcctgggttacagagcgagaacccatctcaaaagaaaaaacaaaaacaaaaaaacagttttgccaggcatgacatcctagatacttaggagagtggggtgggtggactgcttaaacccaggagttcaagaccagcctgggcaacatagcaagacccagtctcaaaacaaaaacaaaaacaaaaaaccagtctgagttctatccggtacacactgctgtgacttctgactgcaatgtcacttctctcccaggtaatttcctcatctacaaaatggaggtactcccacctacctcacagaattgagatggggccatgttgcttcatattagaccaaagattattcatgatctttttctcttcccttccccttacccttttttttttcctgctaaatttctctctataagaagaacttaacacttcatgagaattagcatgatggagtgataagaactaaatggagatcaggtttgaagtctcacacaccctccctataactgttgggcagtcatgaatctcttgagtctgagcttcctcttggctactgttacctttttggaaatcacttggtctccaccctcccagtactttgcaccagaggcagctcagtggttgcgttgcctactttctcaggaaagctctctccctcccttcttctgagtcggtgagtcacttcctcttctgaattgaaatcctagggttatttatattgtggagtaggggagtcaaccacagagagtaaacagtaaaagagggaattcatcgtccaaatgggaagtgattagggtatgagtaagcatcacagagaggttgggccaaggaaatgtttaataaaaaaaaaaaaaaaaaaatcttgctagagttattgtaggccaaccaggaaagaagtaattacatgaaaagaaaaataagtaacaagttgagaattaaaaaaaaaaaaaaatcttcagtggcattaagcaggagactaactaagcaagtcatataaatacaggaagagaaaagggccaaatcaaattctgtaacacatttttcagtgagcatcaaaagataccaacattggccaggcgcagtggctcacgcctgtaatcccaacacttttggaggccacaggtatatcgcttgagcccaggagtttgagaccagcctgggcaacatggtgaaaccttgtctccatcaaaaatacaaaaaaattagctgggcgtggtggcgcatgcctgtagtcccagctactcaggaggctgaggtgggaggattgcttgagcctgggagtttgaggctgcagtgataggtgatcacaccactgcattccagcctaggtgacagggcaagaccctgtctcaaaaaaaaaaaaaaaaaaaaaaaaaaagaaagaaaagaaaagaaaagaaagaaaaaagataccaacattactgtgtgtgagaacaccaactgaatttctctctcacattgtgctcaaactcagcaattatttctttaattacataagatctgtatcatcattgcaaaaacataccagtaaaagtttcagtacaggggtttatgccagcaagcctctttgatgttccgaagtcagagatcttgagaacaccactgtaggtattaatcaacacattgtcaccctagagaacagaggactttaatcacaattgttatctttcttcagatactgtctgttgttgacttggtaagtccaatttaaaaaaaaaaaaggtgtccttacagctaccaacgacattaattctgtattcttcattaatagtttatctcaatagtgcattcttgacactattttttgtttacatattatcagtttgaaaccaaccgcctttgcgaaaattacaacagtgagaaaattatgacagtaaaagagatctgatctaaccaccaccatcttgctttaaatttccaaactgcccttggtcattccagggtgtagaccaagctcacttggagaaatttaatttatagtttagttgataatagcccttccccaaaactaaactatctttgtaaaactaatgaaaggccaccaggttaggaggatgagaggggcctaaagtccgctaagatgtaggcacagtcaaatgattatcagcccattattctgggggtcacaagatttgcaacttccccaattgttcctataattgacatcactattgtagaactgaagactggccttttgagatgtctttacaggcttctccatttctgactatcagatggcatcacccagacctgtgactctggactcaaccagtcctgtggcccctacccagaagtggactcaacacacaagaaccattttccacacccctataattacatccccaaccacccagaccctagccccctgctcaccaaactatctttgaaaaaccctagcctctaaatttttggagaagctgatttgaataattataagatccaatattttgtttggccatctctatgtgtattaaactctttctcaattgcaattcttacatcttgagaaatcagctctatctggtcagtgggcaacatgaactcattggatggttataagttcttcataatctgctactcagatcacaagatcaaatatgattcctaattggttagagcttgttgctatttacagatatataatgatgtatgtataattaaattacgattttcataactttccagttaccttactttcttttcta

SEQ ID NO: 5403 - DNA, 902 bp, Homo sapiens
gagtgtggagaaaagagagagaaagggagagaagagtcatggaccctactttatggttgccatggatgcaagcctcatctccattcctttctactttgaacatagcaagtcctggaggctgctgggtcgtcttccagccacaaggtggctcccccaatcccttctctcaagccaatcgatgtacacctttgctgagttctccaggcggactacaattcagagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattttaccacaagagagttttgatgagaagactttgcaaaactttcttagaagtcccacatcatgccatcattgaagaacagtgatctccaatactgcaaggctttaaaaggagtggaaatattacatatttcctttttgttgcttagcaaacatgttgcatatttcataaatgtgatttttatagaagacatcataattttctacagctgaaataggcatagaaagacaaatcattcatccaattacatggaaggtctttctaaaagtctgagtcctaatttctcacagtttttcattttctgttctggagagaagctatttaacctttgggcaagtttcgttttccttatctg

SEQ ID NO: 5404 - DNA, 2765 bp, Homo sapiens
tttttgttttgttttgttttctcacttccaagtttaacatgtccatggacattggctttagtttccccaagatgagtccatgaatgaccttgttccagtatcccttgctgatttgagttcccaagtaataagcctgggaatgttttcagtgcagcagccgggagaagaagggggattcagcagttgctgttcaatgcatttactctctacctgctggcttcaaacagtattaactttatgtgctccttgtgcattgtgtttaattaaaagcagttctcttcacagaggcacttgtaggatttttttttttttttttttttgccctgaaacgaataaaacaaataggcgtctggtatttgttttgtataacacaatccccataaaatgaagagtaataaaacataattatctgtaaaggcttgttttataagcctgagaatgggcttgtttctaccaggtttttatgttcattcataggagaaagaatctctttgtacattaatatgtaacaacaataagaacaaatgcttcccaattacatgcatgaatcaaacttatcttttattaaaaaattttttttctgttgtagtaaaagtttgtcattaaattctttctgtgtaaacacattagattgaaggaaaatgttttccttcaatattctgttcaactggcataactttatgatttttttctccccagcataattaaagaaacaactttatggttggttattgacttttttaggtcagagagcactctgtggattctaaaaccgccttccagaaaagtacacatcaaacttctacgtacgtttttatagggtttgtagagctctgatccttggttaaagatccctgacaatgtctaatagctgttttgaaaactgtacctccaatctgaagctaaggttttagttttagttttagtatgtgaatatctgatgaaacgattcaatggttttgtagcattggattcaatttcagggttgggctcctttctaggaatagaggaatattcttatctcaggaaaaaaaattcagagtgtgggaagtacgaaaattattaattcaaaggtgtatttgctgtcagattggatggcagtacccacatccctaggggctcctgttcccaagactgttttcattgtttctatccagcgctgggcacgagccttgaagtggcgaattcatcctctgaagttgtgtgtccattgctgcaagaataaaagaagcagtaacagaatcatgcagcgcagtatttcatggtgacagttttatgtggttgtgtgatgttgcagagtcttgtaggtgatatctacccttttcttttgaatcaaaacacggggttttactggaggagggaagtttcagaaacaacctagtctaacacaaaattaagctcctaaatagttatcccattctgtctactacaaaactaattgcttacaggaagtagaagtacacatatctaatatttatatcctgtttgagtagtggtttctaattttagatttctaacccctttttacattatctttttgcattgaaattatactgaaacattcatattattatgaatgcaagctgaattaaatagaccaagattctcggtttctcccttcatgttgtcatctactagagaatgaacagcttaaaataagtgcatcagttcctcatccaaagggaagctgaatattccaattcaagatcactttgcgtgcttactggaaataccatttttgaacgtacttggcaacttaaagtgcccaattaaaagctctgttgaaagaggaagtctgtggatgtgcaattagtccttaggattcagagcatttcctttatgtgtggaaggccataatatgaaatcactggtcacaatagctttatgccaggtgcttagactagaaggcattttcaggatggattatttctgtactcttgctcctaaaatggtttacctaaagaggctcccaagtccataaaaatactggtgatgtcaagaaattttggaggtggcctttcacaaattttaggcagtcaataaatataactagccatgtacgtgataggcaatacacaagacttgcttatattcctagactttctattttatctgattgacagtgttcctcttcccacctttttattcatttatttatttttaaaagatgaggattgggtaccagaaaattagccagtattgtgtgcttttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaacca

SEQ ID NO: 5405 - DNA, 406 bp, Homo sapiens
agaaagaataatggcccattcaacagctgactcctacagacattctgactaagatgcctgttgcaattcccctgagcaacttaataactgtgttttcaaggttaaactcaagaaccaatcagttatctgtaaatgaatatccaacttttctgaaaggaaaaagaacgaatcaatcatctctttctactccctgtgttaagttcatctcagtcagagaaatcactgtctgagggcttgaatctcctggaaaactgtaagctacctggaagcagagatgcatattatttatttttgtatcgcatataattagtacacggagaaggtcaatgaataggagaagatgaagaaaattatttcctctttaggatatacaaaagcattgaaaaaataaagcattctaaagcgc

SEQ ID NO: 5406 - DNA, 1528 bp, Homo sapiens
atgttcatcaattgttgattgttttcaaccaatcacaaagctatcggaacactatacctgctgttcggcgcatgagtggggatagtgggtacctccttaagccttctaatttgagcagaattaggtcaaccaggaactctgctaggagatgaccagatctataatgttattgttaccgcccacgaatttgtcataatcttctttatggtcatatcaattataattgggggtttcggcaactaactagtccctctgataattgctgcccctgatatggcatttccacggataaataataatgagctttttacttctcccccactctttcctactcctacttgcatcctcaatagaagccggtgctggaactggctgaacagtttatccccctttagctgaaaacctaacacatgcaggatcctttgtgggtcttaccatcttctcacttcacttggcaggtattctattttaggagccattaactttattactacaattattaacaaaaagcccccagccatatcccaatatcaaacaccccttttcgtccaaccattcctcattacagcaatcctactcctttctctctcagtcctagccgctggcattaccacaatattaactgaccgtaacctcaacactactttttgaccctgctggtgggggtgatcctatcttatatcaacatttattctgattctttggtcaccctgaagtttatatccttattctatcaggctttgggatgatctcccatgtcgtgacgtattactctggaaaaaaggagccatttgggtatatgggcatagtatgagccataatatctattggcttcttagggtttattgtatgagcacaccatatatttacagtaggaacagacatagacacagacacatgagcatacttcacctccgctaccataattactgctatgcctactggcatcaaggtctttagctgattagctacactgcgtggtggtaacatcaaatgatctcccgcaatgttctgagccctaggattcatctttcttttcacagtaggaggtctaattggcattgtactagctaattcatcactagatattattttacatgatacatactatgttgtagctcatttccactacgtcctatcaccaggagcggtgttcgccatcataggaggctttaccactggttcccccattctcaggttatatgcttaatcagacctacgctaaaattcacttcaccattatattcataggtgttaatttaacctttttcccacagcacttccttggcctatccggtatgccgcaacgttattccgattatcctgatgcatacaccgcatgaaatattatctcatccttaggctcatttatctcattagcagcagttatgctaacaatttttataatctgagaagcctttgtttcgaaaagaaaaactataacaattgaacaaccatctagtaatttagagtgactttatggctgtccaccaccttaccacacatttgaagagccaacctacattaa

SEQ ID NO: 5407 - DNA, 692 bp, Homo sapiens
gaggacacattacagatgacgttcagggactggggaagaagggaaaaaagcaagaaatgttgagttcaagatgtctgtgaagatccaaatggctatgtctacctgccagatgggatgtataaattagtcagggctagagacatagatttgaataatcagatttgaaacacccttgtaagggtagttcagactcaaaagtatataagatgccctaggaaaatatgtagagaaagaacaataggacaaggatgaaatcctggagaataccaattatcacagaggtggaaagagaaggaatatagagacatttgtgaaagagcaattataaatatatgatagagactgccagtgtccattaatattggtgtgcctctcttcttccataaaagtactgctaaactacatatctcagcctttgcagttaggtaaagccatttgaaaatattttgtccaaagatctatgggcagaagtaatatatgcacttctaggcctggtttctgaaacttcttccatgatcctctgtgctgtctcatttttcatggaagacttggaagccacaaactgaggaagccaagtctctgaatgtctctaaggagctgcacttaggacagacactgtagtaaatatcaatattttgtgtcagaggtctaaaccctgaaaaacctacatggtttgcaccacaaaaaaaaaa

SEQ ID NO: 5408 - DNA, 1290 bp, Homo sapiens
gaacttcacatatgaagcccctctcatgtgtcaggcacggcgtcagatgctggacggcaagaaggtggccttctgcaaatggggatgagtcctcaccaggtgtgggatctgccagcacctcgatcttgggcttcccagcctcagtactgtaagaagtaagtgtctgttgtttaagccaccccatgtaatataattttgttatagcagcctacattgattaagacagatgctaagaatatgaaggtgaagaaatgtcccagtacttcatgggaacacatcccagtggcttacagaatcaaagatgaaagagagagggatacacgtggttgctggctcttccctgctgctcagatgcctggatcacttgactgccttctctatcaaaggttgatgtttgctttcgctttgttagaaacacgaatgattggctggatgcagtggctaatgcctgtaatcccagcactttgggcagttgaggcgggtggatcacttgaggtcaggagttcgagaccagcgtggccaacatggtgaaaccccatctctactaaaaatacaaaaattagccaggtgtggtggtgtgcacctgtaaccccagctactgaggaggctgagttaggagaattgcttgagcccgggaggcagtggttgtggtgagccgagatcaagccactgcactccagcctgggtgacagagcgagactgcatctcaaaacaaaacaaaacaaaacaaccaagaaacacaaatgatcagggcttcaattctgcaatgcaacaatcactaaccatttgtagagaatcctaatggcttttacattttcagtgccactgttctcttgcaaataatatgatataaccaatcaatatttggaaggaactctgagattgctttaaaattattgcatgttaataattatgaacatttgggtaatgctttttgactttacaaaatgtctttatatataagcactggttctccaccaggggcaactccctcccccaggggacatttggcaatgttgggagacatttttggttgtcccagctggggagagtgttactggcatctagtgggtagaggccagggaggctgctaaacatccgacaatgcacaggacagcctctgacaacaaactattatcccgtctaaatgtcgataatgttgaggttgagaaactcccatacgcaagatctctcggaaatgtttgcaatttttacagttattgcatgtgttagatattttcacaattcttttacaaatcaggatcccgagggtcaaagatgatgagttac

SEQ ID NO: 5409 - DNA, 3051 bp, Homo sapiens
ctttgttttctcatttttacttgtcatgatgtatgtcgaacacattatttttagtgtctggtgttccattatacagatgtctctcttgttggttgaatttttgcattcacagaccctcaagttggattcatatctttttacactaagcataaagaagacggattggggtcgggtatggtggctcacgcctgtaatcccagcacttcgggaggctgaggtgggcggatcacgaggtcaggagttcgagaccagcctggccaacatactgaaaccccgtctctaaaaatatgaaaaaaaaattagccaggcgtggtggtgcgcagctgtagccccagctacttgggaggctgaggcaggagaatcacttgaacccaggaggtggaggttgcagtgagcatattgcaccattgcattccagcctgcacgacagaggaagacgccatttcaaaaaaaaaaaaaaaaagacggattgattttcttcagcagtatcaagtggcacttaccatccacccctttaacacccaaaccattctaatccatgtatacagaccatcatctgtttcgttattgtgttctataatgcagctttgcgagttatgcagttttggtcctcatgatatttttctgattggtttttaatgtattttgttctaacgagccaacattgttatacatgtaatttgtttatttgctagattgtactctttcccaaagatgggctatgaactagcatctactttcattttacctatttacctgtaaacattgaaaaaactgaatcaaatgcagtgatatcggacctagttttattgttatgccttataatgaatttaacttcacagttttctaaatgagagcatttcccaaagacatctttatggtcataaccagtttcccttggcatttgatttatttttatttttatttatttatctttttgagaaggagtttcgctcttgttgcccaggctagagtgcaatggcgtgatctcgggtcactgcaacctctgcctcccgggttcaagcgattctcctgcctcagcctccaagtagctgggattacaggcatgcaccaccacgcccgactaatttgtatttttagagacggggtttctccgtgttggtcaggctggtctcaaacttccaacctcaggtgatccgcccgccgtggcctcccaaagtgttgggattacaggcgtgagccacagtgtctggcctgatttgtttttaagagcattatttttctgctttattttgtgacttcaacatttgacacaattttgggtgaatggtttgtgcatggtgcctgacatcgtgttttgatgtgtagtatatgccataggacatgtgagacaagatatgtcccaacttgaccttgttttgtattgtttatgtcaaggtgttgagtgtattagatatactgttggggctctgtgttctagctctgccttttagataataaccatggttaaatattgcaatgtcctgcatgtctccacacatgggttttgtaactgagtcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgtccatgtgttctcatcatttagctcccacttacaagtgagaatgtggtgtttggttttctgttcctgcattagtttgctaaggataatggcctcgagctccatccaagtccctgtaaaggacatgatcttgtacttttttatggctgcatagtattctgtggtgtatatgtaccacattttctttatccagtctatcattaggcatttaggttgattccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttcttacaaactcctaacaccatttacgactttgtcatcaatatggtcaactaagcttggtttgcatggctctacttcctttcaccttccacttaggcagtgtctccaagtccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgt

SEQ ID NO: 5410 - DNA, 1545 bp, Homo sapiens
cgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtttcaccgtgttagccatgatggtctcattctcctgaccttgtgatccgcccacctcggcctcccaaagtgctgggattacaggcgtgagccactgtgcccaccctggtatgttttttttaaattggccacttaagagttgtccttcagaaagtggagcagcagtgtgattagtaaaaacgatgggctttcctgcagctctggcttatggtctttgtttttccagttaacagctgttacttcatgctgttatagggggtggggggagaaagagaaagaatatgtctagtggcttaattttggggctcaatttgtttattatgtttttcctgcaaaagagtcaccagtcttgtcatggctcaatgcatattttaaaatgagtcaaagccaatttggaagctgctatcttaggttatttgtagtcaggcttcaaatggagagtgaaactttgactttgaaaactggtgctctatgctcaatgatggtcttacacattcctctagggaaaggtcaagaaataaatttggcttgattgtattctctcatttaccatataggaaatactatggtagaactgaaaatatgtacaatagtaaagtggtggctgagactgggcacttggaaaatagacttggattcttttctaagtgtgaaactaattaaatacttttatgtgactggtagtagtcacagtctccttgattgattctagttccttttcaaagtggagagacctgaatatagattgtaacaggatgtccaaccttgccagacaagcaggcatatatgtctctgggatgcagaagcagttacaagttaatatatttaagcataatgttagccaatcctaggtgataccagagatgtgaatatttgatcatatttgagttcattccttgaaagtccaaacctaactggtcttaattgattacttcttagtattccgaattttagaatttaaaaccctatgaattttcagtttgtgcttacattttctaacattggatgtttgctttggc

SEQ ID NO: 5411 - DNA, 6028 bp, Homo sapiens
ctgaacttagtctgtctgaaaccaaactcagcacacagatacatataccactaccttctgcaaacttagtctccatcccagatttcttatctcagttgaaaacaccccagtgtaacaccctgggaaaaccggaaatctaagcattatccttgacactcacctctcccttcttcctagtccaaaattaagttgtgatattttttcctcattctacaccctgtagccagagttaacttaaaaaacccattattttccaaagctcccattggtcttgcattctttttgttgcttttccttaattaccactctcctcttcctcattttaaaacttactccaaagctacagtaatcaaaacaatgtggtattggaataatatagatatgtagtctagtaataatatagatttatagtctagtggaatagaatttagagttcagaaataaacccatacatctatggctgttgatttttgacaaggatgctaagtccactcaattgggaaagaataatctcatcaacagttggtgccaagataacttgatttccacatgtacaaaatgaaattggaccacctacctcacatcacatataaaaattaactccacatgtgtcagtaacctaaatataaaagccagaaccctaaaacttgtaaaacagtttaatcttcctgacctttggttttgcaatggattcttaggtatgataccaaaagcatgagcaacaaaagaaaaaatagttaagttatattttatcaaaatttgaaagttttatgcattaaaggaccttattaagaaagcgtaaagacggtctacagaatgggagaatgtttgcaaagcttatatctgatactggattggtatctagaatatataaagaacacctacaactcaacagcaacaaaaagacaacccaattaaaaatgggcaaaggacttgaatagacatttctccagacatatatacatatccaataaatacatgaaaaggtgttcaacatcattagtcattagaaaaattcaggtcaaaaccccaatgaggtaattacttagatggctatgattttttttaaagtaaaaaattaggaataatacgtgttggtaaaaatgtggagaaattggaacacttgtacattgctgttgggattgtaaaatggtgcagctgcttatgaaaaagagtttactaattcttcaaaaggttaaatgtagaatttattacatgatctggcaattccacttctgggtatatgccccaaggaattgaaggcagacccaagcagatacttgtatgccagtgttcactgcagtctcattcacagcatctttcaaaagatggaaactacccaagtgtccatcaacagttgagtggataaacaaattgtgatttatccatacggtggaatattcttcagccataagaagaaataaagtactggcacgtgcaacaaaatggatgaacctagaaaacacactaattgaaataagacagacacaaaaggacaaatactgtatgattccactcatgaaatatctaggcatattaatagatacagaaagtggatttgaggatgctaggggcttggaagagcagagaatggggaagtattatttaatggtctgtagtttggggtgataaaaatgttttagaaataggaaatggtgatggttgcaaaacactgggaatgtaaagtagttagtgctgccagattgtgtactcaaaaatgggtaagatggcaaattctatattaatatatatttcgctacagttttaaaaataaataatattatgttccaaaaaccactgaattgtacacttcaaatgggtgaattgtatgtgaattatacctcaataaagcttttcaaaaaataaacagggtaacaattttctcacccaccattttgttttataaactgttttgtcaaattgaaaagtcctgaaatatccttttgctttactagtataactaaaaaagtaattaaaaaattttttaaaaggtgaatagagagttcataatgacctgttttgctatcaggaaccttgatcaatgtgttacatagcagtatttcccattcttaatctaatgtactttgatccaaacaaacaaaaagctaccaggagatccattctaagggctctgtattgccagttatccatgttctatgcctgccacatatggaaagcatacagcagattgattatcttgggggctcttggggcagtattattgatctttacttttcttaatacctggtagttaaccatttattattatagactagattaatttctcctcctatttttaaagttttttttaatgtggcaaatacacataacatataatttattatctttatcatttttaggagtacagtttagtgtatttaaatgcatttataatgtgcaattctcaccatcatccatctctgtgattctttttattttgtaaaacttaaactctatacccattaaacagtaactcttgataccccctggcaaccaacaactaattttttaacatctcaggtttggctggggagagtgttgaatcagtaagtatttatttagcatctactttatggtaaaagttattaggggcatgaagaaggtttaaaatatgggatgctttaaaaaactgacaatactgctgggcagacaatactacatatgcaataattgtataggaatcaatgataacatggaatttattataattataccttgtatatatgtagcttatacatgcaagttataatgaaaattgtggggcaccaataaaagaccaaacacattaaaaaaaactaatgctagtattgataagaatttaatatataatgccaggcatggtggtatgtgtacctgtggtccctcgggaggctgaggtaggaggattacctgagcccaggagaatggagtccagcctgggcaacatagtaagactctgtctcttaaaagaaaatttaacatatgattaggaatgtatcacattttgttggagaagagaaaaatccttcagtgaaggccggggcgcgccccgaggccgggctccagccgggcatgctccccctccccctcagcctccgcgcgcgccgcccgccccgcgagaaaactcgccccgaaagccgggccgcgcgccgcccccagagcaagactacaactcccgggagaaagtcgcctgggccgtgtttcccaggctcccgacagctccggcccggctcggaggccgcctcggcccccgtgcaccccggcccggctcaccggggccccgcggccgccacccgctcccccgtggccacagccccgccgccgccggcccgtccctcctctctcccctccccaggccgtccctccgggaggcggcagcaggggaggaggggacgggcggaggggaggggtccccggcccgcccgctaggcggggacgcggcgccggctggttcccggtcccccgaggcccaggcgcagccgggggtgggggacacggagtcaggcctggcacgcggccagcccacaagctgctggagaccccctcatacaaatcttgcccccagtccagagggtcctaatctgagaactccaaaatacagcctggagacaaatggtggggagggtttcccctaaatttggacatctccagattaagacctccgccgaatccgtgaggctttccctctccaaggagctcctaagagaatttcccagtaaaatcgcctcaactgcggtaaataggctgttccccgcgccagcatttgagaagagctggtccccagagtgtaaaggagttaggatgttggcaggaggaaggatgtgtcgccggatgaggaaaagaaaggtgggtgtctgcggtgcagtccttggtctttctggcaagtgaggcgctctccccctaaatgtctcagagggagacaaatcagcggactaccttgcttcctttgatgacttggaaaggatctgcagtcccccttaaagcccaagaatgtcttctcttccacgacagccgtttgtggacacatactgcttacctccctgactgcaggacaaggtccttcaaagctggaactctgactgcgctcagtgatcccgcagtgctcctctgtagagtgggaacccaggtccatttcaaatatctacgttggaatgagtggatctcgctgggggtgagaggcactttgtctacccacactgccagtcccagccacatgcctcctcccttccctcaaaaagcagtgtcttcttagtctgcttcttcaaggggagaagtcgtttttatttatggaaacgaactcactatatggtagaaagaacaagagtatcagaatttgcactttggacttggactcccctctaagcagctgcacaaggtggaacaaaccaataatccttgctgatctgttttgtccttaggaaaaatggtggagggagaatattagatcaggggttcttagccttggcttcatgaataagctcaaggatgtcaatgaagcttttgacatgatctcaacttttttgtgaacatttatatatttttctggaatggggtccatagagttacaagttctttaagacctccagatggaccccaatatggcagaaatgaactatttaaagatacctgcctgctcccgtagtctgaccctctatggctaagcaaggttttagaggagtggaaggctggccattgcacagtatcagggttccagacaggctccctggctcttccctcccagtcctgctcctgagatatagttctttctggccgccacttcccttagggcaaccccagagcttaaatcatctgcaaggcagtcacctttcaggcacctttcatccggcacctgtgttcttagctggattaactagaaagctagttggaggaaggaaggtgaaagtggaggaaggggaaaagaggaaaagttggagacgaatctggcttatggttagaagcatattttttggccaggcaaagtggctcacgcctgtaatcccagcactttgggaggctgaggtaggcggattgcctgagctcaggagttggagaccagcctggccaacgtggtaaaaccccgtctctaacaaaaatacaaaaatttagccaggcatgatggtgcaagcctgtaatcccagctgttcaggaggctgaggcatgagaattgcttgaacccaggaggtggaggttgcagtgagctgaaattgcaccactgcactccaggctgggtgaccgagcaagactctgtctcaaaaaaaagaaaaaaaaacttattttttgagacagagtctcactctgtcgcccaggctggattgcagtggggcaaacacagttcactgcagcctcaatttcttgggctcaagcaactatcctgcctcagcctcccgaggagtagctgggatcataggtgcttgccaccacacctggctaattttttaaatattttgtagacacagggtcttgccacattgcccaggctggtcttgaactcctgggctcaagttatcctcccgcctcggtctcccaaagttctggaattacagatgttagttaccacccggaccaattttaggattcctttagccagtgaccttggtgtgaccttgtacttctgcagcattttataccttctgcggcacacccttgtagtgggtcgaattgtgttcccccaaaagatatgttctagtcctaattcccagtacctgtgaatgtgacttatttagaaatagggtctttgcagatgtaatctagttcaaatgaggtcatactggattagggcgggtcctcatccaataactgttgttcttattagaatagggaaatttggatgcagagacacagagaaaatgccatgtgaagatggatcagagacagaagtgatgcggctgcaagccaaggaatgtgaagaatggccagccaccaccggaagctaggggagacgccagcacagattctccctgagagtatccagaagaaaccaaccctccaacacctggatttcagacttctgaccttgagaagtgtgagccaataaaacaactgcagtgga

SEQ ID NO: 5412 - DNA, 4752 bp, Homo sapiens
actcctgaggagctatcccagagtccgcgcggcctcgccttcccggcccgctcaccaccccgcctcgtcccacctcgcctcgccctccccgggctctagccacttggtgcggcaggtgtcctgcaggccggctcgagattcccgagctcgccctcgtggtgttccaggaacacggtactttgcgctagcctggcctgtcctgagagactgcgggaggcgaagagaacgcgctgttgctgtgggaagcgccggggacgggacagctacaccgccaaacacttcgctagggaaagggctggctggtttcagtctcgctcgggcaccaggctggagtgcagtggcacggtctcggcttactacaacctccgccttccggattcaagtgattctgctgcctcagcctcccgaatagctgggattacagtgtttcagaatcacctgggatgatctgcatgaagattcctggcctccaccaaagacttactgaatcagaaaggaggcaagaggatgaggaatgcttaagaatctgcattaacaaactttacaaatgaatcttacaacatacagaagcatggaaactactgcctcaagggattatctcaacttgagtttaaacataggaattgctgactacctttaaaatgtaaaaatagtatctttatgggagggatgttgtttgggggcagctactaaatagtgaaatcattcctttaaaataccctctcaagtctgccccagttatccattttactggatagtcttggtatccagatgatttagggaaaaaaatagtagtagcaaactctgaaaacactcagtaaagttcattcttggtcttctcttcctaaatttgttttcaattgttagatttaaacactaaacaagaccaaaagagaactttattttacatgtctttattttacatttagaaccgttttatgatttacttaaaaaaaaaatcttttactattattagaagtattttttaaccaaaatcttgatttaggaagacttaagacattgtgcattattttaaatattttcatttcagtaactattaaaaataaattcacaattagggtttcaaatgtcctaatcatatctagtttgttctcatttaatattttatcaatcccatcatgtgcatacagaggttaaggtgatgtataaattttatatctttcaaacacattgatgctaatcagctcttgatctaattactatttcatttattcagaaatagcatttagacataaaaaccaatgtctcactttgtaaaataacctttggctaatttacacacatctaatacagcgtgttatataagttttaagtaatacaatgagtcactactatcattcagttttaaatatttttagtgttaacagggctgagaatatcatgtggttcagtcttctgaaggaagttatataataaaagcatagtgcctttgaacatgaagactatcctcaaggccagaaatcctacaaaggaactgaaaggagagattccagagaattgctctcctcatttttaatatgtaaagtgactgttttaagtcacttcattgaagacttaaggaagaaaacagtgttattatgccactgaataaagctacttaaaccagagtaattttgggatattaatcctaggctacataattaataggtcatcaaaacaaaaacctgtcagttattaggtgtaagttaacttcctatgccaagtaaggggtcacacttcacttcccccatttgtaaaatgaaaaggtggccaggccagtgccatttaggattctctgctaactgtaaaatgtggactgattttcttctgtttcttatagtccaggtgtatataaacttccagttctttaagtcaaaatttttatgcacataaccatgtcagtgtattgcccttagtttaaaaatgtacaactacataaataaaaactattgtttcttcaatattacttgacatttcttctgtaatttctttatttaaaaaagtaaatgtaacaagatacttaaaaaaggctagatacaaaagtagttaagctgctcacgaacatttaaaattttccaaaatgtatcttcaataatcatgatcttataaaacattttacagttatcagaaagtgcccaggctgagtttacataactgaaataccttagtacaaatgtctagttagaactgaagtgcagtaacctcttgagactgactgctcattgaaatagggatacaaagaaaaagttgattgtgataaaagtattgtgcattggccccatcatatgtacaaaaaaagtgccctcactcaaatgagcaaattacatgcaaaatattagtgatatcatttaatatcctagagctcaatgcagtcaaaccgcaataaaagtggtttttataggtaaaagtgatttcatctcttaagatctgaatgtcgagaacttttttacaagttccatatacatgatacacagttgcagccaaccacaaattaaacaccataaaaaaagttaaaatgaaaacacagaacatacttaattttttattttgaaattccctattccctctatacaagaacctttgctgaaacagtttccacaaaggcagcagtgaattttcagaacatttacattttttccccctcagcaaaaagataaatcacagtgtaaattatgttgttctgctgtcatctttggctggggttagacccagaagttggtgactagcaaaccaatatagccaaatgttgctagtgctccttaggcctttaagctataaactcagcaaggaatgtctgcattttatctctttaaggtaccaccaggggggtatgacagcattaacttccataaacttttatagacaaatggaaaaaaatctacaaaatttgctagtaatattacacagcaatacacactttttatactctacacaaaaccaaaattcttggtcttaatggcgagtaacaatttctgtttgagaatctgtttagaggaatagagtgggacgtaaagtcgagaaatgcaagtatttgcagtaggaagatgttggtcatctggtggtcttattgtgattgagggcataggctggaatccttcttcactggctggcagtgatgggcttgatgtccaaaagtaaacctgaacaggaatttaacaggttaatatttaactcttaactctggcagtatatacacaaagccctattgttatgttaataacctaaaaggagatattattttgaactggattttaaatatattttcttgtactaaaaaggaaagggatcattcatacctcaagacaggtttttgtttttgttttttttccccaaaggagtaagtctagagttagtagaggaaaaaaaggtgactttctgtcacagagcctcagtattttcatctgtaacatgaggctgttggactaaatggtttctaagagcctttcttgcagctaattccataaagtgtctattagtggaaaaaaggctgccaaacaaaagatacggtcttaggttcaaaactcacacaggttatcttaaaaagttattttgcattaaggagcaaaataatgcaaataataaaataataaagcaaaaaaagtatttactgctacattgtgatacagaatcattttataatagtaattattggggaacatctatctatgcatcaaaattcatgcaataagccatattaacactaagttttatcatacctctgtaataaaactttgtgcaacacagtgtaaatgatgctcagtaaatgtgaacttacactttttaacttaaccaaggatatgcctccctgaaatagtttgctgaacatgtaacattcctcatcaatccatcccttcatacatacgcatcattcttcagtgtctgtctctcttaaggaaaagctttttttttaatctaatcattttataatgcacaacaatgaagtatatccaatttcctagaatgactaggaaacctaaacaaacttaagatttcctgaagcacagttgtatgggaaagctcatctagaattctatataaagggacagaaaaaaaaaaaaaaagttaagtatcaggatctataaaatctgaaaagaaatagaaaacaggtactctagagatgaagttgatctaaaccactcatttcatagataagaaacaagcttaatataaagtgtttctccaaggatgaatgtggttaaccagggtagatgacctcactgctggatctctaagaagttggaagagaaatacttttactagtgaattataacactccaagagggaaataaactgtagtttacccaataactctggaaaccctataagttgcaggactaattaattcatgggagaactgtttcagaaaccccattcttatgtcctctagatgcatcaggatgaaaccaaacaatatgtgaaggatgacttcccaaaaagaggagaagggtaagggggaggaagataccatgataaactgcttacaccctaaacatagattttcaataagagtttaaggttcacaaactaaagctgttgacaggaaattttgaggtctttatagaaggagattttcttttttctaagattgagtcactagcaaatttttctttcagtagaaggcagaaactcatgagatttaagttggctgactggactgaggaaatactggtttaaaaacggcagaattgggaggccaagacaggcggatcatgaggtcaggaaatcgagatcatccaggctaacatggtgaaa

SEQ ID NO: 5413 - DNA, 2485 bp, Homo sapiens
gagacagtctcgctttgtcacccaggctggagtgcagtggcacaaccttggctcactgcaacctccgcctcctgggttcaagtgattctcgtgcctcccaggtagctgggattacaggtgtgcaccaccatgcccagctaatttttatatttttagtagagatggggttttgccatgtcggccaaactggtttagaactcctggcctcaaatggtctgcccaccttggcatcccaaaatgctgggattacaggcataagccaccgcgcccagccaacacttaactgatttcttatttcctaatagaaaggattctgtttggtatcctataatactgatgcagcttgatttgctctgtacacccaggagtcttctgacaactcttgtgttcctgtggtggctaatgtcccacaaaatggaaacacatatggcaaggaaaattaaagtagaacctgtgatagtaagaaagttcatgaatgctgaaacaatgacaacaaaatttcatttaaagagacttaaataaaacaagatggaggaaggcccaagcttatggtgaagctgatactacttgcagtttaatatatctaaccattttatattaacagaacaaactggacttatctaattcctacattcataacttttttagatctccaaagcataaacatttcttccacaactcaagatttccaattcttttttaataatctagtatgatgacccttttatattcaagtagatctctctgcaatgagaacacttgttcaacaagtacttgtgtcatgaatctgtgtgcttaaataaaagaagcatactgtgacttctgtgcttcagtctgagttctcagaaatacactggctaagacaatgttttgagaagataaaactttgaaagctaccattatacctattacactacaagttctacctctcatttaaccttacattcctgacgtagtttttagaagtcctatatagatgggttagttcaacattaaaattatggaattctgtgggaaaaactgaggcaaggcctactaaaactacaaataattaaggtaagggcaacaacatcaaaaaaactacaactattatggatctggtattatgggaatgaacagcctttgagtaataaagatagcaatggatcatgagttatctctttttcaggccaagttttgataaagttttactcataacaataccccccacactacacacacacacacacacacacacacacacacacacacacacacacacagagagagagagagagggagagaaatgatataattcaagacaagatttgccatatgcagagttaactaacatacattataggagcgatgtcaagaagcacaggtaaaactgaagaatcttaagtgattttgagaagttacaaaatttaaattttgtatcaaagtggaatttagtaccacatggtaaaaaaccagcaacgacaacaaaactctcaaaagtttagtatttttccctcactctaaaaatataaaaacacattaactttcactatcaactaaattatcattcatttaaccaaagcacaagaataaagacttacaatcacttcagttgaataagacatatttagatgattctgtgattctcaggatataatattttctactctaaaacagataaattttagaaaagactaaattggggaaaacacactaggattaaagaagactatttttttagcttaccagccttttaaattttattatataaaaatattttcataaaataaaatataattttattcacaattccatacattctaacttgatacctgccgaataaaaaaagggtgacctttcccactgtctgactctgtggagtgttttaagtgctcacaaatgggtaaataccctttttatgtacatagaaactgttttcaaacaaaatataaagttctcaagaattattaggaagaaagcttttctcctaagaatcaaagaaacacaacaatctaggtataagtctgcatagctcaaaaattcaagtacagtatttctctttcagaaggagtaaaatgccatacagtttcggacatcctccctcatttttcttctttccttctttgaccactccttttatgttagtttggacacacaaaaaaagaaaaactacaatttttaactaaacaaaagcactatttttgatagtgaaaaaaattcaaaggctctgttttaaaatatgcttctaatatgctacactatcatataaaatgaaaattcacacatgggtatgattcagagagaaagtttctatgatctatgatgccaaaaggcaacttaaattgcattcttagtgatagtgataaaagtcacaatgaaaaccactggtgttaccaaaatgcttgccacgaatgtagaaatactaacctaaagtatatctacggcagggagtgataaaggtgtacagatctggggactatcaccatttatgaataaaataattata

SEQ ID NO: 5414 - DNA, 1156 bp, Homo sapiens
gtctgacccaccttccccgtcgcagctgaagccataggctttgataacctcctgctggatctgcgtggccacgggcagcacgaattgcagcatcttacccatgtcgttgcaggcgttatcccgagcctcgtccatgcgcactgcattctccggggcggagaacgcctggatcacctccgcgaggaccactgcgcgccagaagcatcccagggaggcgtcccgggtaggcgtcggagaacagacagcgggcccagcggagagcgcaaggaattagtggattgaggctgtaggtaacccaataagatcccaagtcttgggggcaagcgccccacttagaaggacggtacccggcgtcccctaccccattttcccggcggacgtagccaggtttgtcgccccacatcctccgcccgcatcctccccagaccagcagcccatgccttgactaccccaggccagcagcctatgccttgactaggacgattctcaccctttgcttgctcagcgctcaaggccgccggttgggtcgaggcggacgccatagggcgtctgaagctctaggttcagcggaggtaaatggaaaactcacgaataaagagccacgtcctacaaccgttcccaacgcccctgggagcggaaaggaaacagcatccggcgcagccggaagcgcccaggcgtggcccaaaccttcataccccaagcttacaactgcatcaagaccaccaaaactacccataatttttgcacagtgaaaacaatctatcattggcaacaaacatcataagaggggctttccggtaaaaagccagaaagcctactagacaaattctaaaagagctgtaacactgctgcgtatgtgtttggagagaagatgggatataaaggaactccacaattgatgagggtgagcttaggtgacttttttcttgttcctattactgtataaacaacgacgcatgtggtaactttcagtaggaaaaataatattctaaggaacttacttaagtcattcatttctagagttcgcgaacatttgttctcagcccatgcaaatgagttcggtgctgattggttgagaaagcagccagtcacagccccttcgttgttgttaagcccggagacctggattcggcagtaaaggcccagagcaaaagcc

SEQ ID NO: 5415 - DNA, 1364 bp, Homo sapiens
gcatcttattgccccttttttctcttacccgggaagaaattattcttctggcgcatgccatcctctctgtgaataattttctttcttttctttcatctatttatttaaaatagtgattggggtctcactatattgcccaggctggtctcgaacttctgggctcaagccatcctcccaccttgacctcacaaagtgctaggattacagacgtgagccaccgtgctcaccctctgaataaattcactgggagttactatcctagtgataatgattggagttttcaaggtagattagatatacaagagaagaggatggaagaagagaagaggatagaagaggagtaaagaatgggatagtactgagaaactagttcagaaaaaaatggtaaactctcacagaaatacaagtgggtgagtttgcaatagcaacaggggtaacaagttgaggaaaataactgagaaaaaaccttagtgattatcttaggagacttttgagttgatgtttttagggaataaagtagggctgaaacagtatttcaagggcttttggaaatatgtggaggtagtggcaccttttaaccttgacagtaaaaggaactagatagaatataggcagtggaaaagataagtgaatggatgaggaagtctgttggaagaagccactggaagcaacttgaactgtacttggaagagatcattaaaggattatgggccaagaagaaatatgtgggaataaaactaattgacaagtacagttatctttgaaaagggtttaggatacttagggtttattttcctctgatgtagaagggaaagaatgtgaattcaagtgaagagagcaactattacaaagaaacagctgagcatggaagttaactgccgggctatggaatagacagatttcaccttacaccttcttcatcttacgtccttgagcaagtttcttcacttcccagtctcagtttcttcttctataaaatagacataacaatgccccccttttttttgtgaggagtaaatgagaaaattttatgaaatacctaaaactggcatataataagtgccaataaatggtagctattgttaccaacctgccagcacaacttatgtttgtcccatttcttgagagtttataaagactttcttaagtgttactttaagatgtctgcaagcattctgcaggactacagaaaatataaaaatgagtaagaaaatgtcattgtgtcctcaaggatctcataaatcaaaaggtaaaaaaatttttacaaggataaaaattatgatacaaaacttaagatcactttagccctgttgtgagtcaggggtagaatgaagattggaaaactaatataaaggctgctgctc

SEQ ID NO: 5416 - DNA, 1893 bp, Homo sapiens
atttatgcttttcagcattggatttaaacctgtcatccttgacatttggggcagaaactgctgaaatgaaggaggacttgccatcaaagaactggctgaaaggagttagcacaccactcctctgccctgaacagttctaagcaagaggaggagcctgtggcagggcgtgatatgaagtcctcagagatagagtgccaagagtagagggagtatcctggaacttcagtgtttgcagaaaaattcttctggggaataaagcatagagaaatgaagagctaagatacagaggagcttcccaagaccatgtttgaacatttgtaaacagccatgcctggacttctgagttaaacgagtcagtatatttcctttattgctcaaatcactttttgtgttgggtcctttttgaaaggtggccagatctgcccaatcatattatgctcctcaaggacacaccctgtgtgaggaataagcagggtttctaccaagtcaactgtcagagtgatttaccttccatgatatttctgaatgatggtagactcaagttaatgtgagttatgtgatgcctgtctgtcattggatgaagatctacactggacagtttcaggtttctttctaaaccatgactgaagccatagattacctgataaccaaccatggttctataaatgtctgtacgtgtctataaaagtcaatgcagaaaattaaaaaagaagtctgggtcgggtgcggtggctcaagcctgtaatcccagcactttgggaggccgaggtgggtggatcatgaggtcaggagatccagaccatcctggctaacacggcaaaaccacatctgtactaaaaaaaatacaaaaaaattagccgggcatggtggcgggcgcctgtagtcccagctactcgggaggctgaggcagaagaatggcgtgaacccaggaggtggagcttgcagtgagccgagatcgcgccactgcactccatcctgggtgacagagggagactctgtcaaagaaagaaagaaagaaagaaaaaatccgaatgggctgttaaaatgaaaatctgcacactgcatctattggtactaatttcaaagacttctttcctgtaggtttgcattgcaaaacataaacattgcttatatttgattttttcatttgtccatagtgattatacaaaggctgatacagagcacccatgtggaggggtcacagaaggtaaagccaaaacataacatgaaaaccaaatatggcagggctttgagcaccagtacaaggcatttgcatgtgattctttgcaaaatggagagttgttaaaagttttgaataaggacgcttctagaggattaatagggcaataatatgcagatgagcataaaagggaagagacagatgcctgttattgggccattgcaatatttcagaatgagataaagaagtagggcaatgggagtgaaaagaaaatgatggatgggagagacatggagaaggaggaataaataagaagacttggcctccacaagaatatggggcaccaacggagagagaaaagtgaaagatgagcatacagtgatgttttaaaaagtgagtttgggaaactgcttttgttcagtggaggagcttgcggagaagataatgagtttagttttatacgtatttgagcccttttctgtttggctgtcagctctcctagaagctgaatgtggtatgtagagtgggatgtaaccatgaggttaccctggaactcagaaactgctatagctataaagagaagtatgaaaagtaacttaaagaacaacgacctttatccatagcctggcattgtcttaacatatgtaaagaaaaaatggcttctttaggaattgtttggtagtgaaataaagaaaatggtgagtcatggagac

SEQ ID NO: 5417 - DNA, 498 bp, Homo sapiens
gtttaactgtttaacctggttgccctccggttggtgagggtctggactgcagactagctgcgagggaggggctctctcttctcctgtcagttagactgaaaactacctggcagccaggccctccggtcgggactggtggtggtgcagatatgatgacaggctttggtaactattgccaaagcctgtctctgtcccaatagatcaccagttcagcaaagtcaggcctgaagcgaagggagtcttgtgagccctggactgaggagccttcccagcctttccgctcctgctggccacctgggcccacatggcctcagggtcttctgccacagggtccttacccctacagcttaacagctgttctttccttctggatggattctcacattttatggttggttgatcagtcagatgttggaattgggggtagagggattatagagttgtgtgtgctatttaagttttctgtaatcattgctaattaaatttgttgattctcca

SEQ ID NO: 5418 - DNA, 493 bp, Homo sapiens
gtacaagaagcatccactggtgagggcttcaggctgcttccactcatggcagaaggtgaaggggagtcagtttgtgcagagatcacatggtgagagagcagaagcaagaaagtggaaggtgccaggctcttttgtacagccagcactcgggggaactctcatggaacctaatataaggagaactcacttactactccaggatggtgccaagccattcatgaaggctccacccccatgatcgaagcatctcccattaggccccacctccaacagtggggatcaaatttcaactaaggtttaggggacaaacgtccaaactacagcaagcccatcctacagcaaggcccgagaagatacagtttgttctcaattatttgaagatacttacaagttatcatcaaatgacttgtgcacatgttagaaaagaacccaactttagagtataagtcaagagtcctgaatttaaggcctctgaggggtttttaaaccttct

SEQ ID NO: 5419 - DNA, 1916 bp, Homo sapiens
aagagttaaatgaaatactggttttttaaatggttagaacagagactgatgcacataagtattcattattataattcagtttttgcattctttaaagtgaagctgtgttgttgcagtattttaaggatatattgttccccaaatttttgggtaaaattgactgttaaggaagatgagtcatgtttaaactgtaattgtgagtagaccaccctttatccttgaagggctttctcaaccaggtgaatggcatggctgtggtgggaaatacagggccctgtgagacaggaaatctagggggttgtctagctccattaccatcctcttcttttatggattcagtgtcttgttcttttgttccatgtgagaatcatccctgccctgcctacgttataaagctggagaaaaatgaaataagtaaaaacacatggaaaacgtactaaaatattaatgcaaggatgcaaggtataatctttgctggaacattagttcctcatttattagtaacattacaggcatttgaaattatgtactttatatgggacctatattttaaatatatgctaatcatcctagaagccctacaaggtaggtgttacttttttccattttaccattaaggaaattatccaggtttacacaacttgaacccaggtctctgtcagtaaaaaactgtctactcttccaaaccattttatctatccatatttatttcctccatcaaacattagttgaatgcaatgtggtgtatcacccaaggtcggctggcatcttgaaaacaataactatgtgttactcagcatcttagcacctagcaaagagtggagaatataacagtctttcaattaagttttgtcgaagaaagaaatgaaggctcttggtctttagaaattcacaaatcagctgaggagacagacatactaaccaacagcatatgatcagcatgttctaattggtactgtctctggaataaaacagctggcagcaaaaaatgtctgacttttgcagagaaactcctaatatgagtttgactgctgtcccacatctacctatgtggtcgtagtgctgtagtcactgttgttaccctaagaggacagccttgttcctccaggtctcttacaactctcttttaaggagctcgtattagatccctagagctgctgtaatgcattgcccaaatcttgtgacttaaaccaacagaaatttattatctcatagttctggaggctagaagcctgaaatgaaggtgtctgcaggcttcactctctctgaaatttttatgagaacatttttcatgtgatttagagcccacctgggtaatccaggatgatatcatctcaagattcctaacttaattacacctgtaaaatccatttttccaaataaggtcatattcacaagttctgaagactaaggcatggacagatctcattggaaaccatcattcaacccactgcaaagctttagccaattcccagctatgaattcttccaagatgaaaggataccaagctcaagactctcccttgttcatttgaggccttcccaaagatgactgacattttcacaaattttatttggtttcatttcctatcttaacgaaaacaatgataatttcctatcttaatgaaaaaaatgataatgtttatactgtatgataattaaaacatcatgtaaagattactctttatctaaatgtttgcacatactctttgaacatccatcatttttccagcagttatgattttttcttcccaggaatatgggaatgaagtgaaattgacaacttttcccccacgcattgtatcctcttttaatgccaccccctgtgtttaacagcctctgacacaatgtaggagcaatccatggtactcaaagaatattatggaatttaacaacaagtatatatatttgtcttga

SEQ ID NO: 5420 - DNA, 1508 bp, Homo sapiens
ttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaacttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaata

SEQ ID NO: 5421 - DNA, 664 bp, Homo sapiens
gctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagccagagaactgggtgcatctgagccagtggagatttgtgacttctccttctt

SEQ ID NO: 5422 - DNA, 296 bp, Homo sapiens
ctgagcggctgggaccttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccgg

SEQ ID NO: 5423 - DNA, 670 bp, Homo sapiens
aaatgaacgaaatctattcatctcttttgctacccctacaattctaggcctaccagcagtagtattaatcattctgtttcccactgtttccaacctctagtcatcaaattagtaaccgattattttctattcaacgatgattaatccaacctgcactaaaacagataataattacccataacattaaaggacaaacctgatcccttataataatatccctaattatcttcactgcctcaaccaacctccttgggcttctaccccattcatttacaccaactatccaattatcaataaacctgggtatagcaatccccctgtgagcaggcgcagtaattacagtcttctgctttaaaacgaaaaactccttggctggctttttaccacaaggcacacctatgccacttatccctatactagtaatcattgaaaccattagcctatttattcaaccaatagcattagctgtgcaattaacagccaacattatagtcagtcatctactaatacatttaattgcaggagacacactagtactattagctattagttttcccacagcttcagttgcttttattattctaatcctactgactattctcaaattcgccatagaccttattcaggcttatgtcttcacactactagtaagcctttatctatatgacaa

SEQ ID NO: 5424 - DNA, 599 bp, Homo sapiens
caaagatgaagactcttatgatgatccactttcacataatgaatagcattgagataatgaagagcatcccagaggaaacaccatgggagggaatacccagccacaacccatcttcgaacctgttgcgatgctgcagaaatcagaggagctggccagttaatgctgagaatttcatcaggggctaacagcatgaaagctttcaaattattaatattttgattcatggcacatttatgggtctagtccatcctaagaacattataaagagacatttccttggatctgtctgtgtttctgaaactgattcaataccagatagaagttcgcagaggtaagctgaatgatggactgggatttttagggtcttcaatgtgtataacttcacaaaaaatatgcacagagtatggaaaaagtaggtttgattggaaaaaatctatacgacgaggaaacagcctgtcaaaaaatcatatgctcataataaaaaaaaacgaaaatatattgtctttgttatttggtaaaattgactgaaataaataatattttgataggaatggcttgtgtttatcagaaactaagattaaaaattaatgtaatgttag

SEQ ID NO: 5425 - DNA, 10053 bp, Homo sapiens
ctctcccaagatggcggccaggtcgcctgctcgggcctcccaggcgactttgccccactgcgcccgcgctctcttctcctttccatttctggaccaaggggctgccataaggagtctgtgactagagatgggaggtggtggccacggcctctcgctgtatgctgtgtggaaggtcgaatcatcatcatcataaaacttaatattgcccttatgtgccaggaactactatctcagcaatggagatgtggtgcttggccgcaatcgtgaatcggccctggaggggacacaggaaggggctgcctgcgactcatgacctcctgcgtgcctgcctgctgacctatgacccttcaagttcccacccctcagccacgcctgtgaggaggtatgaagaagacctgaggtgtgaagaagatcgagagggtcttgttttgtcgcctacgctggagtgcagtggtgtgatcacagctcactgcagcctcaacttcctggactcaagcgattttcctgcctcaacctcccaagaactaggaccccaggtgcatgccactacaccaggctaatttgttgtagagaggaggtcttgctatgttgcccaggctggtctcgaactcctgtgcccaaaagatcctcccacctcagcctcccaacatgccaggattacaggcatgagccaccctgcccagctcaataacctaagttctatgaatgaaaaccatgactgcctgtggagtgagggggccgtcaggctggtggggagctgggtgaagacccagccagcccaggccagctcaggtgacctaatccccccagctcccacttccccctccccaagtggtttggccgcagaataagaacagtgctgggggtgctgaaagaggggacgcaaggctggggcaatgcagtgggacccgggggtgtcaggacaagcaagcagcccttaccatgtctgtgtagatctcgattgctcgcatcaaacagttaatggcctctggagagaaagggaggtgggaggagacatgagaaagtgaagtcgtttcagcagaagctgaggagaggaggcggacgcaggcgcacctggctgccagcagagagatcaataggcgctcagagctgccagcgctgccacacactctcaaggggctgggaagaaggggacggaatccctgagccccaggaaatctggtgagagggctgactctgcagactgtgacttgctgggcacatgcttctgggggagcccttctctcctcgggctgccaggatgctaccagcttcccacaaccccagggacagggcacagcagtgctaggccaggatgatggccagactcccacggtgttttaagacagacctgccaaggccctgctcttgaaggactgagctgctggcaaaggggaaggaggcatgggaggcggccaaaccagcatctgaggtggtcttggaggcaacagggtgccaggttctacctgggctctgccaccatctctgcaggatcctgagcagcttctgctcctgcaccaggaggacctggacctctggcacgaggaggctggatgtcatcaacactgagccctcagtgtgctctccactgccccctcttcctcgtagctcagcagtcgggagccctctgctcagtccctttaacctagtcctgccacccaccagctcctcaaaggttttgccaaaaaacctgaacacaccaggatggcactgaggaagaactgggctacctttgttgtactatctcttgcaagattttaaatttgggaaaggcttttttttgacaagttatttggaggagagagaaaagcatgagtgggaggcattttctagcagacagaaatgagctctcagggggtattttttaagaacaccattttagcacatctcaggaggacaggggtgttgtggggagggaggcctgggttggggagagggaaaggcagggagcttggacaggccacagggcatgggctctgagcttcagcctgggcatctgaaagttcctggtcaccgtgggggtctccatggtcacccaggccatgttcgcctgagaagagggtgctaccaagaagcgccggggctgggctcctctcaaggggctcacggtctggatgggactccaaactccctccgtggggaggcatctggacagaggctctttgtctcaggtctgtggctgggctttcagggagtccaacccctccttctgacatgtaaacagtggggtccataagcactcctctggggagtggggtctgtaggttttgtccaattcagaaagacctctggggatctaaaagggactgagagaaggtacagcactcagtccaggttctagggctgacagaccgagactgtggcagcagacagtggaaacggtggcaaaaagggggcagatgaggaggaaggggagagaacacaacctaaatccggcagtttgaagacacatacatcctgtaatcggcggacccagaagcaacggctaagccgggccacgctgcagaggagagcagcagctggagtgaggtgagaggcccgccttgccccgccccacctggctgcagtctccacatggaggccccgggctgctcactggttcactctcctggccggaacacccaggacaccaacctggcaccctgtgggctgaggcggcaaaggctgctgctccgcagtgagcagtgagatctgcagctgccacctgggcctgctggcactggctctggagcacccgccgtcagcatggcacagtccttgcagtagcagcagggagacagcttaccccccaggcagcaacatggactcacggggttaagtcccctccatgtctggaaagcggcgggccaccagcagacacctgggacagctggctcctggacgagcttctgacacactcatgactgctactcttatctcaggtcaccaggccttgtgcactcggacaggcagagcaacacccagttctgtggcctggcccctcctgtacccacccacagagggctggaaaggggctcagagcaatacagcccaagttggggagctatggcccaggccaccgcccatccccgcagtcactcctaccagcgacgcccaacctgacttctgcgtctctgaagcccttcctggttacacttggtcatctcctccttagtaaaatgggggcaaatcacagaatgcacaaagaaatcaaatgggttaaaagatgccaagcatctggtacacagtagaaacccagtaaatggcagctggggaggaagtgggggacaagcaggggccaggtcgcttctctgccccaggtacacacactgcccccacccccaactatcaggcaggcctgggaagaggcctcgctggcccgagtctgccctgagcagcagccatggttgggtaactgaggaaccaataacacatatgagcatcacccttccccacccagagccaccaaggtggcagcaggccaccctctgcgagagggagaggaattcgggagcccagtcgggcctcaggcacactccagctgccacttgggggcaggtccttctggagggagtcctggaggaagccctagaagtgctgacccaagacagaggccttctaggctgctgaggagaccagtgatgaggacggccccagggtaccggccacctgcttggggaagccaggcaaggttccaaatcgggcctccagcgctgtctcacaaggcacccggccaagggcagaggctgtggggagcccagggcaggcaggggcccctggactgatgaaagccaagggtgtcctgactggaagtttatcacacaccaggtgccgcgctgggcatgactgcatcatctcacagcagtctctgctttaacagacgaggaaacagaggcccaaaagactgacttgcccaggatcacaggggaggcagggtcctcccagaccacccaccacctgcgctgctgagccacacacagttgctacatgacattctctgtgaggcttttttttggggacaggatctcactatgttgtccagactggtcttgaactcctgggcttgagcgatcctcctgcctcagcctcccaaagcactgaaattacaggcatgagccactgcacctggccttgtgtgaggcctgactagcctcagacacaaagcagccactgcccttgatgccaatgtgccccttgccccactgggagtcatggctggcgtgcgtatctttaggctgtagctctggaagctgcactaacacccttccctgctcaacaccacgtccccagggctctggacacggcacctgctctcagctctacccaggtgaggctctcctttcagaactgccccctttcttccttgaaagatctcccatagccaaattcacgcccccagcctcagctctgtgcaagttggcctctgtgccctggatgtaacatcatctttatactttcctaccggtcggagtcctcagccaccttctgagcttcctaaggccagggaggggccacatccagactccaggcccacaccctgcagagtctcgctggagagctagaaaagctcagatcaaacgcaggggagggaccccaccatatcccactgccaggcagggcctgtctgcaggaagtgaggggtctgctgaaagagcaaatggcactctctgttcggcagcctggcgctcagtgttgccccagagtgtccttccagtcactccagatggggcagcagctgaacgtcacagatgctaagacagcacctctaggccaaccagtttcccagggagcagaaggaaaggcttggcggggcagtttaatggaaggcatggagactccatgtggtgaatcaagcttaaaaccaacccagggtctccctgggtcatcactgcatcaaccacgcagcctgctgtggcccagtgctaccagccaggcaagccccatggcccacccagttacaaggctgctcctcggcctcttgccaggcctgagccccaccatgtgaccactgaggccaacgcatgagatgcccagctgctgaggagcaactggtcagtctaaggacagagaagagctactggtcaacacaaattcatcctcatctgggaactaacacgtcagatcacgacaaaggggtatgccagcagttctcaaacacgccatgtgaaccagtgctcactgatccatggaggaagctccctgcactgctgcaaacctgtcttctcttgggaaggacaggcttttattccaagattatatagctgctttttattttttaaagattcatatattttccattcccctgagatgacagtgacaatagatggtcatttttaaaaactgcctgtgctttctaattagcaacctgtacctggcaccaacattttaaaaaataaattaaaattcccgccacatgcaagcaaacactgggctggacctcctcttcgggaggcacccagggggacaaaactgttttctcaccatgagtcagccccaaactgggtttctgtccctagcacgctctcattttaagtaatttgttctctggcaactacatctcgggctctgttctctctaattcctccccaggatgtagggaagccaggttgggctaatttccgctcctttttcggcagcaactcctacctggctggtctcagaatcctccccgccccccacaccgctcccttctgcatgttaattctgacaacagaacagattttcctctctccccggcaggcggtgggtctgcaatggaactcccactcccaaatgctccgggattgggaaggggtgatcagctgcaccgacaccaccgacacggtagataggggggcggagacttgagcagggcgcgaatgccaactggaaggaagagagccagttctaaagtcaacgctcactctgcctcaggcacgcccctgccagcctatcacatgtcggccactggaaaaaccagagccgccaggaaacctgaggaatcaatgcagggtgctaggatggcgctccggacagccagcccgtgtggcccgcagaggccctcaccttgggggtcggctttcttgaatgcgttgccagcgtccacaaagcaggtggctgcgtcgtgcttgctctggagctgcaggtgcagctgtgcagcctggcagaacgcgtttccagcagctggaacagaagagaagggcagtcctggcctcagtggggctccacactttatgaagccacagagacactgccctgggaggtgggtcgggctctcgagaatgcggaaagagtccccaagacaggacgagggtgacctgagcgagcccagaccgaggcctagaactcaggtctcctggctcctgcgctcaggtctgctggctcctgcgctgaggctcctggtggcccacctgacagtctctgagggcggcaggaagctgcctcgggggaaggccctgagccccaggtatatggaaagagagccagggtaagcccaggtaaaacaccatgtccctaatcccagctatgccagcatttccagggccaccacttctaaagatccaaggagaaggcagatagagctgagttggaaaggatataaaacagagtgaggtggcctcctgcacctcccggcctgggcagtcctccccaggggagcctcgaagcacagggcccagaaccaccactagaaggcaaagtacaggctgaaatcatggggtggcttcggaggggtattttgggaagcaaggggcaactgagattaaaccacataacatcttcccatctactcccctttccaagtcctgtttctttttccacagctccccaaagctcttcctgattctcccaactcctctgcctctgttcacattctgttcccttcactgcagatccccatggacaaggcacttgcatgaattgtgaggctcatggagttggggtcggacaacacagagccggctccctccaggagctgcatgtccagagagggaaacaggatgtggacagcaagaatgaatacatgcagaccagtgcccatgggcggagggcagaagagaccgtgcctgaagcctcatccatcctgtgctcatctgcacacggtcagcttctgtgggtcccaagccattctgcccacacatctcctaactgacgtttgggaggcagcagcatctctcctcctcctcgtgcagctgaccacctccagctcagctctgaggcttctccccttcattctcctccagctgaatctgagtcagagtttctaagctggaagaggaccaggaggcctggccctatcctcttaagttttgagcagcagaaaagacaaagccttccgggttttcactatatgatttcattattttcaagagttccaaatttgagtataaaattacggccaggcgcggtggctcatgcctgtaatcccagcactttgggaggccgaggtgggcggatcacgagatcaggagatggagaccatcctggacaacatggtaaaactctgtctctactaaaaatacaaaaataagctgggcgtagtggcacgtgcctgtaatcccagctagtcaagaggctgaggcaggagaatcacttgaaccagggaggcggaggttgcagtgagccaagatcgcgccactgcactccagcctggcaacagagcaagactgtctcaaaaaaaaaaaaaaaaaaaaaaaaaaaaaaatttcaagaaaaggggatattaccggggggaaatggcctagggcttttctttgaagagtttgggggcagaggtaacaaattttaggggaaaagcaacacctatgtaattaaaaaataagctttttttctctagaggaattttctaagtttgggagcataaaaatacaaaaaacatttggctttattcacaacgtattttgtgaaaactcaggaataactctttgaattttggggaaaccaacaacattctcaaaaacgatgataatcaattttattgtgcacctctgcaccctgcctccatggtcccaccaccaggttccctctcctccacagtcagaagttcctccctgcattcaaacactgggtctcttgccgtatttccttaattcaatcttggtgacatgaaagatgtatgatgaaatgagcctcgaaagggctcaacacactggcttgttggacttcttgggcctgcagggagctccaaacagatctccagcctccctgagcccaaggggctcctccccacccctctcctctgtgaagctatcctgcctcactggggcaggttaaacactcaggctctgcagtcagagccttggtttctgaatcttggttctgtcacttactagttctggcatcctgggcaagagactaagccaagcctcagtttccaaatctgtaaaatagggatatttatagactgacccttagggctgctgtgctaacgcaattaaatgatgagcacttaggactcaacaaacagcagccatgattcacgttgttattggaatcacctgaacatcctcccccagcctagaatttagacactgatggaagcactaaggaagttaccaggaaacctgaagttctgaatttaaggaggactctaagagctcatcaatccacatgggtttatctaggtctaataatctatttattcccatcctctctgtcctttcaccaaggccccatgacccagagtataaagtaacccagcaggcacaaaacaagagagcaggccagtggctttccgatgccggagagggcatacaaagagaaagggccctcaaggccaacctctcgggcaggcctgtgtgagtggaagctgagggaggaggagagcaccttggaggagctctagcggagatgacataccactccagtttttggccattttgaacatgtttgctgctctggcgtagatttcgcatgcttcctctattttggatgagcctctggggaaaaaggaaagaaaaaaaggagacaatctagtcggctatccaggagaaagcaagcattctgctccagtgccgggcacagacgtgcccctacccctcacccttcacctgtgaagccagcttcccccaggcctcttgagtctgtggcccccgcccctgcatacaatggcacactcacttcgggcagaccagctccctccgggagtactggggtagatactgggtgcttgctggggtagtggggcgaagagttcctgaccccaccacaaccccagggtctgacagcctcttctacttcctgcctgggatactaggggcccactgggtcccaggcgcgctacaaatcccctttccccgggagactgcaaagcattctgggggactagcccagtttaagacatcgtgttgctttcgcagaggcagccttaatcctgtgccttgcactctgtggttgctcaataaagaccttgcagccctggagtgtgtcattaccagctcaggactgggcatatatatcacacagccatacaaagaaatgggaagcactattttaaagtgtagatataagatgttcccatttgtgtttaaaaaaaaaagagggtgggctgggtgtggtggttcatggctcctgtaatcccaacactttgggaggccaaggttggcggattgcttgagctcaagagttcgagaccagcctgggccacacggcaaaaccccaactctacaaaaaatacaaaaaattagcagggtgtgatggtgcacgcctgtagtcctagctactagagaggctgatgtgggaggatcacttgagcctgggaggcagaggttgcagtaagccaagatcacaccattgaactccagcctggacgacgacagagccagaccttgtctcaaaaaaaaaaaaaaaaaaaaaaagagaaagagagtgaaaataatagaaacatacatgtttatataaacataggatatttctgggcaaatacacaaaaacctagtaacagcatttttctcttaaggtgaagcctgcagaaggagggccaggtgtgggaggcagacttattcactggacatcccgtatttgtactgtctgaatttttttttaactgtttgtacatcttttcgagaaaaaaaatatatacatatatacacacacgtg

SEQ ID NO: 5426 - DNA, 2701 bp, Homo sapiens
attccaggctcctccctgtgtctttgctgttcttcagactccatttatagagaatgagggctgataacaggaatacagtggcaaagactagactgtggaaagggttccagaaatcttttttcttttttaattaaaaaaaatatttgcagagatgagctcttgctatgttgcccaggctggtctcaaactcctgggctcaagcgatcctcccatctcagcctcccagagtgctgggattacaggtgtgagctactgcgcccagccccagaaatctcagtgctgtttggagctccatttctcatttgatgacttgctctgcgtggggaggtggggtctcattcccccaacttcctcagggaggacccctgccctccgctgctcctctgtcctgctagccttcctccaggaagcacactgggtgcagataatcaggacattccagagatccccaatttaagagggtcatttccatctcaggggactcccggatgggtgtttccgctctcaatagcccctcttgttttaccaggaaagatccagttaaatcacccactgaggtgacagctcattagcggggagagagatggagcatcgagtgacactgggccatccaggcggctctgctcccaccagacaggagctaggcctcactggcaggggggctgcccacagccttttcaggggctcgcttggcgggtgacggggccgcagccaggccttctctccctgccccttggtgaccccgtggcttcctgtctgctggcctctcctgctacttatcacttcaccacgaactctctgcctgagactggggaagtaagcgggtatcttctcagtgagcataggttggggactgtgatcttgagaagccatgggccagcaatacctgcttttctgaagcccccaaggagggctctgacattctttttaaaaacaccacaaagcaaaattcccaggacatgtgtagttttgtttgttcagtatcccacaacttaaggctgggagatggaactcttggttaaggtcgatttttctgtctggcttctccgcaccttccacttgctctctggatcaggcagatataaactttctagcgcattttgagagagggctttcttgggtgagggagcatggcaaagtcggtttctctctggactgtttacacttcaaggcggtggatttagaggaatcctggctttcattttcaatgccagtctgagacatgttcccaagccggggctcttgttcacaccacttactctggccaccaacaacaacccaggccagacagagcatctcttttttttttttttgagacagagtctctgtcgcccaggctggagcccagtggcgagatcttggctcactacaacctccacctcccgggttcaggcaattctcgtgcctaagcctcccgagtagctgcgactacaggcgccggccagcatgcctgtctaatttttgtattttagtagagacagggtttcaccatgttgcccaggctggtctcgaactcctgagctcaggcagtctacccacctcagcctcccaaagtgctgggattacaggcgtgagccaccgcgcccagccagaacatctgtttttacacccagagagcgcccctcgttaggacagaaccacggtgcccagagccaggaagccgccctcctggcgcccagcatctgagcttctacacgtgatgggcgggctcaggagaggacagggagtcgtggtggaagttccacagctggccgcgtgggggggcccttgcaccgcactgccgcctcctgactgcccctatccccgcagcccctgtgccggatttcatttccctcctctctcccagggtacctggccccagcactctcccatctgttcttcaggaaccgactcctctccagttgcaacaccagggagaaaggggcctccacatgcccaagtacccctgcaggatgaagggcaggccggcccttgatgtgccatttctgaataatagtcactgccgccgagtctaggatgtcctgttctaactcagccctgcctcggatgcaccaccgatctgtgcagagtgggtgtgggagtgtgggtgagggtcgaaatgccaaaggtctactttccagaatcaagtgccttctgcaaatcatgttggaaaagtccaaacctggagatgtccctgtgcctccgcccctacccaccccttttccttcagctgtgttaggaaggagaagttttcagaaccctctaggctggtggctttcaaacttcagaccatgatctgcagcaagaaacgtgccttccatcataaatcagtccatttgtttacaactgtgttccaagcaggtttcataaagaaattcttaaccttagaacctcggatatcctctatgttttagttttcatttttttaaaatgcttcttaaaattcactaaattgggctaggtgtggctcatgcctgtaatcccagcactatgggaggctgaggtgagaggatcacttgagcccagaaggctggtctcgaactcctgacctcaggtgatccatccgccttggcctcccaaagtgctgggattacaggcgggagccaccatgcctggccagaacaaatgcctttttaaaccttttaagaacatttttaaaatgtctttttctatgtcaaatgtaacgtttatttttttaaacaataaaattgatttgccaaaa

SEQ ID NO: 5427 - DNA, 568 bp, Homo sapiens
tagctttaacacaccattgatgtatgctattacacttttccagtggaagataacaaagcccatataaaatttaaagacagaggaaaaactcgattttcattttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttccc

SEQ ID NO: 5428 - DNA, 4731 bp, Homo sapiens
aaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaa

SEQ ID NO: 5429 - DNA, 3456 bp, Homo sapiens
atgagatggaactgagaagtcctgggtgtccccatccatgccccatttgggaaactctagtgtcagcaaatggttcagggatcaaagcaggcttgaaggtggtagtggctcctattattcatccgtggccagatggctcttctcatcaagcccaggctgctggctcctgctccagcgttccttcttcagtcagctcatgtcctcctgtacatggggtccagaggagacagcaacttcctgcacacaagactgatggcacagttcaggcctctggccttctgttccaggactctatgggcaacatagcaagaccctgtctctaagaaaaatataattaaaaaattaggtggatgtggtgcgtgcctgtagtcccagctactcagaaggctaaggcaagatgatcgcctgagcccgggaggtggaggctgcagtgaactatgatcgtgccactgcactccagcctggatgacagagtgagaccctgtctcaaataataataacaaacaaacaaaaccagtttctgtgcctttgactggggctggagggactactggcattggctccattagcacaaaggaatcttgatgtcatttattccattcctgtttctggagtggctcaaacccaagtaacctcaaaacagtgtgaactgatgcaggaatacacttccatacacccatggaaactgaatgtatgttcacacaagaacttacacctgaatgttcacagcagcattatacctaacaaccaaaaagtgaaaacaatcccaatatccatcaactgatgagtgataaacaagctgtggtacatccatacaagggaagattcagccataaaaagggatgcggcactactgatacatgatacaacataaacaaactttgaaaacattatgctaagaagccagacacaaaagatcacatattatataattatctttgtataaaatgtccagaataggcaaatctatagggacagaaggtaaattagtagttgcctagggctgtggggagggaagagtagggagtgactctctttttggggtgatgaaatgttccgaattacacaatggtgataaccatcacatttagtgtatgcacaacctataaaaacactaaaacccactaaattatatactttaaaggggtgaattttatggcatatgaattatatccataaagaagattataataaaaaccaaaacagtatgaacaatgatgtgagggaagtagagttttattctccaaactgaagtttctagactcctgacacatctagaaatgtactcaatggacatttcccaagtttcaatgaaataatattcccaagaaccgttttccataaagagtgagacatgagcccgcatctcaattcagacctagctagatcaacactgtatcctgtaactttacagagtagtctaaatctaaggatggaagaagacaggaaaatcaaagagaacttcagtttacaccagctatcttctatggagggagaagtcttgccctgcgggttcaggaaacaccctccatactgacattgttctgggagctggcggctcaacccttggggaagaagagccattcaccaaggaaagagagaaagggaaaagctcacatgccaccgcacttgcacccacaaccctaactttcaaaacaaaggacaaaccagcaacccagctattcccacggccactggatccactagttcagttcctctttggctgtatgactcacctcagagacccatacactccaaagtaggtctaccgcaccccctcgccccaatggttatgaaatgagggtgtgtatgagggtgtggggactattctgacttccgtgtaatgaagtgctgacacagaccaaactcaagcctgtgactccactttgccccttcatcacatacccctgtaataaatttgccttaatagtgtctttggcagagcagagtttttaattttaaagaggtacagtttatcttttttttcttttgtggatcatgcttttggtgttgtatctatccccatgtttttacctgtcttttccactgggattataggtgtgagccaccgcacctggcatagttatccttttttaaaaagtgtttagtttaattatatcatggttggtgaacatggtctatagaatatatgttctttggaatttgttgagacctgctttatgactgagtacatggtcaagttttgaaaatgttctatgtgtgtgtttgtgtgtgtgagagtgtgtgtgtgtgtatatgttttctcccttcctcctttggatctacagacttttcttgatttcctgcttatcttcttctggtttagaaattatacattctacttttattcctttagtcattacatttatttatttatttatttatttatgttttgagacagggtctcgctctgtttgcccaggctggagtgcagtggtgtcatctcagctcactgcaagttccgcctcccggctttcacgccattctcctgcctcagtctcccaagtagctgggactacaggtgcccgccaccacgcctggctaattttttgtatttttagtagagatggggtttcaccgtgttagccaggatggtctcgatctcctgacctcgtgatcctcccacctcagcctcccaaagtgctggaattacaggcatgagccaacgtgcccggccctatttatttacttttttgagacaaagtcttgctctgttacacaggctggagtgcagtgacatgatcttggctcactgcagcctcaacctcctgggctcaagcgattctcccgcctcagcctcctgagtagcagggaccacaggctcacaccaccacgcctgacttatttttaaattttttgtagagatggggtcttgctatattgcccaggctggtcttgaactcctgggctcaagcaatctgcccattttggcctcccaaagtgctaggattatagtcatgagccactgtgcccggtctaaattttttttaatcgagttataacgtacatgaaataatatgcacaaatctttaatatccattttgctgcagctttatatatatatatatacccttgtaatcaccatcagattgggctgtagaacattttcagcatttcagaacgctcctttctgcgtccttccagttaatacccccttacttaaggtgactgcagcctgtgcatagtggctcatgcctgtaatcctagcactttcagagcctgaggcaggaggatcacgtaagtccaggagtttgagaccagcctgggcaacacagtgagacactatctctacaaataattaaaaaattagctgggcatggtagcacgtatctgtagtttcaggtactcaggaggctgaggctggaagattgcttgagcccaagagttggaggctacagtgagctatgatctcacccctccactacagcctgggcaacagagcaagcacctatcttt

SEQ ID NO: 5430 - DNA, 5251 bp, Homo sapiens
acttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagaggcccggcctcggatgaaggcggaagggagggcaccgcctgttgctgggcaactgtgccccaactcgtctgcccctggggagtgtttgtttccaaagcaacccaaggggatgtggtcactgcggtgaggaggcttttcctggggtaaggtggggctggaatgggcaatggttctgttgaacttagtgtcaccccatagccaggccctgagccccagaacattcaccgaaaagctgagaaagaggacgccggggccaggcacagtggctcacccctgtaatcccagcattttgggaggtcaaggtgggcaagtcacctgaggtcaggagttcgagaccagcctgccaacatggcgaaaccccatctctactgaaaaatacaaaaattagctgggcatggtgacgggcacttgtaatctcagctgctcaggcggctgaggcagggagaatcgcttgaacccgggactcggaggttgcagtgagctgagatcgtgccaccacactccagcctgggcaacagagtgagactccgtcttaaaaaaaaagaaaagaaaagaaaagaaaaagaaataggacactgggactttagcccgtacattcccagagaaccatggtgcctcccccgttcctcctgggaggatgccccaccccatcctgccttgtcttatccacggtgcctccccagatctgctcctgccatgcagcccccacaggcaccccctgcttggccagcttgcttcacaccttttttttttttttctggtagagatgggctcttgctatgttgcccaggctggtctcaagctcctggcctcaagagatcctcctgcctcagcctcccaaagtgctgggattacaggtgtgagctaccacactggcccctgcctcatacttttaattaacataagtctctctctcttcagaccatttagcccccattttggttggaaaatatcagtgaggtgaggcttgggtaacaaaaatgtcaagcctctgagaggagtccagggtataaaaacaggcgtgggcctgtttccaaaaccctgaccatcctcatgtctgtccctctttcctgctgctgagggtgggaggagcctggagcagagtgtgacaagatgtcatcaggctctggagtccaggtgactttctgagattctctagtttgactcatccacagatgacaaaagtaaggcttaaagaaaagagatttcatgaccaaagtcgcatgaccaatgtatgtgtgggtgagcatgtagtggccagggtggtggaagaatagatagaaatccctgggctgggcgaggtggctcatgcctgtaatcccagcactttgggagaccgaggcgggtggatcacctgaggtcaggagtttgggagcagcctggccaacatggcaaaaccccgtctctactaaaaatacaaaaattagccgggcgtggtgccgcacgcctatgaccccaactactcaggaggctgaggcaggagaatcgcttgaacccggtgcagtgagccgagatcgtgccattccactccagcctgggcaacagagcgagactctgtctcaaaataaataaattaaataaataaatgaatgaaaagacagtctccgtcagactgccccatcctggtggttttgagccctgctgggaggagctggagatggagagtccgggggaaaccgcctttgcaaagaaagagatctaacttaactgactccaccttgcttctaacctccaagctgtctttgtttattcctgggcgtaggctgaactaactttgggagaaacttagtttgtagtttatagtttaaacaaagacagtaacagccctttcccaaagcagaccttcttgcctggggactagactaacactagccataggattagaaattatggtttaggagtcatgcagctggaggctacaagattctgaccctccctaaactgctcctaacatcagtgcttgagatattttgcagaccctgcacttgatggatcagctggcaccacccagatcaataaactggctcatctgatcttgtggcccccacccagaactgactctgcaagaagacagctctgactcctgatgatttcatctctgaccaatctgcactcccagatcccagcactttgggaggaccagacaggcagatcacaaggtcaggatgagaggtgacagcgtgctggcagccctcactcactctgggcgcctcctcggcctccacgccaactctccctgcgcttgaggagcccttcagcccgccgctgcactgtgggagcccctctctgggctggccgaggcgggagcccgctccctctgcttgccagaggtgtggagggagaggcgcggacgggaactggggctgcgggccacgctcgagggccagcatgagttccgggtgggcgtgggctcggtgggccccgcactcagagaggccggctggcgccattggccccaggcagtgaggggcttagcacccagaccagcagctgcagagggtgcgccaggtcccccagcagtgccagcccacaggtgcacttgaattctcgcaggcctcagctgcctccccacggggcagggcttgggacctgcagcccgccatgcccaagcgtccccctgcctgggctcctgcaccgccccctgctctgcggggcctggtcccatcaaccgcccaagggctgaggagtgcaggcacaggattggtgggcagctccacctgcagcccaggtgctaggtccactaggtgaagccagctgggctcttgagtctagtgggcacttggagaacctttatgtctagctaagggattgtaaatacaccaatcagcactctgtgtctagctcaaggtttgtaaacacaccaatcagcaccctgtcaaaatggaccaatcagctctctataaaacagaccagttggctctctgtaaaatgggccaatcagcaggatgtgggtggggccagataaggcaataaaagcaggctgccagagccagcagtggcaactcggcgtacccttccacataggaagctttgttcttttgatctttccaataaatcttgctgctgcttatcctgggtctgcactgcctttatgagctgtaacatcgtgaaggtctgcagcttcacgccagaggccagcgagaccacgaacccaccagaaggaagaaactcggaacacgtccgaacatcagaaggaacaaactccggacatgccgcctttaagaactgaaacactcaccgtgagggtccgcagcttcattcttgaagtcagtgagaccaagaacccgccaattctggacacaaggagatcgagaccatcctggctaacacggtgaaaccccatctctactaaaaatacaaaaaatttattaggcgtgttggcggatgcctgtagtcccagctagtcccagctactcccagctacttgggaggctgaggcgggagaatggcatgaacctgggaggcggagcttgcagtgagccgagattgcgccactgccctcaagcctgggcgacagagcaagactccatctcaaaaaaacaaaacaaaaacaaacaaaaaaaccctctgtttcccgaatgctcagggagactgatttgagtaataataaaactcctggctggacacagtggctcacgcctgtaatttcagcaatttgggaggccaaggccggtggatcaccttaggttgggagtttgagaccagcgtgaccaacatggagaaaacactgtctctactaaaaatacaaaattagccaggtgtggtggcaagtgcctgtaatcccagctactcaggaggctgaggcaggagaatcacttaaaccctggaggcggaggttgcagtgagccgaggtggcaccattgtactccagcctgggcaaaaagagcaaaaccgtcaaaaaaaaaaaaaaaaaaaaaaaaaaaactccggtctcctgcacagctggctctgtgtgaattactctttattgcaattttgctgtcttgatgaatcggctatgtgtaggcagcgggcaaggtgaacccctttggcagttacagggggaagctaaggctcaggacactcgcagaaacctgaggaggctagaattttaccagattacaagccttaaaatcaaacctgaagttagtgccagcgaacaacacgcttaaaaataactaagatgttctttctggctgttctagaggtcaatatagaaaaatgatagtaactttgatgttattttatgttatgtatttctttttttcttttgagacggagtctgtctctgttgcccaggctggagtgcggtgacgcaatcttggctcactgcaacctccgcctcccgggttcaagatattcttctgcttcagccatccaagtagctgggattacaggtgtgtaccaccgtgcctggcagttatgtgtgtttccctacaatcaaacaatgatttattgtaaaaaaaaaaaaaatcaaaataaacaaaacctgaaaacttg

SEQ ID NO: 5431 - DNA, 628 bp, Homo sapiens
agaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaaggtaggctcaagatcagcctggcagaacgccaaacctagggcccctggcacccagaggcgagggggtgcctgctggctgccctgtccccactccctgagctctgttttccactttgttgactaaggtcctccctggggtgggttccggggacaggggaacccaggtccccaagggttcttggttgggtacggctgcacaggacagcttcaagtctgggtctgggatagttgctgccttctttcttcaccacacctgtggtctccctgggtcttggtggggcgtgtatgtgcaggccctgctctgttttcagcaaacctcgctgagacaggagctttggggtgacttattcccagcctgcctccta

SEQ ID NO: 5432 - DNA, 921 bp, Homo sapiens
cagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgc

SEQ ID NO: 5433 - DNA, 5651 bp, Homo sapiens
cgccgccattttgggctgggaggaggcagcggagggactcgctgcgcagggcgcggatcctgaggccgagctctgccagcttccctccccacccccattcggcctgggtatggcggcgaggccccgcacagagggactcccacttcgactggagaggtgggggcgacgccagattccagaggctggcgccgcgggggagggcggaggtcgcaggtctggccacaagtcggcgtggcagtcagctggaggctccgagagcggagatcccagtgcacccaccttacctcgcttacaccaaagcgccatctcgccgcccgggttgcgaaaaaccacgaccctcttaaactactgtagcaaccactaattccccctgggagcagctagagaggggcacttggaaaccttcacgagctcggtgcctgaaggtctctgaggctcttgccctcaagatctctcccattcagccccgattctccggacaacctgacctagcatgtcgccagcctcttggtgaaacgcctaaagtgtgctgccccacttctcttgaaagtttacaccgaagggatgaggttttgccctttacagggttggggcacaaagtcggagtcgctgcggctccgaaatagaaacggagttgcccatttcgtatgcttcatcaacatctgcttgcattttgaaatcctagtcttaacttttacacaacttttagagaaatggctgccctcctagagggaaaaacgaactacagtaattccaattccaatgtaatctttgtaagactacaaaatctttccagtttaaagatttttcttttcccacagactaaacaaagtcagagtattttgtgttctactggtgcattgttactaggtaacctcaattttttgaaattccaagtaattgaaggatcacttttgtagatcctaaatgctaccaaaaaagaaaccagtttttatctacttcatatgtatagcgtttaagagatgaggagacctgctttgaaagaataaactcttaaccttacattatagctgtagcagcttcttaaagattgaagtttgatgtgaagttcttttattgaattgcaggttaaaccatcttacttcctactgcttgaaatctaaatccagagagatttgtggctcaaggatatcttcaaataaaagttttattgctaaaatgtcagttaaaattatgcctaggtaggtgctgaagtaggagaggctttgacgtagcagagtgactggcagtgaattttgtgggtaccttgtgatgagtcttattatcagttacaaatggtcaaaacatgcctaagccttcagccttactaaaagtttaacagaacttggcctggcgcggtggctcacacctgtaatcccagccctttgggaggtggaggcgggtggatcacctgaggtcaggagtttgagaccaacctggccaacatggtgaagccccttctctactaaaaatacaaaattagccgggtgtggagttgcgtgcctgtaatcccagctactcgggaggctgaggcaggagaatcgcttgaacccaggaggcagagtttgccatgagcctctcaccgttgcactccagcctgggtgacagagtaagactctgtctcaaaaaaaaaaaaaagttttccagaactgaagttctgctcctcctattaataatttttcttcagttggagtgacaactccatagcattaacttttttccctctgctccccagatgttttacaactggattacaaaataggatcatcattgactagggtcctcaatccaaaactggaaccacttactcctaactgaagcttcagtacacttgatgcctactgtggtttgattttttacctacatatgacatgttcgctctacactgatcaagagatgtgagtttaaaaaagctaactaacttggtaggacttaaatagtcataggaacagaaaaggcttttaaagacgatctttgtgggtcttctgtcaagaatttaatggaggatcctagacacttgggattcatcctccattatgaagtaatctagtgaaatttttggatgctactgagtggcaaatactgtaccagcagcagaaatttgttactcatttgtaaatgaaacttactatccttaaggttgacccacaagcttttccattctttgctaagaaaaattgggaataggccgggcacagtggctcacgcctgtaatcccagcactttgggaggccaaggcgggcagatcacgaggtcaagagattgagaccgtcctggcagacatggtgaaaccccatctctactaaaaatacaaaaattagctgagtgtggtggtgtgcacctgtagtcacagctacttgggaagctgaggcaggagaattgcttgaaccccggggctggaggttgcagtgagccgagatcgtgccactgcactccagcctgggtgacagagcaagattctgtctcaaaaaaaaaaaaagaaaaaatgggaataaaaccagcttattagtggcctcctggttatctaaggaaaacacaggactgtaggactgaaaattaggaactccgagctctgtttctgtgtgtgctgcccttaacttggttgacttggccagaggccaaatactgataatgaggccaaactggtcattttgctgcttagtctattgttcatctactgttcaaccagactttcaacttccttttcagctctcccctctcagatgagttgcattatgcttttatgacaaattctacaaactctatattcatttgaaaatggtatcagcactgtctccctcataaatacctagaggagtaactagtcttaagtcgctatgtaaacacttactccttgtaactttgttatatgagaacttcacaaggaatgcttcaaagatcattggggcagttggaaagcctgccttaccaaagtgtggccttagttgtccatagcatcacaaaagagccatccaagtaggctgaatgaggatcagtctctcagggtgcccactggttgtggctgtgaagtcctggacactcattttgcctgatggccaaatcctagggagcagtgactatgtgtgagtaggattcgttgacagaggtaggaggttttttttttgtttttttttcctgctgcctgtataattgcagaaaaggagtgattctttacagtaattccccctcttcgggatgaagatgcttgcttctgtttggtttccacagttaaatcaattttttttccttttcttttgagatggaatcttgctctgtcgcccaggctggagtgcagtggcgcgatttcgcccactgcaacctccacctcccaggtttaagcgattctcctgcctcagcctcccgcgtagctaggattacaggcactcaccaccatgcctggctaatttttgcattttatttttttctggaacggagtttcacctggttgccaaggctggagcgcgatggtgtgatcttggctcaccacaacctctgcctcctgggttcaagcgattctcctgcctcagcctcccaaggagctgggactataggcatgcgccaccatgcacggctagttttgtatttttagtagagatggggtttctccatgttggtcaggctggtcttgaactcccaacctcaggtgatcctcccaccttggcctcccaaagtgctgggattacagtcagtgagccactgtgcccggcctgtatttgtatttttagtagagacagggttttaccatgttggccaggctggtctccaactcctgacctcaggtggtccgcccacctcggcctcccagtgtgctaggattgcaggcgtgagctacggtgcctggccagttaatcagttttttaccctcctgtgtttaggccccaacatcctgttcttgatcttttttggcaaaaatttggccaaagattgaaattttgcctcctggaccatatattttgctccagttgcaaagtatgacttttatcctttggtcagcagttcccatggtgtttagggcctgaatttgacattcttttttttttttctttttgagatggagtctagctctgttgcccaggctggagtgcagtggcacgatctcggcttgccgcaacctctgcctcccggcttcaagcagttctccctgcctcagcctcccaaatatctgggattacaggcgcccaccaccacacccggctaatttttgtagctttttttgtttgtttgtttgtttttgagagtctcactctgtcaccagactggagtgcagtggcgcagtctcggctcactgcaacctctgcctcctgggttcaagcaattctcctgcctcagcttcccaagtagctgggactacgggtgggcaccaccatgcctagctaattttttttctgtatttttagtagagacggagttttaccatattggccaggatggtctcgatctcttgaccttgtgatgcgcccgcctcggcctcccaaagtgctgggattacaggcgtgagccaccgtacctggcaacattctctttttttaaaaaaataactttttatttctagcctcaaccatttacactttgcttgagaaagaataataaagtggaattgttattccagtgatgttgtgcaaatgtgagaaatagtacttcccccaaaaaaacaaacctcgaaaccccacaaactcaagtgtacttaagtacttaacgttcaagtactttttaactataaccaacttttccaccacactgttgtgaatatttgttgctagctgttatgggtataagtgatcaagggaagaactgatgcattacctaatgcttgactaaatatagccagcccttaagtaggtagagtatttggttgtgggttttgttgtttaagtctgtggagtccctctttggtttctttaacttttgcagtcattagggcagagtatatttatttacatttctccaagcaaagtcttgctctgttgcccaggctggagtacggtggcgcgatctcggctcactacaacctctgcctcccaggttcaagcaattgtcctgcctcagcctcccgagtagctgggattacagatacccgccacgatgcctggctaatttttgtatttttaatagagacgagattttgccatgttggccaggctggtttcgaacttttgacctcaagtgatccatctgccttggcctcccaacgtgctgggattacaggcgtgagccaccatgcctggcctaaatttactttttaatagagacgaggctggttatgttgcctgtgttggtaactgtgttgcctaggctggtgtcaagtgcttgagctcaagtgaccctcctgccttggcttcccaaagtgttaggattacaggcatgaagccactgcgcctggcctgtctaatctttattatgcttcccctctttagagatacttagtctgtttttcagaactaaaccaatctggaactccctggctctctctcctaaaactctgaagtctagaggaccctgtctcctgagggctctaagaaaagctgtccagctagctgtgtcagtttgagaagcagtttttcctgattgaatacctaggccccagtaggaaaaagggaacaaactgaaattgctaatttgtaagcctggtcttttgagcagctcagttaaaa

SEQ ID NO: 5434 - DNA, 2659 bp, Homo sapiens
ccattcctacatatatttatttggtattgatgatgaggaaccccgtcaaaaattcctgtaagggagactactactcgactgttaggggtattgcaacatttacatacatgtagcttatcacatacgtaaacatttacacaaatagtacagcggtgaaccaccaagttctcattccacattcctttcccacactgcgtttacctgcccattcttgaaactggatctcagggcagcacattgcatttcaacaggcctagtgctgcttctcagaggcagtcaactcaatggtgcaaaagcacaggacagcgacaaggcattcacactacacagacatgtgatctcttactgacagcaggaagggaagagagatggagatcccgggtgggaaagcgacaacatgcatcacaggagccatgtgagatgcggtgaggaccgctggtacgcagcgtcccttgccaaggaatgcctcacagccatccgagaatgacaggcacgaaacatgaggaccttcctcgggtcagtcaagcatcatgctgggaggactcccacgtgtcccggtacacaggtcctggcactcatccgaccacagcttgctgtttggtccccaaaatgggcccacacccaggcgctgccaacacggcggctccgtctgagtcccttcgggtctccatcccatgggggtgcacgtctcagttttcctctaaccactgcttgagcagcctctgaaacattattttgctctcctgctgcctctctcgctggcgcttctcctctgtctcctgtggctggagtgccgcttcaggcagaggcccgggctggttggtgcctaggctgagagtcaagccactgaggccctgcaccagcgtctcccaggaggagggatgtggggccctgttactctccccagggatcccagaaagattcggcctgtggctctggcagtatcgacattcacatcggaatcgattctgacttctgtcacctaatggggagattctggcttccctcccaacagggtcttctcctctctgtaccgctggcggagcagcccctctgggagaggcacggcctggctggggccaggaccggggctcaggttactgaggcccatcatcggctgttctgagtacgaaggctgagagggcgctggaccttcctgggaagtctctgcagctgtcatcggggaagatttggaaggcgatgctggattccgtttctggagtggatccatggaggtctggtcccagctggaagctccgccaggccctcgggtccagaaaaggaggtaggaatgtgtgcgggcagaacccagactgcaacgcaaggtgataagacaagaaaacacagaattattcatcttactcaacctctctgtccctccacttcctgtgtgtagaatggggattatagagagaccctgtcctaggcttcttctgaggatgacgtgagatcatacatctcaccagcttagaatattaatgccatctaataaaggatttacaaatgataccaattaatgcatccacgtgacacggggtgcaaaaggatgcaatgcagttcgacgatgtcaattccctgctgacattttccaaccccttcccaagcatcatttgtagaataatcaatgtgtgactcacaggtgctctgcccatgagcgttcattttcatccactcacaagggagacttttactcaactgtaagcgtttgcaccatggggacacacccttttgtatgttcgccttcctgaccactgggtttgcatctagtcgaaaaggctgctcatgcctatggaaatcgtttccaaattcctagtgtggataagaatttattttgctaaacaacagaagcataaacccccaggagacttcaaacagaaaaacacatagatgaattcaattaatccaggaaaaaaaaaaaaaaaaaagctggttctttgaagtgatcaatgaaattgatacacccgtggcaggactggctgggaaaaaagagggcaaagaaacaagttaccaatatcaggaatgcaagaagagatttcactccagacccagaaaacataaaagggtcaatatggtaagaatacacgcaactctacagattcacattccacaggtcagaggaaatgtagcacatacttgaaaaccacaagctacggaaactcacacaggatggatttcaaacactgaactgtgtgcacagtcctatatgttttaaagaagttgaattcacaggcaaacacatttgcaaaaagatctctgggccaagacagtttcactggccaagtctaccaaacgtttaatgaagaaatatcaccaacttacacaacttcttctaggaaacaaagcagagggaatgcgccccactgattttatgaggccagcaccacagggataccaagaaaaggacagaccagtattctttcctagtacaggcaccaaagtattcaacaaaaccttgcagtttgaattgagcaatatgtgagaagaataataagccacgatcaagtgggttttatagcgggaatgcaagggttgttcttcccacacctgaaaatcaatcaatgtaacccacagattgagagatcagatgaagaacaaaaatgacaggatcacatcaagctatgcagaaaaaccctttgataagattcaaagtccactggtg

SEQ ID NO: 5435 - DNA, 3650 bp, Homo sapiens
aatatcaattgaatttattacaagttactaagctccaaggcacattacagtgttctgttaactacagaaatgtataaaggacaaacagagcagattctccatgtctagcatttcgctctactgttcaaaagcatccgtgcatcaataaagcaaaaacaaaacaacacgtgtagatccaacacattcaggtcagtagaaacaaaccaaaacattttcccctcacaaacttgcaacaaaatacaccccatcccccccgacacccccttaccattttgcaaacaaaacagaaaaacaaaacaaaacaacaaaataaagtgaagacttcaacacttggggcagtttagaaggaagctttcaccattttatagcattttttttttttttttttttttttttttttttttttaggcagcaacactggccttggcaaaaaaaaaaaaaaaaaaaaaaaagtctttttcttttgtgtgtgtttttcctttcagagagtgcataacatttacaaaaatacacaccagcagcagtcgttgctaagggctattaattctgtacctaggcaaacattctgccaccaaataaatgctaacgatatgatgcaaatgacccaaccaatactatactgcttaacacaaaccagcttatccttcaaatgaagaagttacatacctttgtttcaaaatatagaaacatacgacgaaaataatgtctatacataagactaactttttgcagtttcgttatattcacaattctacaccttgggggtgaggggagggagggtcgagttgggttgggggaggggccctcaggattggagaggagctggtctagggcaaaggaggtggctgcccagtggttcaagggtctctctcctttttcactttaacatccccagctaagatagtcgcgatttcgccctgcatgaaggcccaaggtacattcgacccgactagggggcatttctctccgctggggcaatacacctcgccggtggccccctgggccttgatactctctctagagcaagggaagcaaaatttgtggctggggacggaagggcactgaacgaaatgcgtatcctccaaacgttcgtggcaaatggtgcagcagaggggtccgctgttggccatgggggaatccggaatgttttgggggtgcacttggtccatgcccgggtgggcgctaggcggcgggggcgccacctgtaaattcaggtccccgttacgtgatgccaagcggcgctgccccggcacggaggccggcgagactgggctgctgctgtttcgccgcgccgacgcagtggtagagtgcacggaactgccatccttgggcgagtgcgctgtgcccagagtatctgccaccgacatgagagcggccataggggacggaccgttctggggggctgactcaggtggggtggtccggttggaatggggtcccagaggtgggggcggcggaggcggaccccccgccgcgtgccccggcgccgcgaagcccccggcggacatggtgagcttcagcgcctcgctctggttcgccatccactgctgcctctgctgttcctcgcccagcttcagcgcgccctcggctgagtccgggggctccggagaggcctttctcttgcgcaggctggcggctgcgccccggcccgacggcgcggcgggcggcaaggccccggtccccgggggtgcgctgggggcgcggctcagactcaccagagcagtgggcagcatgggacagctggcgtccaggtagggctggggcagcatgtcggcgccgggcacgccctccttgaagaagcgcacggcttcggggagcaggtctccaagcaggcgccagtccccggagccgtgcttcttttcgtactccaggtacttgaaacccgaggataggccccggccgaagtccttcatgcagtcctgatacatctgcttggccacaccagatgcactggagtacacgttgcccgagcccgtggggtactcaatgaacagcttcaattcgtagtccatgccgggcttggagacggcgtcgaaggcgaaaacgcggcccagcagcgagtggtccttcttgaagcgaacctcgtagggcgtgcagcctgccagcgtgagcagcgtgtcgcggaccatcttgggcttgctggcccactcctcggcgcggttgcgcaggctctcgctcagctcggccagggcctcggcgttgcgctgcttctccttcaactcgcgctcctggtctgtgctcgacaccgagccgggcctcttaccaccagcacccacgcccacctctgccaccgacgaagaggtcgaagacgacgcggaggacgacgtggccgatacacccggggtacccccgagacaagcggggcccccaggagcccctgggggagcaggcgtcgggggcccacggctgcccagggcgtggggagggggtggggggagtaccgcagcgctggccgggccgttaagcagcgtctgcggtagcaggttggggggcacggtgagctgggggcctccgccaccccccgggttgggcagccccgtaaccagcccaccgtgcgttccacgccgagacgccaccgacgccgccgctgaagaagaattggggctctgacggttcagctctgggggtccctcctctggtgttggtttggggaagccgtttgggccccccaggccgttgggcagtcgcgcggtgtggctgctgcttcccaggctcaccggcggtggcgggtactcgaagcggctgcgctgttccaccgcagcggcggcggcggcggcggcggcggcggcagcgcttaggccgtagcgctccaggccagacggggccgccagcaccgcaggcttgctggaaccatcaacgtggttgagctgttgttgctgctgctgctgctgctgctgctgctgctgttgctgctgctgctgctgctgttgctgttgctgggcggcggcggcccgggggagcggccgtcctggaagcagccgtgcgcccgcttcagctggcgcgctgtctcgatcacgaattcgatgcgatcagcgccctcgtagttgacgcaaccgcggcatacgggttccgagaagtcccagatcatggcccagggcatgcggggcaggtcgcacaggtagcaagattgtctccgggacgaggacacctgcgccgccgacatgatgcctgccctggggaaggtaggcccccgcccgggctgtctccgcggcgccttctcctccgggaggactggccggctggggagggagtccgactgcgggggagggaggagggggggcgagaaagttctgccccaggggctggagggaacgcgagtctccaccgccggcgcagcgcctcgccgtgggggctccaccgcccgggcagcggacgggttcagccctctcttcgcccccacctcctactgcggttgactcgtcgcgaggggagctcaggcgccttcttcctggtgctgcagacttgggctggaagctcccggcccgaggggagggggcgagggtgcccggtggtggccgccgttgcctcttggccccctccccggagtggctggtgcgtggaagctcgaaaggggctgtctcttcctctccccggggacccccctacgagctgcgtcctctccccgacgggccccctggggcgagggccag

SEQ ID NO: 5436 - DNA, 2824 bp, Homo sapiens
gaaagttgtagaccagattaatagcgttgtaccaatgttaatgactttgattattatactctggttatataagtggatggcctcatctttaggaaatatgcacctgaaatatttcagggtaaaggggcatggtgtctgcatctttccctcattttttccaagtttgaaattattttaaactaaaaagttaaagagccttttgccctaactcagcctccaaatagcagcacttccctttggttatggaatcttgacacaggccaaggattgaaaggagggctgcaatgttctaggaggtggaactgggtgctcacctgcttgtttggaaacccttcatagttagatcagagttctaaaccagaccctttctgtctaggagggaattggttctacttaggccttaaaagggtccaagacccttgttaacctcagaggagggaaacttgaaggagaaaaccatgatgacccttatattttcttaccttgtctctgtcctcttagtgaaaggaacctcttggtggttcagataaggacaggcagtgtgatgccttggaaagggttggagtgaagaaataggatgtggcctaaaagctgttgaatgcacagggcttgcccagagggtctggagctgcgcgatgcccaagctgggattagactattctgcattttgtcccacaacccactcaaatagcttaaattaaagggaggattttctgaaaggttgtaggagtctcatggaactcaagggaggggaagtgtcactggctctgatgcgtagggaaaccacatgtttcagttggccctgggcagtcttggtggatgcttgtggtcccagcacagttattaatagtgcctctccttattctcaaaagtgtcctgtttgattgatacatcatatgactgtgttgtcacaggattagaatcaggaacccgggccatctctcactgcccctcccatgccacctcatggttctctgcacatttgcttttttctgtctctcacctctgtttttgtctgtctctccctcctctggtttcctctgttctgattcctaagagagggagtcttgtattggaaacacggtggcaagtcctcacagaaggaagtagcaggtctggctgacactctgaggggcccctactcctgaagttggtcagggactgagatgggaaaagaaaaggactcaggggaaggggaattaggtccctggtttccagcagtgatcttgaagttctccccaacttgaagatcctagtatattcttcctattccattcctttccatttgtatttgtcaccttggggctgtttcacctgggtcttctagttggatgacacaaactgctgtggaattgggcctatgccatgagcaggagtgttgtggctggctccagctccctggtggtcttcatccatacccctgctctctacctctgcttcttcctggctcctacaccctcctgccttggcctttctggtttggctcccttgctcccccactctgccctggtgtactctttgtgcttctatctctgctgcagaattcttaaggtagaatcagcttgctctggccctcagggctatgaaagcccctcccagcaggagctgggactgagaagaaaaaccagacagaggcgggagggaaggcatcctgaggcccccaaaaagcatggcaggatctctcaaagcagaaaaggatctagggctaggcctgtgctgtgcaatagggcagccactagccacacgcagctatttaaattatcattaagtcttttgaacctgggaggcagaggttgcagtgagccgagatcgcgccactgcactccagccctggcgacagagtgagactccatcccaaaaaacaattaaaaaaaaatcactaagttaattaagttttaattttttgagacagagtctcgctctgtcacccaggctggagtgcagtgggacgatcctggctcactgcagccttgaccgcctaggctcaagcaatccccctgcctcagcctcccatgtagttgggactataggcatgcagtgccacaccaggttaatttttgtgtttttagtagagatggggtttcattatgttgcccagcctggtctcaaactcttgaactcaggagatcctcccaccgtggcctcccaaagtgctgggattacaggtgtaagccaccgtgcctggccccttgaagttaagtaaaatacaaaactcagttgcaccagccacatttcaagtgtttgcttggccacaagtggctgtggcttctgtgttggatggcacagatgtagcacatgtcatcgtcacagaagttccgtcagccagcactggagagcacttgctcccttttcacccaagcgctatttaaagtggtttctttgtgtgttctagtagctgccacaagtgctcttagagaatagattggatgggtgaaaagaaagcatgatttgtattaggttggtgcaaaagtaattgtggtttttgccattaaaagtgatagtgaatggaacatttcagttgcctttaccactggccagtaagtcaggatgttttcatagtgccttttatcatagaattctagtatgttcctgctaatggagactttcctatcattctagggctggatttccctaactccagttattctgctgctgccgccatcatttttgccacatcctaggactgcatgtgctatttattccacgttgtcttttaaattggttcatgtttttacttcagaatttttttgagacatttcgctcttgttgcccaagctggagtgcaatggcatgatctcggcttatgcaacctctgcctcccagg

SEQ ID NO: 5437 - DNA, 1404 bp, Homo sapiens
cgcacagacgagttttcgccatgttggccaggctggtctcgaactcctggcctcaagtgatccacccgcctcggcctcccaaagtcctgggattacaggcatgagccacctcgtccagcccttattgtcattttttaaaaataaaaattcatctatttctaaccatatattccattccccaataatcctaggtaagaatttagtgtcttcgaaacgtgtagaaatcttaacatgggagcagtgtgaaaagaatggcaagacggagagaggctgcttcagaaggccccagcagagctggcgacctgcagacagacaaaggtggtgcagctgggaggcagaccccgggctccacctaggatagaggatgtgtgatgtggctctgtgtgtctttacagaggatgggaccactgtaaagacaactgctaaatgatgagacagcccaaggggctcccacatcccaacagggacctggtgctggtggctgacacatgcacatcacaccatgaacatgaagccacacggacagcagttatagaagacccagttttacccagaaaaggatttctgtgcacaatgcagttgcattttcagaggcaagaccgtgagagagagccaactgagactcacggtgacggcggcttccagatctgcatgtgtcacacgaaaatgaggtcacagaggtgccgctgtcaagtagtttaatcatagtccctaccgtgtgtacctaaagaagagaactgtccttccctggacaaaccacccaccaggtcgagactccgatccggacgctccctgcacattaccagggtctgtcaccacccgctttgcttctcagttctgtgtgacaccaacgcccagggcccacaggggacgattatcattaaccagtttgtcctttctttgaccacataactctttgttttcaatgttacttatgaatattgagaaaaactgagccgaatatctggtgtatgtggttattataacttaatcaaaagctgtcacattcattcctggcagtcacttctgctgaagctgtaacttcccaacagggaggcacaatgtttttccctatggtagtagttttcaaccttttaaaaagcattaaaatgccttctaggctgaggcaggagaatcgctggaacccggaaggcaaaggtttcaagggattccctgccttggcctcccaagtagctgggattacaggtgcctgctaccatgcccagctaatttttgcatttttagtagagatagagtttccccatgttggccaagctggtctcaaactactaacctcaaatgatccacccgccttggcctcccaaagtggtgggattacaggcatgagctacagcaaccgggcacaggtatactctttttttttttttttctttttgagacaga

SEQ ID NO: 5438 - DNA, 1752 bp, Homo sapiens
ccccgccgccgcccggcgcaggggccgggagcaagtgcacgccgcgcggaggacgaagaggctgcacgcacagccgctgccgggggtcggggccaagtgcgcgcctcgccgaggacgaagaggctggcgtgcccggtggctcggctagctcccgggtcccggccccgcctggagggtgggtccgccgattactcactttgtttttaggggatttcagggccccctcccgccgatcggcggagtttggtgatgtcactctgggccgggtctggagcaaagccagggctactgggctgcggccgcccgccccgcgcagggaaaagcccgaccgggccttctgctccgcagaggccgggtggttgaactccgcgcgggtttcctaaccgctaaaggtgcctttcggtggtggctgtctcagaagcacgttaaaatgtcctacccaccccaatctagatgcggctgtgggggaatgggagcggccggacctcccagcctgacagtgcatcaagagctttgcggagcctacagcccggatgggacgactgaggccctcccgctggcgagctggccgagggctcgtccctctccagctaaagcgccagcttacgatacagccaaactgccggctctcatcggctgtgggagcaggaggcccccaggggtaaatcccggagcctcgtctctgaagcctggcgcttgtgtctcagaaggtgcgggacccacagggacacttgaatcagcaggctcacgaccccccacccccctgcccccgcctgtgtttgccctggacctccagctagggctgaccactaattctgtcatgtgaccccacagtgcaggtagctcccccaagaccaagcccaaggcgcgtccgtgtggaggctggggctgacgcacccccaccccaggcctcatccccaaaggaggatgctccactgcagggggcggagtcttctccagatggagaaagacttttttattttctctgaattcgtcttaaattaggaaatcatgtgggaattggaaaagattggaaattctgacttgtttcccaggctctgaagaaacaggaagagaaaagtgaaaatagagttagcaccccgcccactcatttcagtttctccagtggctggccctgattagaaaagtgtttacttttggcagggggcgggggaggccgacttcaggtgacagaatggattaattaaaatctttggttaatgatatacaattatcattgaaccttgcatggatcctcttcttaaaattcatgtatatttataacttttaaattaatacgataaacacccatgtacccattgcaaaactcaaggggccaccaccatccagaattctgtattgtattgtattgtattgtattgtattgtattgtattgtattgtatttatttatttatttattttttgagacacggtctgtctctgtcgcccaggctggagtgcagtggcacaatctctgctcactgcagcctctacctcctgggctcaagcaatcctcccacttcagcctcttgcatagctgggactacgggagcacaccaccatgcccggctaagtttttgtattttttgtaaagaagtggtttaaccttgttgtccaggctagtcttgaactcctgagctcaactttcctccccgcttggcctcacaaagtgctgggattacaggcgtgagccaccacgctgggccagaattctgtattttttaaattaattaattaattaatttattgt

SEQ ID NO: 5439 - DNA, 5338 bp, Homo sapiens
tgcccctctcggggaggttggctggcagctggcaggtggaaagcctcctgtgttcacctcagggcagaggtggggacacagggcgggacgggcgagtgtggtgcccctctggggtgggtgctcttgggtccgcctcccgtgccagagtgcgtgtcaacagttccagctgcccctcagaactgtcctggtttaggaggtgaacacacggggcagcctacattctacgtggtttttttaacattataaaagcagcatgtgttattacaggaaatttaacagaagtatataaaaagaaaccagaagtcacccgggagtctgagcactgtgctctctggggcctttcctttcggccttcttccttccagccctttccctgcacactggacagagtggctgagtctctctcgtaagcccacagggttatgatcgctgtgcagaggcatgacagaggggtttgaccaacagcgtggacatggcaaggtgtggcatcattgccagtgtggggccagagggtgcccgagccccggtgcgcggccagcctgctgcatccctgccggctgacgtctggagtgaccgtcattccagtgaccacccccatagccacagacggcacgtcagtggaaacgggggtgcagcaggcatgacaccaaggcagagcccgcagcagggggcccggggttccacagctagggaagcttgctcagacaggcagcacacccagggcacggccactcacgcccccgcaccaggagacccatttggaagttagttagggtttgttttgttttctttttaatgtggacttcccctttatttaaattttctttcagtgtacaaattcacaaaactggctacaaaaatttggttgaaaagtaaggctttctgagaatgaaaatctgtacgtctggtcagaacaagctccccacgggcccaggtgcacgtctgcccgtgcaaatccggcctccaccgcgagtaaggcaagagggtatggcaacgaaaatggcaaggctgtggccccagcccctgggccccacgggtggacggcagcccctggcagtttggtggctttggaatgagtggggtgcatgtggcactaagccccccccaccgccccggctttcctgcaggcttagcccgcgctttaggaccccatgagcaggcagatggcctggcacggcttgcttctggctctgcccttcctcagtctcccctcagaggcagggtttgtgggcaaggctgtgacaaaagtaaggctcctgccactgcccccagctggggccatcatgctggtgggggtgagctgtctgcctgctgcccatggggacaccaatgtggggggcacctcctaggcgaacctccctcccagaggactgagatcagaagtcctggggccagcagggtggagtgcaggaacaggctgctccgggcagtgtggcagcttggatgatggggtggcaccttatagatagggtctactccctccagtcaaaacacaaacatgaaaccagctaaaggccatttctttctctaagcagaagggatagccaccattttctcccctgactgctgcgtggtgggcacaggacaggcaggcggggtctgaggaggctgggtcatttctccctaagcgccctggggctgggcttgctggtcgatgggaccagcttgcggggaggtggggaggtggctgtgactcagccagctccacagcttgtcccttcctgccaccaggcctgaatggggaggtggcaggcaaggtttgagggcaggtcacccacaccccagtcccacgacatatacctgtcaccatgtgcctcccaccccagccctaagcaaaggtagctgggggctgctgcatgcctcagcctcagctggcaccgtccacctccctcactgcctctgccttccacaggaaggcctgctatagaggctgtgtgccctcggccacaccgggcatgtggtgccaggaccccccacgcccagtggtactccgggggcaagacatggccatgtgctctccacattcacccaacaactgccctggccgcctccacatttgctctaagaagacatggtctccatgacccccaggcagggacaggccaagatgtctctgtctgctcagagccaccagctcttgggttcggctgtccgggatcacaagtagacatgcctccggcaggagctacagcaaccagaggtgagctggttccccggctctgggacctgcccagtgcccggcataccccatgtgtcagccacctgagctagcaacaccatctctcagggctgtggggctgggggctttctgccagctccttaaagctgatttttaagaagtgccacccacatattgggaacttgaaccaccatccttttgatgtagtaaaaaaataagatttaaacaacgtttcccaaaaagcatctttcttgaggagaaagaaggtgagaagcatctggactcaacctgcagaagcgaggcgttcactcgtccatgaagacgagcaaaagcaaagtgactacaaaagtgctttgaacgcgcgtgtcagccaacacaagggagcgcaccagttatttttagccttatgggaaaatgagccacttgctcctaagccagcccaattgctattgtttgcagaagacgccacattcgctaaaagccagattcccatagagcagagcccatgtggtggtgtctgcaaggcagccggagaggagctacaaaccttgagaggagagcaaaccctcagggggctaggctcctcggatgccccagggtgaggagccagggtggggtaggggcagggagcatgaatccagctttgtgccggtggctgggcctacaacagagatgcagccctcaggactgggctccccctaagctgacaagggcgtgggcttgtcttgaggtgggtgatgtgccctggttacagccagcagtcctcaaggacaaacgggaggtgcctggaatcctgcaggggcccctgcagagtggccagcggacgcccttcacccctgagtgcgcatagggccctcatctgcccacctgctcgcagctcccgtctcccgaggccgttttcaagaggctgccctggtatcgtgccatccctacactcaccggaaccaaccatgcttatcactcagtgacctgtcagccacagagaagggctgccatctgctaaccctgccccaacggtggcagagccatggggtcagcctctccatgctgtaggagaggcaagcaagtccgtcttttcagccaacagatccaccaaatttctacccaacacgggaggccctaacaagcaccctccaaatcgttccttgggcccgagactccggacatggcttaccctctggagggccagtccagcaccccagggattctgtctctcacattggaattaaggccaaatggttctggtgttacagaaggaagcatctcccgaaccttcccaagcctgaagcagggagacctgggagagaaggcacggagtaaaactgagtgaaagaagctgcggggccgactccccagaagtgaacctgagtgaggccaagaagggccctgacatagcagatggcccctggcccccaccccaggccctccctgacagcccccaccaccagggggatacagagcggtgcccagctctgccggggacaacagagactgcccaacatcccacagggaaagaggcagaaaagacgcaaacttcaaagctgtcctctgggctgcagtagttctgtggacctggtggctgccacgctcggggagccggtgagaggctgacacacccgctgtatgacgcggccaggccaggctctcccccaggcagcaggtgggctccctctctgggacccgacaccactcaggaagctttcatcaggcccacgagttgggctccccttcaagggcccacctagtgcccagagtgggggctgtcgatgccagcacaccccagccctgcctgggcccacaccccctcagttcttctctatctgctcaatgtccaactcgccgtccagggagcagaggctgttcccaggggccccgcggtcccgccaggctgcagccggctccgctctcctgccacaatcctcgtccagggcgcagctgtctgactcctcacaggacaggtcctcctggcaggcgaggtggtcgtcgaaggaagggggaagaggctcagggaccggggtcccagcgggggtcctgccccctgggccggaggctgagagcagggcggtccaggccctggtgttgctgacgtggcgggcgaaggggctctggggaccgcagtcctctgtccctgcgctcaggcagctgaggctgctgaaggtctgacagttctgtggaggggcagacacacaggttactaagggttactcccctcccgcagccccaggactgcacaccccacaaagcaactagaccaccaggctgtggcaagaccaatcaagtcccgggttcctcctatccaggcaaggacgggcccatgagcaacgtactcatgaagatgcacctccggccaatgagcgctctgtgctcataaagacacgcgcaattccactattcacctactaactcggcaaagcacacaaatttgatgcagacccagttctggggggctgcggtgaaacaggaatgctcctaacacttcgtccacagcctttctgaagcgcaacctggggaaaatatatccaattccttgatcaggtaatttcactacttggatttttatcttaagaaaacattctaagatgtgtgtaaaaatttggcaacataccgttaaatggaaaagaagagagtaacccaaacaccctacaatggtggtgaaatcaatgtttttcaagcagggacctctatgcaaacataactgacgcgccgcgatacttcccttgagaagggatctgacttggaggaagcccaggctgtaactgccccacacagggcgacacgacgcccgctctacccactctccacaaccagagcgggagccgcaggctagaaggggccgagctgaagtcctgagcctggtgtgtaacagagccatgcagggagctggggaaacatgagttctcggcctcacctggagacacagagtctctagaagggagtggtcctgtgccctccacaggtgctggggactgggaggtctgatctgctgaggaggggccaggctccaggttctggtgctcgccagctgggggcctcatctggaagaggtgcatgatgctccctgcctgccttgctgggccctttgaggccccagagagagagtaggctgcgcagaagcttctccgctcaccaagtgtgctccctctgtgtgctcccaggcac

SEQ ID NO: 5440 - DNA, 530 bp, Homo sapiens
gctctcacggctgctgctcctctggactccccaagaaaccaggccgactaacaaggtttccagcaggtggccttgcctcaccccaagcacacgaggtcagcctggcaggtgtgccctcctcgcgctggcttcagggttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaa

SEQ ID NO: 5441 - DNA, 1099 bp, Homo sapiens
gagacactggatttctttaattaaaaaaaaaatgccaagaaacattatttatacagggttgattgttttcatgttgttattctgtaccctatagtagcctccatgagaatctggtatttcttgctgcttggaactactttgcagtgattacttggttgcagtccaagtattctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgatttttttctttctaaacagggaaaataatgttacaaaagcatcttttttgttatttgtttgcatccctcccccacaccctggtgttttaaaatgaagaaaaaaaaccactttttgtacaaaaactcttaatgattaaaaaacaaacaaacaaaa

SEQ ID NO: 5442 - DNA, 2466 bp, Homo sapiens
ggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaaagtgcacttcggccttccaaagtgcattacaggcgtgagccaccacgcccggcctggccttttttttttttttcttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccacgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgttaaa

SEQ ID NO: 5443 - DNA, 1914 bp, Homo sapiens
attttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagtaaggcatatcaatttatggttatcaaataggtttttttttttttttttgagactgagtgtcgctctatagcccaggctggagtgtagtgctcactgcgacttccgcctcctgggttcaaatgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgct

SEQ ID NO: 5444 - DNA, 2343 bp, Homo sapiens
gccttaacaaaaataatttattccacacacctcccaaggcagggggtagcgtgggaatcaagcatgtgtaaggcactgcccccgccagacccttctaacttctgcacactggaaggtgaaacctggagagagaagacactcccctccctagcttctacctggcaccctccaaagatgagcattcatcttggagaccaaaataaaaaaggacaaaagaccaggctcagagggagcagagctcaatggggggaagtgaaagcagccatcttctcctgcagctaagccagggcaaggcactagagacccacatccttcccatgccaccaactcgtcaggtcccaccaagcaagccactcaccctacagcccagcaaccatggcttgcctcacctgggagaccagcacgacttccagaagcttccaaaccccaccctgaagccaaaccccacccaggaggtctgaggagctggaggctggccaggcatagagggcccggggtggtccttcctcccagggtgcaaaggcttcttcattgtccggaagggagcagggtgggcggagccccagcagctagtgaggagttccattccagcccacccagctgggggaccctcctctggcttcacttgccccagttgagggccaagaccaagcaggagagactgaggctccagtgagaatgagggtggagaagagggccagggctgtggtggggacgtaatgagggtgcaggcgacactgggtgcggggggctgaggcctttgaggtctctgagctgcggaacagggttagcgtttcaggcccaggctcctgacggtggaggcgctggccccgcagacagcagactgcagcttctcctgagggggctcttcagaaagaacatgttggccactgtgaaaggcgggcagcccctctgggcaagaaggaaggatgagcacagggagggacgagaggggacgccaggagacaggatactcacacggggactcgggagacagagccattccggaacagcaggtagcaagaggggaagtcggtgacaccaaactttctcaccacattggcctctgtgttcagcaccctgcgcaccgccacgcctttgtgctgggacaggtccagagccacctgcagggacagcagaacatctgggggccaggccaccgggtggagggagccagggctgggtcccagctcggtgacctgtgaaggcacccagatggcagctgtgctccttccagactctaaacccacaaagagtggaccacactgatgcgcaagagatactcgccatcaacagcagctaaccagtaggtagcaagtgccaatcactgcccaggaggagaggccttggagctgtgcatgccacacacgctttaatttcttacgacagtcccaactgggtagcattttctttctaatgaaagcaatttgtaaagagcacaataaaatgtggtttcattttaattctcgtttgttttttgcactgagccagcacgttcttgtctttaagaccttcacaccccaagactgctctctgatgtccaggattccccagggccttctcataacatttttctaaagggaaaagatccctttagaaattactaattattgtttgtttgaaatatcaattgttgggggcaagagcagtcttccttatggaagcttgagtcacagatgtttaaagaactgtgattttattgcgttcaaatacatatggtaacaaatttcatgggtaggatacaaacaaaataaacctttggaattgggtaaacttctaaacagcaggctaactctgagcccagtatgtgcagtagtcagaggggccctttggtcaatgtgtatagttataagaagatctgaaaacgtttcttaacgtggggctctctgaaggcaacaagaggccttgttgagatgacaatgtccccacattagaaatgggaagagaagttctgagcataatcggacaggccatctgcaaatggcaggcacggacttctgttactgacgtctcactcttcaccatggagcaggtggcgccccctagccttttttcttatatttataaagcttcctatctagactccgaatcagaaaaatatacatcagtcatcattattttttttagaaagaaataaagagaaagcactagctaacctgtattgcataggtattatgtagtgtccacacagattgcctcatttatcttcagagaaacactgaaatagcagctattctcaggagactaagagatgcggcaccgtacactacagttgcctgcattggaatcctggccccactgcaccaaacctttccctgaccaaatttccttacttgcaaaata

SEQ ID NO: 5445 - DNA, 6438 bp, Homo sapiens
agaacacacagtgggcctcaggagcaccggaatcagcgcgaaaacgcagaatgcaaaccgtactttgcaccattatttgcaacttgacagtgaccgccgccgtcactgcatgtttaagggaacccggagctgtttccaacccaggtctgacgtccttcacagtgctttgtgtgaactggcagggggagaaacgacggctggggaacgaacggggttattcgtcccatcaatggcctcagaagcatccttatcacctgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctggataaggaacctaattcgagctacccttctctgtgaagctcgacggctgagaacgtcagggctcgttcccaagtctctttccagaggccaggctttatgggagcatgggttaccagcgacgcaccctgtgaggatgcagtgtccaaggcaccatcttgaactcatcatcgccaaatatgtgagcaccttgatgttggacttcccaacctccagaccgtaaggcagtacatttctttgtaaattacgcagtctcagctattctgttacagcagcacaaatggactaagacaacccccgagataggaaggggtaaggtaaatgcaatgagagttggggttttcgatcttagtccagtaaaggagctggaactgttctgtataaacaaagggcaaggtaattgctacatagattcttttcttattattgctgattcttatcctaaaataaaggacattgccactacacatcctctagaatgaccaaaaataaaaatacagcatcaaatgggacgacatggtgccaactggaattctcataccctgctgatgggagtataatgtggtacagtcactttggaaaaaagtttgacaatttcttataaaattatacataaacctgtactatgacctagagattctactcctgtttgttcaaaagaaaggcaaacatctgtccactaaaagatatgtacaagaatgctcacagtggcattatttatgacggtccaaaccaggagataatccaaatgtctgtaaccaagagaatggataaagaaattttgatacgtcaatttaatggattactacttagcaataaaaataattagccatgctgggcgcggtggcttatgcctgtaatcccagcactttgggaggctgaggcaggtggatcacctgaggttgggagttcaagaccagcctgaccaacatggagaacccccgtctctactaaaatacaaaattagccggggtggtggcgcatgcctgtaatcccagctactcgggaggctgaggcaggagaatcacttgaacccgggaggtggaggttgcattgagccgagattgcgccattgcactccagcatgggcaaaaagagcaaaactccgtctcaaaaaaataaataaataataattagccacatatccacacaacaatattgcattatcacaggtatagtgataaatactgtatgattccatttatatgaagttcaagaacaggcaagtaatccatgatgaaagaagtacttacctctgggggtggcagcattgactaaagaggtacaagggagtcttctggggcctggaaatgttctatatcttgatctgggtggtggttacacaggtatacgcgtgttaagaaatcatcaggctgtatacttagtgtactgtaatggcattacactgtctttcaattaaaatgtgaaagaaaaaacgggggtgtcttttgcttccacatttgtagccccagcttctgtatctcctgcgtgataatggttggatgaattaaaaggtaggaggaatagaagaggagaaaagcaataggaagaggaaggctggaagaaaagcccagctccactgtctcacttgggtgtcactgggtactggggaatttggaagcactagggaacagagaggaaggtgctcccttaggcttccacttctcagcccagtagtgagaggctatgaagctgttgccccctggtgggggacaagtgagaccagtgagagagggtttttgccttagaattgccccttccctggagacagcagcaagatgaaggcctctcaagaagtgcttcatcctctggaaaccagcggaggaaatgactttcccaagagaaggatcatacatcactcaatcatcagcaaacatttatgaagcacctgctctgtgccagaccctaaagtgaaaaaaaacaaacactgcacttacggaagcacgagataaacaataaacataagtaaattaaagagtagttagaaggcaacaactttggaagaaagaaaaaagagtaggtgatgtagtgcccagatgggaagggcaagttgccgtataaaattgggtgctaagagtgagtcagagtcacctcattgaggtgacatctgaacaaggactggaaagaagggatgcagatggctgggcgcggtgcctcacgcctgtaatcccagcactttgggaggccaaggcgggcggatcacaaggtcaggagatcaagaccatcttggctaacatggtgaaaccccatctctactaaaatccaaaaaattagccaggcgtggtgacgggctcctgtagtcccagctactcgggaggctgaggcaggagaatggcgtgaacctgggagacggagcttgcagtgagccgagatcgcgccactgcactctagcctaggcaacagagcaagactccgtctaaataaataaataaataaaaataagagatgcagacatcggagggaagagctagaacaaaagccctggtgtgagggcctgcctagtcagctgcgggaacaacagtggtcatagaggcaataagggggccagatggtagagaaagttgaaggcatcatgagggctctggcagggttctgagtagagcattgatgagctctagcctctgtatggagagtaaccaaggaaagcagtagagtcatgtgtgaaaccaatgtagtaattaggtggaagatgatagccgctcggatcagattggtgatcagtggctggattgcggacatgctgatactttaaaggtagagccaacagaccgtaggttcaaggttttgcatcataaggggcaatatagcctgtaatgttcagaaggagtcaagaaataaaggaggcctctcaatacagagctattcaccaagggccttgatggggaggaagtaagttgcaagtgtgtggagatactgctcccttctggcccaagctccctcccactccagttacccagtgttgcgggcagcaccctattctcttctgggaggtagcggaggcagagccacaccatcattttggatgcacctattatgggaggctggagtgcaatggtgccatcttggctcactacaacctccgcctcccaggttcaagggattctgcctcagcctcctgagtaactggggttacaggcgcgcgataccacgcctggctaatttttctatttttagtagagatggggtttcgccatgttggccacgctggtcttaaactcctgacctcaagtgatccgcccgccttggtcttccaaagtgctgggattacaggtgtgagtcaccgtgcccagcctggacttgccttttacctcatccgtggtgtcttttgaagaaaaagattctttagaaatgttttttctttcatagcttgtgttttatgtattactttcaagatcccaactagatctaggtcctaaaaatagtatcctacctattgtttttttaatcaacttaattgtggtataattgcacactgcagataaactgcacatgtttgaagtgagtaatgtaagtttttttgtcttggagccctgaggtaaacttttatttcttagctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccaccggcagtaccttgcccgcccgctttagtcacttgctctaggtggatctaaacctctaggcctgggcgcggtggctcacgcttgtaatcccggcactttaggagggcaaggcggcagaatcgcttgagcccccggcagcatggagaggtggcagaggcagggccataccatcatcttgggtgcacctattatgggaggctggagtgcaatggtgccatcttggctcactgcaacctccgccccccaggttcaagcgattctgcctcagcctcctgagtaactgggatcataggcgcacgctaccacgcccggctaatttttctatttttagtagacatggggtttcgccacccccggcagcatgggtagacatggccctcccgcctgatctcttaaaaaaactttaaataattcgtggggggggttaccgcccacctgttttcccagctactccggaggctgcggtggaaggatcacctgagcccaggaggtcaagactgcagtgagctatgatcctgccactgcactccagcctgggcgacagcgtgagatcctgtctccaaaataaataaaattatgtacatatgtatgtatatttaattacatatattttgtataatttgtatatagtttataatatatacatgtatgtgtacacatacataaatatatgcgtaaatatatatatgcatatatatatgtaataaaatattaagaacccgcccagccgaagccacgggcgctttgggccctcggttggcctcagccacttcagtcgcggccccggggatgttgggggaaccctgtcaggcagcaagcgcgtcctccagccccgggcggccggcggctgtgcacccgccctccctccctcccacggcgctcgcctgcatgcgttttggcaaatatctaaacccgcaaaaccatcactagctctggtttcccaagatccttgaagcccctccgttcagcattccacgcccctctctgccctgctttcaaaccaccgccaatctgctttctgttatatatacagattagtttggattttctaacagttgtatataaatgcagtgacacatttgagtgtactcttttgtgatctggtttattttactcagcataattattttgagattatccattttgttgcatatgtaagtagctcattccttctattgctgagtggtgttccatctcatggatgcaccaccattgtttatcacgcatctgtccgtggacatgtaaactgttttctatttgcggctgttaaaaataaacttctgtgaacattcgtgtacaa

SEQ ID NO: 5446 - DNA, 5421 bp, Homo sapiens
gaagcttgcagtgagccgagatcgcgccactgcactccagcctgggcgacacagcaagactctgtctcaaaaaaaaaaattaagaaagaaaaaagcgacggcgagactcttgtctcaaaaaaaaagaaaaaagaaaaaagtcgtaagagaaaatatatttcctatttatgcagtggaagcggatcaccataaagagcttcatcctcatggccttcaccttgagtgggctgaggaggaggacgaggggctggtcttgttgtcttgggtagcaggggtggaagaaaatccacgtgtccgtgatcatacatagctcactcctgtgttgctgaagggtcacctgtcatagaagagggaagaattgtgtggcctgtgcggattctgcattcagccttgtgtgttgtgttacggttaaccagggacgtgtgccccactaataactctgattcctggaaggaatggcatggcagcctccgttgtcatggttcctggagggaatggcatggcagcctccgttgtcatggttcctggaaggaatggcatggcagcctccgttgtcatggttcctggaaggaatggcatggcagcctccgttgccatggcaaggcaaagccatggcagcttcctggttatcactcctggcatgtggtaggtgcttgtccagtgaaatcctagtcgttgctgcattggcaggtgccctggcgtgaggaagggcaggcagtcaccatgccctttgctctcctgggccctgcatctgcttatggatgaggctgcgtgtagctgacatgcgtgtctctcctgcatctgagtaattgtcgtcgtcttttttttttttttttttttgagatggagcttcgctcttgttgccgaagttggagtgcaatgccacgatctcggctcattgcaaactccacctcgtgggttcaagcagttctcctgcctcagcctcccgagtaactgggactaaaggtgcccgcaaccatgcccggctaattttttgtgtttttagtagagacggagtttcaccatgtgagctaggatgatctcgatctcctgacgttgtggtctgcccacctcggcctcccaaagtgctgggattataggcgtgagccaccacgcccggccaagtgattgttttatgtttattctgttttgggttgaactatagtttgcttggagaaaataatgtctgttaaatttgcgttagaggataattgtttactgagccaaataatctttcttgtgagaacctattctgggtttcccctgggccctctgctgtggtttcggcgggagttggtttgtgtggattttcaggactgctgacttgatcagacaggcacaacacagtcccggccctcaggcaggccttctccctggtctgatgctgaactgcatggcgtctgttcagatgaagattcttttgccacctccttaaatgaaagaacgatactgaatgtggcttagaaacagctttgccagccgtgcagaatgattgtaagtagtggttgcccgaaaagtatttgcttggaataccactcactgataacactggtgaacctggaaggaattatacggagtgaaaaaaggcaccactcactgataacacgaatgaacctggaaggaattatacggagtgaaaaaaggctccgctcactgataacgcgggtgaacctggaaggaattacacggagtgaaaaaagaccctgctcactggtaaggcgggtgaacccagaaggaattacacagagtggaaaaaagactccgctcactgataacgcgggtgaacccagaaggaattacacggagtggaaaaaaggccccgctcactgataacgcgggtgaacccagaaggaattatacggagtgaaaaaaggccgagctgaaagatcacatgccgtatgattttttttttatacagcattctctaaagacaaaaattaaagagatggaacacagattcgtggttgctaggggttaaggatgggggaaggagacagccggagggagcctgtggttggattgcctcagctgcggtgggcacacactgcgcgtgtgtcatgggatgaccccggggagcttggtggaccgtcgtggtgggagagcctggctgtgatactgttcatagttttgtgagatggaacccctggaagcagggggacaaggtattgctctgcgtcatttatttttatttatttatttttttttgagatggggtctggctctgtcacccaggatggagtgcagtggctcgatctctgctcactgcaacctccacctcccgggttcaagcgattctcctgcctcagcctcctgagtagctgggattacaggcgcgtgccaccacacccagctaattttgtttgtttttagtagagatggggtttcagtatgttggtcaggctggtctcgaactcctgacctcatcatctgcctgcctcggtccccacaaagtgctgggattacaggtgtgagccactgcgcccagcctgctctgtgccatttcttacaactacatgtgaaggtacagttacttcacggttgctaactagaactagaaaactagaaaaaaagcagttgctaacattttttttttctttttttgagacggaatttcgctcttgttgcccagcctggagtgcagtggcgcgatctcagctcaccgcaacctccgcctcccgggttcaagccattctgttgccttagcttcccgagtagctgggattacaggcatgcgtcaccacacctggctgattttttgtatttttagtaaagatggggtttctgcatgttggtcaggcttgtctcagactcccgacctcaggtgatgcacccgcctcagcctcccgaagtgctgggatgacaggcgtgagccaccgcgcccggcagcagttgctaacattttcacacagcttcttgtggagaaggcccctttccactgtgaagtgtgaatgcgtcaaggtggagcccctgccccggaggcctctcctctgtcagggtcagctgtggcgctcggggctgctgtcttcaggggcggtttccaagtgggatgagcctgatgtggcccctgtggctgcttccttgagactcagtggtatcagccgtttgtttttagatgactgattgaagtgagttatgtgatcataatatctaattgtcaacaattgactttttttcctcgaagagggattttggcaacaaaacttgccagtggtcctgcaggctgccgtccacgaggtgtgcatatgaggctcaggaggcatgtgcgtttcctgagcgccttggcggacagcctcaggaacacaggcagcaggtgctgaggtcacaccccagttctgtgtgagctggcggctcgtctcagcatcctgaataaccgtcctggaagcacacaggaggaaggtacctgcagccctgggtgcgcaggcacaaatgaccacaacactgaaggcgtggcgggaagaggtgcatcgggcagcgcagtggaagggacgcgctgggcgtttgggttgaacagaagttaaggacttcatgggaaggagatggggggtcttgcaggcagaggaagttccttttatacctagagtgcttttgtttgtttgtttgtttgtttgtttgttttgagatggagtttcactcttcgttgcccaggcaggagtgaagtggcgcgatctcagcccactgcaacctccgcccgccatgtttaagcgattctcctgcgttagcctccctagtagctgggcttacaggcgcgtggtaccacgcccagctaatttttgtatttttagtagagacagggtttcaccatgttggccaggctggtgttgaactcctgacctcaggtgatccactcacctcagcctcccaaagtgcctggatgacagtcgtaagccactgcgcccagccccagctacgttgtgttttttttttccccctgtagagatgggttttcgctatgttgcccaggctggtttctaactcctggactcaagtgatccacctgtctcgactcccaaagtgctgggatgacaggtgtgagccattgcgtccggctggaatttcttatggttcgtttccttaggttaaagtttcagaagtaggatttttgaattaaagaaactaaatactgtctatggcgcttgatacatcttgccaggcagttatcagacagggttgtactggtttgcgccaccccagaacgtgtgcaaggcctgtttgtggaccctccttggcctggctctctaggtcatccacctgcgtgtgctcacagagcatatggatttttccctgcggtgccttcacttgtggctggaagagccttctctgtgatcctgtgtcctgggtgctctgttggcctccttcttgccaccgaggaagacacggaggctagagagggctcactgaacagtgaaatgattggaacctaaggagcttcagcagaaggtgtcatgatggggctaggctctcccgagggctgtgtggcctcagcgtcttgttgggcagatcctgctccctgacacagcggggctaagagccagcctgtgtcacacacctgtgaattaacatgcctggctgaccctcactggagaagggctacacgtttgtgacgaaagcagaagaggtgtttattgtagaccaaatccaagctgtcattttacttttattagaaattatttgggatttggctcatgcctataatcccagcactttgggaggctgaggtgggagaatcacctgagctcagtcgtttgagactgccttggcaacatagtgagacctcatcttctactcaaatttaaaaaattagccgggcgcagtggcgtgcacctgtactcccagctactcaggaggctcagttgggaggatcacttgagcccaggaggtggaggctgcagtgagcccagatatgctcatgaagcactgtgggtttctcctgcagtgcaccaccgcactccagcctgggtgacggagagagaccccatctcaacaaaaataaaaaagaaaagaaaatgggacactgttgatacagtcacagagctgaaggagcagcatgggtcgtgattctggatcgtccctccagggcagctagagtagctgctgggaagtatttctctcagtttcccgggagcagtgtgggtcgtgattctggattggccctccagggcagctagagtagctgctgggaagtatttctcagtttcccagtgcaccccatgtttctagtagaaaacacaattggtaattaaatattggaagtagtttctaacaattggatactcacctgagaacataaatttgctctctgaaataagcggtgggctttaaataattgcctttgtgaatatgaaatttaagtattagatgcacgattaggatcgattgtaacaaaacagtgatatctaaaatataccttcatgttttcaaagt

SEQ ID NO: 5447 - DNA, 609 bp, Homo sapiens
gttctagctgagatctgggatagtttctgaattcagaagtgttcaccagccacattgcatgtattagctggaaccatatatgaaactacgatactcagctgtttctaacctacaaacacagtgattacatatggctcaacttaatgtatatgaagcctagaatgtcagaactgatagagccttagagactttcaagtctatttcattatgttgaagaggaaaacggatgagggagagaagtgtccagcctaagatcatacatcaccttaagtggtagaatcagggctgcttctcttcctactggaccatgtacctgtctctcatactctgcttcttttaatataataataatttaggtgcgatatcagtcttttttgtttttgtttttgtttttttttgagacagagccttgctctgtcacccagaattgtatgaccttcaggcctggatccactcctgtgtagcacagagttttgaaaagcactaggcaaggagaccagagttcctgggttccaatcatggcactatgcaggcccaaatgggcagcacagcacttgccctgctttcttcacgggagcgggggcagggtggtggtggtaaatcatatct

SEQ ID NO: 5448 - DNA, 4528 bp, Homo sapiens
tatgccctaaaatctgggccctgggcaagcacacagcaggagagacaggcccccggtgggctatgggcagaacacgagggctccggcaattgggctgacaccgtccctgagcgtcagggatggccctgccagcacctgccgttctctgggcctcactttccttgaaagggtgggaaaggtggccctgaccccctttccagctctgcgcacctgaagactctcaggacccccaccccagggccgtggcttcatttgcttcattcagaaacacattgcaaaatggaaaatcaagggttagggtaaagaaagaaagtagccagaaagagcccccaggccctcccaaggcgacgtggccaacacagagttcccaggccagcccctgccctggacgagcggcctcctggggccactgggccacctggagcagctcccagagctaacagcacaagacagcatagccacattctctggggaggggttgggggacctggaggccccccatggggtcttggggatcaacgacgcggccactcagctgccctgggggtcttgggggttggtcagtgacatggccactcggctgccctgggggtctcgggggtcactgacaccgacccgtggatgtcctgggcccccgagggggcggcaggcagaggtgcggcgcgagcatgcgagagcgccaggcggccaccagggggcagcaccggcctccgccccgccccccgcacccagccataccttgcagtgtgcggtactcaccaggccgccgcaggacggagctctggccggtcagctcgtgcacgatgcagttatcagcctcggtgtcgggtgctgtgggcaccacgtgctgtgggcaagcagcgctgagccatgcacgggctggccgggcgccccccacgctggcgtctccacctgcctggctgctcacctggtcagactcccgttcctggggccactggtccagctctgctagctccagctcccgagcctcatacccctttgccgcctccttcctctgcagagaccagcgtcttgagcccaaaccagctccacaccccacccagaggcaggaggtcctgagaccagccccatggcctggcctcagcccacccaccatgggtggcaggtgctcacctggccggaggggcggtacgcgcggagcttgcgcagagaggccgtggcgtagcacagcagcaggaggacgccggggctggcatacacaggccagtccaggccggtgttgaggaccagcgcgtgggggctggagcagttggtgggacccacgaagtccttgagacccagcaccctgtccagagaagacccgtcacagcctaccaccccagaggcagtggggccacaggggctagacgagccaggtgggcgggaccagggtggcaggaaaaaggggctgtgtggcaagccgttacctagcccagatgccggcaggcgggagcagagcctgtgccaagggcatctggtagcagtagaggcagatgagatggccggcgccgaagcaccccaccgcgacgcagagtctgctgaagccccgagtgctgatgggaaagtggcaggcccaccaggtgcagagggccaggaagagcagcagtcatcagggaactcccaagacccctcccagtgtgactgccagtgccccctgcctcggtgcgtacctgccagtgcaagcagtgttacggccaggacccgcccagccgccaccagcagccagtgggccgtgactcggaaacgagcggccagccgtgacctccgtgtaggggccagcgttgctgcttcctgcagccctgccgtcgggctggcatccacatccctctcatcatcatcctgccaaggtcacggacaggggcaaggtcaggtgtatcgcactgacgccacctctccagcccacacctgcccagccaggagcgtgggaggcggccacatccacagctgctcctctgagggccacaggacagcctccccgggcacaggccccagccgtccctgaggtctgcctgacaccttcctacttcctcactcaagctcacagttcctgcaggccttcctggtagcagctcccaccctggccgaagacccagggtctgtcctgccaagcccaggcacgtgatgaccttgccaggtacagacagaccacagactgtcctataccacctcatctccccgaaccacgcacccagggagcagcggggccctgtctataccccggggggtctctagagaccaagggggcctgagggacatggccaggctccagggtctcctgtgtacccctgccagccttctgggtggctctgcctggaagataggggtggtactcctgccctccccaagcctctggggggacagaggtggccagctgcctagaagaagtgacaggccggcctggggctggggagagagacctgccgggcctgttttccctggacctgactaaagatttcccagaacacagccatttcccaaacaccagggaaagccaggtgtggtggaaagaacacggctgtcgtcagatgccctggctctggcctggctgccaccggcccagtgtccccatctgtgactcgggggctctcctggtggctgaggcgccaggtgcccgggctgagaccgcaggctgtggggctggacgataggccccaccccagctctgacagtctccgtgctctgcaggccgaggcaagtcacagcctctcggagcctattccccttctgtcaaatgggatgggggcttgacgggacagatgaaccagaccagtcctgtcctcacaggcctccagggctgcaggggctgctgggaggctccgaggccagggtaacagggagatcagggcaggagaggcccaggccctgagcccacccctctcagagaccacacagcagctgggggcgaggctggatcagaacgcagggcgccatcgctcaccccacccacagcctggccctggccctggccctgggaaatcttctgagcagagccgtgaaaaatgagcatttctgggagtggaaagaacagaggcagctgctgtgagagaacaggtgtgaggccaccgaggggcaggcccggccctgacttggggtatgaggccaccgaggggcaggcccggccctgacttggggtgtgaggccaccgaggggcaggcccggccctgacttgggccccacgtgccgcagccatgctgcagacgcccctcaccctcctctagcggccagcacccctcgggctggctggcacactccgtcgcatgcctgcaaacacgtgtgtgtgttgcccatatgtgggagtgagggtcgcccgggggccctgccaggccgggtcatggggcttctagatctttcggaacggtatcctgcaggtgcctggtgcccccagctcactctgaagtctgtccacgctggccgcccagggcgcagctgcacactcaggctcccatcacaccaagatgaagatgaccagagtccagccacccagccccttcccagcagccaaactctaggaagctcatgccccatgcccccatcagcatggaggggctgacgagggaggggcgggtctcttggaggacaggcagcagcacagtcctcatgagcgctggaccccctcaaatgcccggaaaagccacttgacctccaggtccccgttcccacttctgaaatgcgggcaccagccttgccccatggggtggcgacaggacaggcaggagggcaggccgcctctgcaggctgagcaggtgtactcgacctaccgtgtggcttggggaacccctttccctctcgggactcctctagaagttgaggcccatgtgcgtggcgagcatcagctatctgacgagtgggcactgggagggtgaggtgggaggaggctgggtgcccggggcagggagttcgtgggccaggacacccaggtggccataaatcctggctgagcctggggatggcaagtgtgggcccaggcagggacgagagggtctgagcagtcaacgttgggtgtcgcaggccccagctcatgccctgtccgtgtgagggggccatagctcagagattcccggggccggacctccaagtcttgtagcagctaaagttcactctgcctcccactccgaggacagaggccctgcttcaggcccgtcgctcctggggtccaggcccctgctggggctctgggccgacagcctgtttgcctgtaagtgcatggggcctgctggggccgccccttctcagcccttctgcagtggctctccagccagacccactgcccagcactgcaggtttccaccaccgcgtggccccaaataattcccctgtgaagagttcctaagggcacagatgccatgtcggggcgtggaggtttctgactagaggcagagcccgagtagaaacaggtctgaacggatggaactgcaggctgggccccggggtgggatttggaacttcctcctctctttaacaccaacttacaaccaaaacgtctacatctgttttaaaaagattaaaataaccctcaaaatggctgaga

SEQ ID NO: 5449 - DNA, 1718 bp, Homo sapiens
aaactgtccatcagtcaacgatgaattcacatagagcaaggctgacaactgacctgcttgtgtccctctgtcagaaatggggtcggagccattcacctgtgtcaagcagtggaaatgctgtgggaagcaaagtcagcagtcgaaccttgcaggaggcagcaggaggtgtgcagtgaggacacgcgtgtgaccacgggacgtgggacgaggggaggcatgggataaggagatgcgtagagtgaggatttctgtggagtgaggtgatgcgtggagtgaggtgatgcgtggagtgaggagatgcgtggagtgaggagatgcgtggagtgaggagatgcgtggagtgaggagatgtgtggagtgaggagatgtgtggagtgaggtgatgtgtggagtgagatgcgtgcagtgaggagatgtgtggagtgaggtgatgtgtggagtgaggtgatgcgtgcagtgaggagacgcgtgcagtgaggaggtgagtggcgtgcggagtggagggctgggaaaccacacctggggcggttctccagttgcccaatctttatcaagccccttcctcctcatctttaaaaccagaaggctggccagtcagtctctcaggcctctccctgttctagcccctgtgattcagtaacagccccacagctgccatatcagccggttttgcagggctgagcatggaaggtgcctgagagtgtggccagctctcggcaggagcaggactctgcactacaggcttctaaggcagaaaagcatcttctgtccacgacgacaagggtgtttccgctgcaagcgcttctcgcatgcttgagacaacctgactgaggggttgccagcaggggtgggcaccagccgcacaacaaaccaaatgacctctgcggcccattccttaagaccgggaactctggactaaagtgtgctgccctgtgtgcccagcaacctggcgacagcagtcgtttcacacacagcccgagccctgctgtccctggggcaccagcttaccagggccatcttcccagacagcagcagctccgtctcactgcgcagagctctgaagttattcaccatttccaggacgaagctgcagttgagcccctagaagaaaccaggcaaatatgcatgggggcggggggccgaacatgcacggttaggggcagggaacaagcactgggagggccgaacatgcaccggggaggcgggggaatgaacacgcacggggagggccgagggcggcagacactgagaagaagccaggactgaaaaggccagaatagctacctctgtggttctgggcttgccatacacacggtccatggacttggagctggcattgacggcgtgggccagttcctgctccatgtcccggtgagactgagctatttctcggatactagagaggaagagaagcacgggcagatgtcaggccaaatggaagggcagcctttcacaatacgcatctgaacacggcccaggtaccacctggagggctgatgtggagggcaggcccagcaggacgacagggatcgtggctcagcccagcgaccgttcagtcacaagcttgggcacaggatgacccacagcaaatgggagggcttccacgagaaatctgacgtcaaaatccaagattttccagggagagaaatgtacaaaatgaggcttacaacctgtaaaacggccagtgggcaagtgacagtgtgcacaggcccactgca

SEQ ID NO: 5450 - DNA, 11826 bp, Homo sapiens
agcgcggtacccgccccggcgaggcgctggggaggcccgggtggggagaagaaatggggcctgggggacggtaggagcctccgtgcggagaccactgttcaaggccacaggtgaggaggtgtggagggggcttcggggctgttgacctgggtcagctcctcccctccaattcaccgcttccgcgactccaaatagatggaatcactcagtcctgctgctactggagagggaaggtgaccttgacgctgcctcccgctcggcctggcccctccgcctggcgtttcagggctgcacggagtaggtctggcgggcggggggcggggcgcaggcacccgggacgagggttgccatgggaaccgctagggaggcgtccccagcccgggagccgggaggagctcggtgggaggggagcgggaggcggagggggctgcgctgtccgacgtggggagactgcggcggagggaggaggcgaggggcggcaggcacgggcggaagtgacggaagccagggcccgaagatggacggaatctgtcgcctctgcacagcctcattcagttgtgtccttcccagaccctcagactcgcccactacagcgtccagcgctgcccgggcgggggagaaggggcgccctcccgggggggatgggtagggggtgtcggccggggaaatcaggccatttcccgcctcccttccccaccggcacccgcgccactcttcctgacaggaccaccgatgccctgctccacaccaactgcgtccttttccctagagagaaactgaggcagagaggggtaggaatgggtttttgaagtgttggcgggggtgggggtgtcctttgaagcctctacccagcctatcaaccctgaggcgtcgaggggcgatggggctgtttctgtctcccgcccctgctgcttccctgggacccccacctcccaaagccgaggctcaggcgcaaaggtcccggccctggcgggacacggcccgggctgaggatgcgggcagagcgcgggggttctccaggggctggggctggggcctggccgcgcgtggggcagggctaagctcacctctctgcctgctgtctccgccgagcaaaggcgggtccggttcgcgcctgcgccgcagttcggggcgggggagggggcgccggcccgcctcagggcctggctctgcagacggcggccgcctgcagctcccccggctcctgtccccttccagagttccctgctcgctcggacaccccagcgccctcacagagacccctcggactccctgggccccagcccctcacgcagcccctcagactcctcaccgaagctgccgtcactcccgcagttccccacccctcccgtggaagacccatcccttaaccgagccttcctctcctcgctgcaccgtcagtcccttttccaggtctccatccccctcatggagccccaccccagcgtagaaaccgcttctcctcgccgggcccccgccctcttcacaggctcccatctgtctccgggctcctaccgggaagtcccctcccacttgccttgagagccgctaatccctctggagtcctcacatctcactcagtccccatcctcttttcatcctcttttcctctttgagtccctacccatccctggtacgggatcagcccttgtaccttgagaagggagtttgggtggaggactcggggttgggagagaagtgacctccactttggaaggagctaatgacagcctcccttgttgtttcctcccctagccccagttctgccctgggcaatgcgtgcccactgcccatctccctggagagccagcctgtgccaggcagctgcatctgcctcccaccctgtcatgagctgtcagccttgattttgtcccacatttgctgtgtgatcttgggaaagtcattgtgcccctccaaccgtcatcaagcacccttgcacagacatgcctttgtgtcttgagcatctattctgtttctccttgtgctaggggctggggacacacagaagaatgagctcggcaagatagggccacatcttcctttttagtttttctttttctttttttttaatttttatttttttgagacagcgtctcactctgttgtccaggctggagtgcggtggcatgatcacggctcactgcagcctcgatctcccaaggctcaggtgatcctcccacctcagtcgcctgaggagctgggactacaggcacgcactaccatgcctagctaattttttgtatttttaatagagacagggttttgccatgatgcccaggctggtcttgaactcctgagctcaagtgatccacctgcctcggcctcccaaagtgctgggattgtaagcgtgagccaccgcgtctggccaaggccacatatttcttgttcgtgttgtatctgtgagcctcccatagtgcttggcactgagtaggcagcccagtaaatatttactgaagacagtctaataatagtagcaaacttattatgctcactatgtgcaaagtgtttaagcgttttgtatgttctatttacttactcatttaagtgtgtgtgtgtgtgtgtatgtgtgtgtgtgtgatgggaggaactcttgcagctcaaaactaaaggccccaaatggtgacaggagatggcattggagaggcaggcagaagtgagaccttgtggggcctcataagccaaggtaaggagtttgagcttcagcccaagggtagtggggagccatggaagggttatgaagaggggtgggatgtgatctgattttcattctgaaaagacctctggctgctgtcaagagaacagcatgttgagcacaagagtgacagcaagagatcagcaaagagatcagagatgacagtgtcttggcctggtgcagagaaatgaagacattcaagagatgttagcctgtaaaatgaactacaggaatagctacagattggaaacaacctgtggtggttttaaaatatagctacaaattctttagcactcctctgtagagaggtgggatccttgtaccctctctgaatcttgggtgagctgatgactgcttcaaccaatggagtacggtggaagtaacactctgacttctaaggtccagacataaaagtacaggcaacttctgctagaactctagctcttggagcctgaggcaccatgcctacctagggctccatgtctgcttagaggctgccatgctgtcaggatgccaagaccatcaggagaggacacatgaaggcaccacagtcccagctaagcttagctttgagtcatcccagttcaagcataaaagaagtgagtgaagaagaaccagatgaggccaggcacggtggctcacacctgtaatcccagcactttgggaggccaaggcgggtggataccctgagttcaggagttcgagaccagcctggccacatggcaaaaccccgtctctactaaaaatacaaaaatagccgggcatggtggcgtgcacctgtaatcccagctactagggaggatgaggcaggagaattgcttgaacccgggaggcagaggttgcagtgagccgacatcatgccattgcactgtagaaggcgaaggggaaggggaagaacaagatgattccagtggccagccatttgaatcagcttcagccttcaaatcttcaaatcttcctagctgaagactcaaacattgcagagtagaaacaagctggcctcactgtgtcctgcctgaattcctgacacacagaacccacaagcatattcaagtggttattgtgttataccactaggtttggggggttttgttctgtgctaacagataactgggacaccacttaaatatccatcaatggaagacgagttatgtacattatatgtctttgtggaatactatgcatccattagaaagaagaaattagtctataattatttatattaatcacacttcaagtgaagaaggatgcagtgttctgaaaagtcttgatagtatgcctccatttgaaattctcaaaaagatggcacatatagagaacttctgggaaaatagacaagaaagaggtaacagtagatgccttgggggagggtaactgatggcaagggtgggaatgaaattcactttttttttttttttttgagatggagtctcgctctgtcaccaggctggagggcagtggtgcgatctcagctcactgcaacctccgcctcccgggttcaagcgattctcctgcctcagcctccccagtagctgggactacaagcacatgccaccatgcccagctaatttttttttgtatttttagtacagatgaggtttcaccatgttggccaggatggtctctatctcctgacctcatgatctgcctgcctcggcctcccaaagtgctgggattacaggcatgagccactgtgcccggccgaaattcactttttactatacacctctatgttagttatctattgattttgtaaaaatttaggtgagaaatgatgaagaattggagtgggcaggaaaaatggaaaggagggtgcaggtgtgaaaaatgtccataaagttaagttggcagaacttggttactaagaagtaagggaagtgacagggattgagagagagagagagagacagagagagggagagagacagagaggatagaggctgacttttatgtttataggtcaggtgggtgatgctcccattaacagagatgtaaaatagatgagggaaagccaggttgtggagaagttgatgccctttgcttttggcagagttgaatggcactgtacaggacattctggcctagagtcaggggcaaggtcttggccttagatacaacatagggaattgttctcactggaaatggcagttttaaacttgaactggctttaaacaaagggaatataaaggctcacataattgagaagtcaagggatactggcttcaggcatggctgtatccagatgctcaggatctttctctttatctcttggctcttccctcatctgtgttggcttcaatgtcaggcagattttccctatatggtagcaaaatggccacagacttcaaatttaactgctgggaaaagaatctgtttctccttatagtctcaggaaaagccctgatgttgattcccctcaccccagttagataatatgtcatttactgaacccactggagtgtctctgattggctggttacttgctcaccctttgggtggctggcagtgcttaacccagagaaacctcttggactgagaacctgcttgaagagcttccctaaagggaaattgaaatactgttactgtaagaaagggcagtggggccaggcccagtggctcatgcctgtaatcccagcactttgggaggctgaggcaggtggatcacaaggtcaggagtttgagaccagcctgaccaacatggtgaaaccctgtctctactaaaaatacaaaaatcagccgggtgtggtggcatgcacctgtagtcccagctactccggaggctgaggcaggagaatcacttgaagctgggaggcggaggttgcagtgagccaagatcgtgccactgcaccgtagcctgggtgataagagtgagactctgtctcaaaaaaaaaaaaaaaaaaaaaaaaaaaaaaaaagggcagtggatgtagagctggcaaaaacaatgacattgagatgaagcgtgctcaggtcagagctctaacgaagccctctgctgcagactgaatgtttgtatctccctcatattcatatgttgaagtcctaaggtgatgttatttggaagtgggcctttgggagggattacagcctgataagaggagacttgagagcttgcttcttctctgtgccatttggggctacaataggatggtcgtctgtacaccagaagtcaggcccttggttgccagcagaatggaatttgccagcaccttgatcttagactcttcaccctgcagacctgaggaataaatgtgtgttgtcaagccacctgctccatgctaaattgttatagtagcccaagcagattaagatgcctctgtttggctgtctatggctgcataacagaccactccaaatccaatgatttttatcatctttcacaatttctgtgggtcaggaatttgggaagggctcatctgggtggttctgccttggtgtctcttttgtggttacagtggaagccggagcactggggagctggagcagctgggagctggccaagcatctctcttcatatagcctcaaggcctctccatgttgtctctctgcatgagccagttgggcttcctcacagcatggcagctgagagtgttgacacctcttacactgtagctcaggactcccatgagtcaggccacattgcctttatgacccagcctcacaagtcaccatagaatcatttctactgtagtctgagtcactaagtttggctcagattcaaggggaagaaacagactctgttactcagtgggaggagtcttaaagaatttatagacatggttgggcacgatggctgaagtctgtaatcctagcactttgggaggccaagatgggaggatcgcttgagcccaggagctcgagaccagcttggtcaacacagggagcccctatctctccaaaaaacttaaaagttaaaaaaaattagctgagcatggtggcacgcacctgatcgcaccactgtatccagctcgggcaacaaagtgagactctatctcaaaaaaaaaaaaaaaaattatggacatgttttaaaaccaccatactacatttgaagaggtcagaggaggagaaagaaccacagaagcatctagagagatagcgggtggtggtgggtgggggcaagaatctgggatgtgtgtatgtgtgttttggagtgggggtgcattgtgtcatagaaaccaaagaaacacatttccaagaaggacctgctcagccttgccaagtgcataagagacacacagcgggacaacaggacttaggtttggcaacaaggaggtcagtgggaaccttggccaggagaatttagggtgtgatgtggaaggcaagaaagtgaggaggcaggggccctttgtggagtggtttggagaaggggtgtgtatgtatgtgcacctgtgtgtgtgtgtgtgtgaagtgcaaaaagccccacaccatggacagaaggggagggggcccctgatatcagagcaggggtggatgaaatcctggggcagtgggaagagatgaagtcaaatatacagggggatgggctggccttgactagcaaaggagggatcctgtatcctctgagagcctggggaggaggggagggggccaccaagaagagccacaatgtagtgtctgtaagttgaactctggagtccagcagatctgcgtttgaatcttagctccactacttactgcttacatgatttaaacactctgtgcctcagtttccctgactgtaaaatgaagataatttaagtacttgcctctcagaggggttgaaagagtgaaatgagatgtgcatataagacacttatccaaagtacctggaacaaaattagaactcagcaaattatggttattgttactgttattgttatattagtttataggtgagtagggtgggaaggtgagagacacgacacctgataaactgtctacttttgagaaaaacaagatggattatctattaagaaataggaaaatttgtccaggcatggtggctcacacctgtgatcccagcactttgggaggctgaggtgggtggatcacttgaggtcaggagtttgagaccagcctggccaacgtggtgaaactctgtctctactaaaaatacaaaaattatctggacatggtggtacatgcctgtagtcccagctactcttgaggctgaggcaggagaatcacttgaagtagaggttgcagtgagccaagatcatgccactgcactccagcctgggtgacagagagagactctgagaagaaaagaaagaaagaaaaagaaaagaaaagaaaagaaagagaaagaaagaaagaaagaaaagaaagaaagaaagaaagaaaatatggtgaaaccccagctctactgaaaaaaaaaaaaaaaaaaaattagccgggagtggcagcatgctgcctgtagtcccagctactcgcttgggaggctgaggcaggagaattgcttgaacccaggaggcggaggttgcagtaatacaagattgtgccactccagcctggcgacagagtgagactccgtctcaaaaaaaaaaaaaaaagtgacaaagatgggtatcatttatagagcatttactatatgctgggataattaatcttcccaatgaccttatgaactttcttttttatcaattaaagtacttcaaggctagaatcaactaaagtatgagattggatttttaaaaggctttgagtgaaaaatgtcctgtaaaaactctcagagccaagatcactttagaggtgcaactctgccacctgttattcttgctaattgccattacattgagagtgacagctttaggatagaaagcaaagggaaaaagcagacttgaggacaatatattgaaaagtattgtgggtatggttttagtaccattaactacagtcaaatcgataagaaacctaagattttttttgagatggagtttcactcttgttgcccaggctagagtgcaatggcacaatcttggctcactgcaacctccacctcctgggttcaagtgattctcctgcttccgcctcccaagtagctgggattacaggcatatgctaccatgcctggctaattttttgtatttggtagagatggggtttcaccctgttggtcaggctggtgtcgaacttctaaccttaggtgatccgtccgcctcggcctcccaaagtgctgggattacaggcgtgagccactgccccctgccagaaacctaagtttttcagagaattatactgacaaagaaatcacaagcctgggctaaaaagcctatgaagctgggtgcctataatcctagcactttgggaggctggaggcaggtggattgcttgagcccaggaattcaagactagcctggtcaacatggcaaaaccctgtctctacaaaatacacaaaaattagctggatgtggtggtgtgtgcctgtagtcccagctccttgggagcctgaggtgggaggttcacctgagcccaaggaggttgaggctgcggtcaactatgattgcaccactgcactccagcctgggcaacaacaacaaaaaagcctgtgactgtttgggtctcaaaatgatcctagtcacttcatacccattaggatgactaccataaaacaaaacagaataacaagttttggcaaggatagggggaaactggaaccctgtgaattgttgataacaatgaaaaatggtgcagatgctatggaaaacacatagtgattccttgaaaaagtaaaaatagaattaccacatgatctggcaattttacttctagttatataccccaaagaactgaagccaggggtggtggctcactcctgtaatcccagcactttgggaggcaaaggcaggcggatcacctgagatcaggaatttgagagcagcctgacaaacatggcaaagcctcatccctactaaacacacacagacacacacacacacacacacacacacacacacacacatcaggtgcggtggtgtgagcctgtaatcccagctactcgggaggctgaggcaggagaattgcttggacccaggaagtggaggttgcagtgagcggagattgtgccactgcactccagcctgggcaatagagtgagactgtctcagagagaaaaaaaaaagaactgaaagcagtgtatcttgaagagaaatttccaaacccattttcatagcaacattattctcaatagctaaaaggtggaagcaacccaagtgtctatcaacagatgaatggataagcaagatgtgatatacacatgcaatagaatattactcagctttaaaaagaaggaaattctgatacatgctgcaatggataaaccttgaggacatgatgtgaagtgaaatagaccagtcacgaaaagtaaacactgtatgattctgcttatatgagacatataccatagtcaaattcatacatatagaaagcagaatggtggttgctaagagctagggggagggggaaatggagagttagtgcatagtggatccagaacttcagttttgcacgatgaagagttctcaagatggatgatggtgatggttgcacaacaatgtgactatacttaatatccagtgagttgtacacctaaagatggttaagatggtaaatgttatgctatctgtattttactactctctctctctctctctatctatatatatatagatagagagagagagagagagagagacagagtttcgctcctgttgcccagggtggagtgcaatggtgtgatctcagctcactgcaacctctgtctcctgggttcaagtgattctcctgcctcagcctcccgagtagctgggattacaggcacacaccaccacgcctggctaattttgtatttttagtagagatggggtttctccatgttggtcaggctggtctcgatctcccgacctcaagtgatccacccacctcagcctcccaaagtgctgggattacaggcgtgagccaccacgcccggccctcaaaatattttttaatgatcctagggtccctgacagtttacaggcagtgagtgagctgaaaaagcggcgtacctcccaaggtacttttgggccttcttgcttccagtggattccttgctctttcctgctttgcagagctgacccctggaagctactcagcctcctttgtcagctggcctctagctgaggtcacccaaggtgaggcacccacaggaagttggagggagaaagggggaagccaggctttttcttcccaaccatctctgacttccctagcccatcttgactgatacaacctcctcatctaaaatagtagcccttccttacactttgtccccttcactgcatgatatcattatgtgcacttatctgtttattcattatacgtttccatctactagagtataagctctgtgagggaagggactatgtctgctttattcactgacgaatccccagtccttaagacagtgcctggaacatagtaggtgctcagtgacggtttattgcaaaagtgaataaatttggtagtcaaaccaaacgcatacaagagaagagggaagtgctcatttcagcacacatatactaaaatcagaacaatacagagggctgggcacagtggctcatgcctgtaatcccagcactttgggaggctgatgctggcggatcacttgaggtcaggagtctgagaccagcctgggtaacacggtgaaaacccgtctctaccaaataatacaaaaaattagcccggtgtggtggtgttcacctataatcccagcttactttggtggctgaggcagaaaaatcgtttgaacttgggaggtggatgttgcagtgagctgagattgtgccactgtactccagcctaagtgacagagtgagactccatctcaaaaaatagaaaagaacaggctgggcacagtggctcatgcttgtaatcccaaagtttgggagttcgagatcagcctggctaacatagtgaaaccctgtgtctactaaaaatacaaaattagctgggcatggtggcgtgcacctgtaatcccagctacttgggaggctgaggcaggagaactgcttgtaccagggaggcggaggttgcagtgagccgggatcgccccactgcactccagcctgggcgacagagtgagactaggtctcaaaaaacaaaagaagaagaagaag

SEQ ID NO: 5451 - DNA, 20940 bp, Homo sapiens
agaaccaacgcgctgtcccgaaggagtagcaacggtaacgggcccagggccctaaacccaagctgtgccccaaccagaggcactatcccctattctacagttccgataaccttaccgtcggactctgcccgaaccagcagcgacatccccttgagctcctccaccaggctcgcacgggctgtcctagcaggggctacggcggccgacaagtcccatgagcagcacctccgcttctgcacgcgcttcccaggccggaatgctcggcgctctcgcgaggaggggtaccgactggggcgggagtacttcggcgagacttcctcctctttcggcccgacttcctcctctttcggccccgcctcttggcgcggggtcgcaattgggcgggaggttctcgcgatctccccgtccacgcctgcgccgcgagaggccgctaggtggaaggggacttcggttccgcacgtcgtcatgttgttggatggcaccagtatgtgacgttcctaggaacttagctctgaggaaaaaacaaagcaaaccggggaagtacgtagccttgaaccggagtaaccagggacagaaaggaaggaaaagggtttcataccttcacggaacgacgctcacttcgtccgcctgaggaggaaaaataagtttaaacctttctgtgaaaaagaacgtggagccctttctgccgaatggaaacccgctaaaccccgttatggagtctgctacaattaagcatctaaccaggaattgtctatggacacaactctccaggcaattcatgcagaaagtgtgttgacgatttcctgtttcttgcagagcgcttcaccgttaaggctcttagtagctggcgattgtaaagcacattttccgcttcatgaaaatacagtgctcttcttgtgtttgtaaccttggaaagtaagtctgctatgataagtttagggaagtggcggggagctactttcctaacatatctgtgattgttttgatacttctcagtttctcgcgggcatttcctgcgttctctatagggctctcttgcactgaataaggaaaggaggaattctctctgcattgaggctattatcgcacattgtgcggtggatatagtcacgcgctgggtcgtagtagcgtgtcgtttatttcagtccagctcactcttggtagaatccctttattcgttttgttgtttttgatagtctctctctgcttcccaggctagagtgcaatggcgctatctcgactcactgtagcctccgccttgagggctcaagcgatcctctcacctcagcctcccgagtagctgggaccgtagacgcctgctccccatccccgctatattcgttctttaatacagtctctcagcttgttcagctgccacttctgtgcagctcattagcctgatcggtgaaaactaggcgagacgcgcacactgaccctgcagtgcatcttgggagttgtagtcataactaatcaatggtcttgttaaaacgtgcttatgttttgaccagatcgcttaagtgtggacacccttcagcagtacactacaacgtgggtcagtgtacagaacacatgctgatagaaataatttcaaaatctggattcatagtttttttttttaatctagagacctcagaaaatgtacttgaagaaaatcatcataatataatacataacaatagagccaattaattgatgtgatgaaagtggacaaaatgtattttgacctcagagaaaataacatttctgtcttggaagagtcagagaatgcttcacacaatttttgagcctgatgttagactctccagccttctgtccaagcctcaccctttggttactccccaggaagactgaacttgggaagaggattgtgcagaccctggagtcaggcttggcgtttgggatagggaatactagagtgcccacagcatggtctggaaaagggaaagtgggctgcaggtggctacagtcccatgattccatggatttcagacccctccaaagcacagggctcagtgcttatccaagtctgagggccccccataaccacatcttccccagcagatgttctttgcttcaggcagtcatcaaagttccacttcaaagagttgctaaccaaataagcccacaatcttccttttttgttgttttgaataagtaatgcctttacacatatgaaattaaaaagagaggccgggcatggtggctcacgcctgtaatcccagcactttgggagggcgaggtgggcagattgcccgaggtcaggagatccagaccagccaggccaacgtggtgaaaccctgtctctgctaaaaatacaaaaatcagctgggcgtggtggtgggggcctgtaatcccagctacttgggaggccgaggtaggagaatcgcttcaacctgggaggcagaggttgcagtgagccaagattgcaccactgcactccagcctgggggacagtgtgacagactgtctcaaaaaaaaaaaaaaaaaaaaaggcaaagatatatagtgaaaactaagtcttcttttagtctttgtctcctgccactcatagaattttcctcttggaatcacctctattccattttcctgtgtatgttgccagagcagggctggcttcatggtggtgacctgtacagataggcacttggtttaatgttttgctgtcactaacttgaaattcaggaaagtttctggacaagggccctgcggttttattttgcactgggcccacaaagtatgtatctagtcctattccagagatattctatgcatatacaggtaattatatgtagatatgtatgtagtggtccagtagtggtccagggcctgttaggaactgggcggcacagcagaaggtgagtggcaggggagccagcatttcggcctgagctctgccccctgtcagatgagcaggggcattacattctggtaggagtgagaaccctattgtaaactgcacatgcaagggatctaacctgtgcactccttatgagaatccaactccccctttccatggaaaaattgtcttccacaaaaccagtccctggtgtcaaaaaggttggggacctctgtagtaggctaccatctaggtttgtttaggtacactctatgatgttcacacaacaaaaaatcacctgatgatgcatttttcagaaagcatccccattgttaagggacacatgactgtaatggaatactattcttttccttcctttttattttttgtggagacagggtctctacatgttggtgcccaggctggtctcacactcctgagcttaagggatctgcctgctttgacctcccaaagtgctgggattacaagtgtgagccaccatatctgaacccctgtcccccactttttttttctttctttttttccatacacagtccaggctggagtgcagaggtgtcatctcggctcactgcaacctccgtctcccggattctaacgattctcctgcctcatcctcctgagtagctgggattataggtgtccgccaccacgcccagctaatttttgtatttttagtagagatggggtttcaccatgttggtgaggctggtctcaaactcttgacctcatgtgatccacctgcctcagcctcccaaaatactgggattacaggggtgagccaccgtgcccaggacagccttttttgggtcagtgtgtatatagagctaactcattctacttaatggctacatagtatcccactgtgatagccgcaaaaggcagacaaatcctaggcagacaggggcaggtccctggtgaaacccttcaagctgaggacagtttaaaggctagccacaagaccaggataaatccacagaccagattgagaacctctcttcccatttggcgtgctttcttctgattgatccccacccttcacctattttacacatatcctttcctaattgtttttttacactgttgtacctacctttgagtggtgctgttgttttagccttttttgcatactcacaaaccaatcagcatgcacgccttcattctgagcccataaaagctgtggactcagccgcactgagagagagaccacctgactttgagtgagggaccacccttgcatcctctctctcctgagagctgtttcatagttcaaataaaactcttctccaccctcctcaccctttgattgtcagcgtaacctcattcttggacgctgaagaaaaattcgggacccaccaaacgcagatacaaagaaggctgtacacactgtggccctttgccctctgctggtggagggcaaccgtcccacacaacgcgatgggaagcagcagtggggcagagccagtcctgaagccacgggcctgagtggggcaatgggactgatagagctgttaacatgccactgtccgttggcctgcagacggcagaactaaaagagtgcttagcatactgtaacacctctggggcttcagggtcatgagcacccctgtttgggtgccaccacatttccctcaatgtgacacacctggtccagccacaagccccgcacagagcccactcctgccctgtactcgttcactcacacaccccctcctgccaggggctgaggccatggtggctgcaggattcgtgcctgagcacaagccagacacatcctggtgggccgagtagttggggtgttgctggccggaggtctccagctgtcaaagtggccaagaaaaatcctgcatcaactgtacaaatgtaccctaatttatttaactcatttattgtatatttgtgtcatttccaatggttcgtaatttcaaacatatgattgtgcaaaagttgttttatgtgtgccaatatctttgtaggttaatttcctagagcaaagtttttcaacctaagcaccactgacatctggggctggataatttgttgtgaggggctgtcatgtgcgttatacgatgtatcctatccacccctatatgttatgaaaaatatttcagtggccagaatcctttcaatgacttaaaaagcccttttcatcctgcttctgcctacctctccagctgcatcttagtacccgcacactcttttttcatactcatgcccctgcttgctgtctttgcacaggtattctctttgtctggagctttcttcctcaccaatcatctcctaataactcccattttatcttttaaatgttgccactattatcacttccttggaggagccttcttggactgcctatttcaaatcccctgggttttttttttttctttgacaaaagccacattcgaacaaatcccccttggaatgttacaattaccaaaaaatccaatttaaactagtttaaatgataagagaatttattggctcacataaatgagaagtctgaagataaggtgaacctcaggttgatttgagtgacttaacagtatcagcaggaacttgatttccttctacctctcaattttctttctgatgtcagattcatcctaaggcttactccttttgtatcataaaatggtggccaggatctcccaaggttatgtagttctttgtccatatcaaaagagagtttctttcacatatttcacagtttcaatgtgattaaattaatttaggtcacatgtccgcccctaaacctagagttttgtggtctagagaatgtcaagcactgattggccagggcaaatcaaggcctatccttggaactggaagttacgttaatcccacctaaatcccatgaatgttactctatgaggtatcggtaaaatcgatgctaggaatacaatcagaatccattatatcctattacacgcttatagcaccatgcacccctccattgtagcacctgtcatacttgtagctttatatttatttgtatgatttctgattaataactgtcttctcatccagatgaaaaacctctattagtccagggaactgcattttttctcaccattgtatctctagtctagcacagggtgtcaaacatagcaggttctcaataactattgaaagaatgaaacttcccttagaagtttactactcaatttgacattccctttagcaggcaatttaatagctaccatatcagacttatattacatatttgaaagtcccagactgagatctctaatttctatctccaggcagtcagttcttgacacaccactgagtaagattcatggaataaatctgaccatattatattcccttgacatctttcaagttcctgatttcttttaggataaagttctttatgatgccattcaaagctcttcatggtttggcccctatctggctttctattctcaagagcaaaactatagacttctggccttcttcagggtgatctttctctttcaatcatagtccctccccaaccactcaccaaatatcagtttttagaagtcttgtctcttgcagggagtagagagggggcagtaatagtttattcagggattcccccatatctttcctgggtaaaggtattctagaaggaggcagaggaaggaggctagaggtcccactgtttggcattcaggctttcacttaatgctcactttagccctgcttcacagtcccctactacctactgtgactaatattctcaagtcaagagtctctcccattctagaaaataaatcaggctcctgggatgtggtgatggtgttataggggcatgtgtgggtatgagtgtgtgtgtatgtgtgtatgtgtgtggggtggcagtcctttggttatatgggattggggaatagacccaggaatgtaggtgttctttatataggctttcacccttccctaaaattttctgccctgatcctttctaatttttttgtggaaagaattagctcttttaatttatttattttattttattttatttcattttattttatttttttgagatggaatcttgctctgttgcccaggctggagtgcagtggtgtgatcttggctcactgtaacctctgcctcccaggttcaagcgattctcctgtctcagcctactgactagctgggactacaggcatgtaccaccatgccaggttaattttttgtatttttagtagagacgggctttcaccatgttagccaggatggtctccatctcctgacctcgtgatctgcctgcctcagcctcccaaagtgctgggattacagacgtgagcgactgcgcccggcatctttttatatttttaaaaggtcacatgtatgtcctttcctgtgaactgtttatattctttgccaaagtgctgggattacagacatgagccactgcacctggccttacctcttctttttttctttaatcacctgtggaggcttttagattgtgccttttgctgtcaagtctactactactcttccatcggcttgtcatacaaccatttgttgaaatttcttttgtattttgtttgccttttgggctctacactttttaaaaatttatttagctgtcaaagagatgacatactgtgtatggttaattttccatgtattctggagttctaatatattttcatggtttttaaatgtttagttctttaatcaagttggaatttttaaaatatatatgaagtaggatgctaatttaaaacttttcctccaaatggatatccatccagttgtctcaacatcatgtatagaaaaaacaaattgaaaatgctatcttatcatattatttactaaatttacatgcatatacatatacatacataacatatatctgagtttgagtctgaattcactactgtttcaattgctgtagttggtcaattctagtatgacagagttttaattgctacagttttggaatgattatggggttacttttgagacagggtctggctatcttgcccagactggtctcaaacttaccggctcaagcaatcctcccatctcagcctcttaaagtgttgggattataggtatgaaccactgcacctggccctggattgcattttgactgtggccatagaagtttccactcagatcttcaagagaacctactctggggactacaagtgactgacagccagctgccacccctttggaactaccatgcattcatgtcaatgccacatatctctggagtcgcccccagctagtggctgagcacagcaggagtactaaacttgttctttcttgcccagtgcagaactcctctaacgggcaactttggcttggggaacttctcatcagcctggatgagactatcttagaactacagtgtagtcgaggctctttctacccaatatttccttctcttctttttacagaagtcagacctgcaccacagtctgaagtctctctgccaattcctgagccttcccactttatccttcacaaacatttcccccaataaatatcttgcatgtctaatcccttcttggcatctgcttctctgaggaccagaacagacaggtggtttaccaagtggtgcaagaaaacagatagtaagatgggttttgggcaatggcttacttggtccctggcacaaagcagccatctgagtcctgatttagccagcagtgacctaggaaaacatcccagagaagggaaatcctcttgctcgtgcaatttaggcatttaaaagatatggggaatacgatgcctacaaagaaagcagagctggccaactgttactaagacaagtaatgccttgcagatggataatgagaaaccgagagcacttaaacagttaaaggctaagtgtgggagccgggggcttctctggagcttaacaaacttttatttcctgcagtggaagagcagaaatgggattggatggtcacagagctctaaagatatttgaatgctcagcctagggagatccagtatgtagtcagggcgctggttggggaaaccagcctgaagctttgaaacatggaatgggtgcccctgaggattttggctctgtagatacctctggacactcaagagcttacagaactggctcatacttcctagtaagagcaagcacttccctcattacagaaagacctcttccataattgttctcagtttttctcctggctgccaagccatggtaactggagttaacatctcagcataatctgcctaggaactgctggccctgataagaaaggaaagattacacaccgaaggaattgaaataagttaccatgactatcaggagccagagaagtatacttaggattggattttaagggtgttcaattaagggggctggaatttaagacaacataagcaagacttcatggacttggggtacttttttgggacagatttaacctcagcaagtagtcccgaggttagcttttcaaagcctggaaaaggtgatggctttgaaaaagtggaaatgaattcacaccatggcagcttttaacttgaggagaagatagctatttattttggcatatttatgtggttactgctcacttactagtcccaattgttttgtaaccactttttatttattttttgagatagtctcattctgttttctagactggagtacagtggtgcaatcttggctcattgcaacctctacctcttgggcttaagccatcctcccacctcagcctcctaatttttgcattttttgcagagatggggtttccccatgtcacccaggctggtcttgaactcctggatttgtgatccgcccacctcggccacccaaagtgctgggattacaggttttagccaccatgcccggccacctggcctgttttataccaatttaaagtgtttttttaggcttcacatggtggttcatgcctgtaatcccagcactctggaaggccaaggtgggaggatcgcttgagcccaggagtttgagatcagcacctgggcaacagagcgagacctcacctctactaaaaattaaaaaaaaaaaaaaaattaaccaggcatggtagtccatacctgtagtaccagctacttgggaggctgaggcaggaggatcccttgagcctaggagttcaaggttgcagtaagctatgattatgtcactgcactccagcctgagtgacagtaagaccctgtctaaaaaataaatagtggtttttagatgatcatctgcaaatatttttgttctttccctgtatccctttttaatctcatcacattgattaggacatccagaacactggtgattcttgttttgttcctgactttaatggccatgtttccagtgttgtatacatgttcctaatttttgatacataccacttgtgacgttaaggacatttcctgatattctaaactctctaggaaatggatattgaattattaaaaaaaaaagtctctttttagcctgggcaacatagtgagacccagtctctaaaagaacaacaacagcaaaaaatttgctggcatgctggtgcatgctggcagtcccagcacctcagcaggctgaggcaggaggatcacttcagcccaggagtttgaggctacagtgaactatgatcctgccactgcactccagcctgggcaacagagcaagaccctgtctccaaaaaaaaaaaaaaaaaaaaaagaaaaacaggaccattttttgcatctggtgaccatatggttttctcttaatattatgacaatttataactgttctcataaatgataatgatctataaatttttatgtttgcttttttttaatcatctcttctaggttatgagtcctaggcaattgcattaaattttataaccatagtattaaaaaaactatttatagtcaacaactcaagtttggttttcatgaaacactgggtatttttcaatgcttcccatcccatgcaggataaagtcagagtactaaatctcatattctaaactcccacacaatctgacgtctatttactggcttcttcatccattaataaaactgttccttctccacaaagtgcctttccctttataatcgtcctttaaagcccagctcaaatactaactctctatattgaaatccagttcaaattccacttcttagaaaccttcatttttccttctagtttacctcttctctttttatagcatgactttttaaaaactttcattatagtgctcaccaacctgcctttcattaattagtaactctgtattagactatatttaagtccctgaaggaaacaaactattccatagcagagtactgtgctcctaataggtagttttaaagtttttattacattaaaattaattttgtaaatttctgttatattgaagcctcttgcaatgatctgagatatgctttagatggcaaaactgaggttgctttaaatattacctttacaaaagtcacttattaccaaattgccttttagaccattttacctgtctgttggttgatgacttcatactcatatttaatgagtcagacatctctctcttttttgagacacagtctggctctgttgcccaggctggagtacagtgggacaatcatagctcactgcagccttgaattaccgggcccaagtgatcctcctacctgagccctcagcctcccaagtagctgagattacaggtgcgcaccaccatgccaggctaatttttttattttctgtagaacaaggtgtgaccatttggcccaagctggtactgaactcctgggctcatgtgatccacccaccttggcctctcaaagtgctgggattacaagccaccacacccaggccatctttaaactatttaaaactatttaaactctttaaaactattttgtccattggccaggtatggtggctgacgcctgtaatcccagcactttggaggctgaggcgggcagatcacaaggtcaacagattgagaccatcctggccaacatggtgaaaccccgtctctactaaaaatacaaaaattagctgggaatggtggcgtgcagctgtaatcccagctactcgggaggctgaggcaggagaatcgcttgaacctgggaggcggaggttgcagtgagccgagatcacaccactgcactccagcctggcaacagagcgagactccatctcaaaaacaaaaacaaccctattttgtcccttttagtttctatttatgtaacagatcctattgtcctcacaatcctcagcctgaaatccttagtcataactgccgctctcttccctccacttgccactcactccccattttatctgggttaagtccatccattatcccttatatttgctctgcaacatcttggtatgtgcccagcccactttttctgaatacactctcttctcagaagtgagctcttggtaattttctgaccagttgcttataccaggtttagggttaccagatttagcaaataaaaatatagacaattgtctgaccagttgcttatatctggcttatgggtaccagacttagcaaataaaaatataggacattcagttaaattatttgaacttcagataaacaaggaataatcttttagtgttacatgggacctacactgaacatctgtttatctgtaattccaatttaatttggcatcattattttatctggcaatctcagtcaggtttaacacctttcccaagctgagcttgtcatttcctccaaaagaacacaaacctataaaggacaggtaacgtcctgtgggacagccatcctttgccctatgctgagaaaacaggtttgcagagaataaaaacgaacaaataaataaacatttaaaaaagcagttgtgtggaaagaagcacaaaagagaggccatgagactccataattaagcagagatgaactgccctagttcttaatggcttgttagtcctcattccagtcttccacagggtgtgacttggcttccataaaataaactcacggtcccatgatcattttccctctttgctttagcaagaatctttaactaaaacaactctcttttcatttccactgtctaccactctagtctcaactctcatgagtctggaattttgcaaaagcctgataaacttgtcacatgattccagtgtctacccattccttgtaagtaaccaagatattcttgcctgattaaatgctttgaaaatatcatcttaggccaggcgcagtggctcacacctgtaagcccaacactttgggaggctgaggtgggcggatcacttgatgtcatgagttcgagaccagcctggccaatatggtgtaaccccgtctctactaaaaatacaaaacttagctgggtgtagtggcgggcgcctgtagtcccagctactcgggaggctgaggcaggagaatagcttggacccgggaggtggaggttgcagggaggtggaggttgcagggaggtggaggttgcagtgagctgagatcacgccactgtgctacagcctgggcgacacagtgagactccgtctcaaaaaaagaaaaaaaaaaaaatatcatattgtattggccatcccttgtttcatattcgttaataaactttgctactttgctttctaatttcggtgaagaacaagcacaagattaaggagtaagactatgtgaaactgggttataaattgaaaggctgttggctgttgtatcttgtaaacaattcaacgcaatgccaagtgaaaatgaagttgttagtccctctatctagaattctttcccaaatagctgcatatctttttcctctgcttcatttaagtctgtgctgaaatgttatctactcagagaagacattctggatcatttcatattaaatagtaacttttatcactctatctctttatctagttgtttttctttaaggtacctaccactacctgacatgttgtacagttaagttcttacttaatgtcttcgataggttcttgcaaactgtaactctaagataaactacataaaatgaaaccaaatttaccacaggctaattgatataaacaagagttaagatcctatggcacatttctggtaaaaaaaaaaaattaccaaacttgcaaataaagaccaaaacatttctgatgttaaacactgaagtaaatgtgagctagacaacattcaagaaagatgaataaaacaagatgatttatcaaattacaacagttcagggttttgggtggttggagcccatcctggcagttcagggtgccaggtgggaagtgatactagacaggacagccatcacattgcagggtgcactcacacacacatccacactcactcagactgggcaacaagagcaaaactctgcctcaaaacaaacaacaaacaaaataaaataaattatccagactcaggtatttcttctttcttttttgagatggagtctccctgtgtcacccaggctggagtgcagtggcatgatctcggctcactgcaacctctgcctcccaggttcaagcgattctcctgcctcagcctcctgagtagctgggattacaggcgtgcaccactatggccggctaacgtttgtatttttttttcagtagagacggggtttcaccatgttggccaggctggtctcgaactcctgacctcaggtgatccacctgcctcagcctcccaaagtgttgggattacaagcatgagccaccgcatccaacctcaggtatttctttatagcaatgcaagaatggactaatatactcctgcagacgtgggaaaaagtgcagactccacacagacggtaagcctggccaggaatcaatgttttgtttccttctcaacaacattttaatgcaaatgatgttgaaaaaaaagttattcaaggacctgctgtatcgtaatttgctatcaatttccaaactctagaatatgagcattggaactttagctgttttgtctgtttttgttattttgagatggagtcttgctctgttgcccaggctggagtacagtggcacgatctcggctcactgtaacctctgcctcccgggttcaagtgattctcctgcctcagcctcccgagtagctagaactacaggcatgtgccaccacgcttggctaatttttgtatttctagtagagacggggtttctccatgttggccaggctgttctcaaactcctggcctcaggtgatccacccgcctcagcctccctaagtgctgggattacaagtgtgagccaccgtgcccggcctaacttaggtcttttatttactgacacatcccctgcataccttataatgcctggcacatgttaaatgatgaataaaagaatgctatgcttggctgaactgaactaagaaagatattcatgttttcattttagatccaagaatgtaagatattctgtaatagaagaaaaaatgattatataaaaactgtactgtgatagaacagtaacttatggagtatgtgtgttcctgtatcaaaacaaaagtcatgggaaaaaaagtcttacttttaagtacttgtattgagctaaccaccaaagatggcattcagtttgatctgagtcactataaattagtgtttccagcatataatatagccgtcatagaaaaacttcattggggccaggcgcagcggctcatgcttgtaatcccagcactttgggaggccgaggtgggcagatcacaaggtcaggagatgagaccatcctggctaacatggtgaatccccgtctctactaaaaaatacaaaaaaaaaattagccgggcatattggcaggtgcctgtagtcccagctactggggaggctgagtcaggagaatggtgtgaacccgggaggcggagcttgcagtgagctgagaatgcaccactgcaccccagcctgggcgacagagcaagatgccatctcaaaaaaataagaaaaaataaaataaaaatacaaaaattagccgggtgtagggcacctgtaatcccagctactagggaggctgaggaaggagagttgcttgaacctgggaagtggaggttgcagtgagccaacattgcgccgccgcactccagcctggcaacagagtgagattctgtctcaaaaaaaaaaaaaaaaaaaagaaaagaaagaaagaaagaaagaaaaagaaaaacttcattggaaagtagggaaaactaccaacatttaaatgaagacaaaaataagaaaagttcagacataaagtgtaggctcttggtttaagcagaaatggtgttcttttggtggtttgcagttagtaagctgtatttgtactttgtgtcagttcaggtttctggagtttgtttaagaactggcttcattttccatattattaggagttgggagttcctttgaaaaagaaaacagaaaatttaagaaaaacacaaattgcaattttgaaattctaccattaaggatgatatcttaaaataagaattatgtcttagaaagcagaagtgagaataaaaacttttgttactgttattaaataatagtcgatatcaagtgtagaaagcaaataaatttaatctttcattttcaattaatctttaatatttcagaagtatatcaacattgcctaacatgctattttacacacaatagatatataatcaatgtttattgacttaaaaatctttggtttagccagataaatttgtaatattttatgaactagttaaccctgagtcatgaatttaccttttttttttttttttctggagacggagtcttgctctgtcgcccaggctggagtgcaatggcgcaatctcggctcactgcaacctccatttcccaggctcaagtgattctcctgcctcagcctcccgagtagctaggattacaggtgcctgccaccatgcccagctaatttttgtatttttagtagagatggggttttaccgtgttggccaggctggtcttgaattcctgacctcatgtaatccacccgcctcggcctcccaaagtgctggaattacaggcatgagcttctgtgcccaccatttttttttttgagatggagttttactctttttgcccaggctggagtgcagtggtgcgatctcagctcactgccacctctgcctcccaggttcaagagattctcctgcctcagcctcctgagtagctgggattacaggcgcccgccaccacacccagctaatttttgtatttttagtagagatggggtttcaccatgttggccaggctggtctcgaactcctgacctcaggtgatctacccgccttgacctcccaaagtgttgggattacaggtgtgagccaccatgcctggccagatatacctacatttttataagatttaaaattttttttagagataagagtcctgctatgttgcccaggctggagtacagtagctattcacaggtatgattgttgcacactacagtgtcgaacttctgggctctagtgaccttcccacttcagccttccaagtagctgggactacaggcacgtaccactgagtccagtgtatttttataagattttaaaaaagattacacattctaaattatgacgtccacataccatttacttttctgtggaattataaggtgatattttaaatgatgggaatgaacaacttgacatgtgtatcagtaacctctaaacatctatttcaaacatctattaaccgaaagtcatgatccttcagctcttatactaagaacttccatacattagagcaatacacatattcaaattgacctagttcaatttgataagtaaacaattttttttttttttttgagacggagttttgctcttgttgcctgagctggagtgcaatggcgcaatctcggctcactacaacctccacctcctgggttgaagtgattcttctgcctcagcctcctgagtagctaggattacaggcatgcgccaccacgcccggctaatttttgcacttttagtagagacggggtttcaccgtgttagccaggatggtctcgatctcctgatctcatgatccgcctgccttagccaataatctttctgtttaggtaaatttgaaaaatatacatcattactaccacattcatcctagttagaatctcatttatatttattccactctgtttatgatttggtaactaatttgaaaggcattatattatcaaaagtgtatcagattagctccctcaactcactatatctgttaacagttctgaagaaataggcactggctttgaatatggcctgttccagtttgtgaaccgttgtaggcaagtaaagttgttgggcacagaggtgacctgtaggatgactgaaggtaaactgtcactactgtatacaaagaagaaaaataagatgtaggaagagatctgttataataacatatgacatattctatctaagtttttcatatatttcagaattgtaaaaacaaaactatgtaattttttctaagatgtataaatgacttacttttaataataaatatttcttgatttataatgtaaatacaattaaacaaatatgggttactcgaattaaaaaaatggcacatgtaaatgagcattttagtacaaataattaaaatgtatttatattatatagaaatctacacaatggaagatactactaaaatgttgctctacagcacatcaccctagacaaaatagaattctagaattctctttaaaaaaaaaaatcactgagaattagatgatgactgtgaaataggttctcccattacaatactacttctgtcattcaaagttctgaccacggttgtagctggcgactgaagcacttttcgagaaagcctcattcttccatcggctgggtcacgtccaaagtatttcacctgtgttaaagaaacagatcttcctttaaagttacagcacattgagtgacatctaaactaatagacatttaaatttacatggtccaaataaggcaatgattgtttttacttgttcactgaaagcattgttcagtgctaagtggacgtatacacttaacacatataagtagtcattataaaagagaaaagagacggggcagttagttgttcaactataatctgccgctgaactcatctgtgcctttttattctcaccaggccaagtccttatactgggggaacagtcacaggcatagtgaatgatcctagacaagggctttgagagcctaattgtgttatatactatagaggattatgcttaggtcacttggattttcactactgctcaaaggaccaacacattagtgtttatttggcttcaccttggaaaatgaaagtcaggggcaaatgcaaaggtttaaagttccttctgatgtgaaaacaacaacaacaacaacaacaacaaataaaccaaaaaatcaaccttatacagagatactatatcttagcactcatcttcccctggaggctacttggacaataagactacacattgggaataaaccagaagccttagttactcaggtcatgcgtattagcgtaagtgaaagacaatgtggtggagcccgaaaaaacagactggcaatgacttctttcatccactcataaaggactacaaagaaagggccaattttgttatatgaattctaggcctgaataacatggctcttaccaagctcaaaaactttaagtagtggagaaacaaagtctcacctcctcaaagatgacattcaaagactttaacaagttaccttatcacagttcttacgtcagtgcccaaatcatggagtctgcatagctaacactaacatgctcatgtattttttaaacgaactaagggtgactaccattttggccaagctgcaagctccttgagggaaagaattgtgtcttaaatccttaatgagtctgttcaagcaattctaagattaaaaatgaagtactgcatacaaataaaaaacttcatagatggtgactcttctttcaactttttgaaaaaaacaatggaagcttcaagaacaatttacaacttcaaggctaaaaggtggaatacaaatacctgaatttcttggccaacttctaatcctagggcagtaggatgtttaatctggaaaaaaaaatgttaatctattagttgttgtgcataattatgtagtgtccatggaagtacacattttttcctcaagctttattagtttttctgattaaaaaaatcagttagcggctgggcgcagtggctcaagcctgtaattccagcactttgggaggcagaagcgggcagatcaagaggtcaggagattgagaccatctctggaggtcaggagagtgaaaccccatctctgctaaaaatgcaaaaaattagccgggcatggtggcgggcgcctgtagtcccagctactcaggaggctgaggcaggagaatggcgtgaacccaggaggtggagcttgcagtgagccgagaccacgccattgcactccagcctgggtgacagagagagaatccgtctcaaaaaaaaaaaaaaaaaatcagctgggcatggtggctcacggctgtaatcccagaactttgggaggctggggcaggcagatcacttgagctccggagttcgaaaccagtctgaccaacatggtgaaaccctatctctactaaaaatacaaaaactagctgggtgtcgtggcacacgcctgtagtcccagctacttgggaggctgaggcaggagaattgcctgaatctgggaggcagaggttgcagtaagctgagattatgccactgcattccagcctgggcgacagagtcagactctgtctcagaaaaaaaaaaaaaaatcagttaattataaagatttaaaatacagatgtattaagaacataaaaattatccaaaacaggctgggtacagtggctcacacctgtagtcccagaactttgggaggccgaggtggaaggactgcttaaaccagactgggcaacgtgaagaaaccccatctctacaaaaaatccaaaaaaattagccgggtgtagcggtttgtgcctggggacccagcttctccagaggctaaggtgggagaatcacttgagcctgggaggctgaggctgcagtgagctgtgatcatgccactatactccagcctgggtgacagagcaagaccctgtctcaaaaccctctcaagttgtagataactactgctaacattccaatgagtatcccttcagat

SEQ ID NO: 5452 - DNA, 4579 bp, Homo sapiens
gcctggggaacagagcaagatctcatctctttttaaaaaaaaaaaaaaaaaaaaaaagtgattttagtatgacaggaaagaaagagaaaaatattgttatatagctgtacaatgtgttttaagctaagtattacaaacgagtcagaatgttaaaaaatgtaaaagtttataaagtaaaaaaattacagtaagctaaggttaatttattatcgaagaaaaataattttttgatttagtgcaacctaagctgtacagtgtttctgtagtgtacagtaatgccctaggccttcgcatttactcaccgctcactcactgatgcacccagagcaacttccagtcataataagtgtcctggtcaggtgaaccattttttattttttgtaccgtatttttcctgtactttgcttgtttagatatgtttagatacacaaatactactgcattacaattgcctatttattcagtacagtcacatgctgtacagttttgcagcttaggagcaataggctataccatatagcctacatgtgcagtaggctataccatccaggtatgtgtaagtacattctatgatgtttacacaacaacaaaatcacctaatgatgcatttctcagtacgtatccccaacgttaagcgacacatggctgtattttcatctctttttcttcacattccatgtatgcttcttgacattgcttaaatttataaatcaaggtcctatttatacttatattactactgtattaatgctaataatattctgtaaactattctatcttgattaaggccattagtgcccattaaaattttttttaattgggttgaatgccttattcggttggaattttacattcccacaatgtgtggcagctaatgcttctggcacatctactgagaacataaaagttctcctggaactaacaaattacttcccttccaacataattatataatctgagagttgaaaagcaccctagagattattctgtggtccaaaatccctcccaattaaggaatctcatctaaaactactcaactctgtctgcaagaagggatgctaatatttagattctccatgacacagcgctgcagccatagcaggctctttaatacatgctttttgttgtttctcatacatgtttgttgaactgaacaaatctaaaatggacgtatttcactcattttatttttcttcccaggctttagctgtaacacccactgaatctgtaatttaaagctttgcatgattcctcggctcattagccaacgttcaaaaagaaattcaataaaggaaactcaatgcattaaagaaactcattttaacagtttaaaattttaagctcctggcctggcaaagtggctcttgcctataatcccagcattttgggaggctgagatgggaggatctcttgagcccaggagtttgacaatagcctgggcaacaaagggagaccctgtgatatgctatggctctgtgtccccacccaaatctcatctcgatttgtaatcaccacctgtggagggagggaacctgtaatccctcccatgtgttgagtgagggaggtaactggatcatggggagtttcccccatgcggttctcatgctagtgaatgctcacgaaatccaatggttttacaagtgtttgggagttcctccttcgcctcgtgcacgccggcctccgcacacatgtgcctggctgacaactgcggagcggcccttccaggatcaaagccgttggcctggaccgaaagccgcactcttcccagcccactgccttctcccgcggccgctctccccggtaacaggcggcggaaccgaagcgctccggccacaagccggctaccccctccgcccggcgcgccctgtgcagccgcactcaaacccgcttcccctcagccccaacgtcctttctccttcccccttttttcgcctcaggaaattccatcggaacttcattccgcccgagcggggcggccctggcacaccctcctccggcggccgcgcccctcgcgcctccacccgaaggggccggagacccggcgaccccggcccgcccagcctgccgcctcacctcctcctcgctctcgctgcggaaacacaggcatgcggcccgcttcttgtagccgtcgccgtcgtaggtgcgggtctggttcgacttgagcttcatcatcctccgggcccgggtgggggtgcggtgcgggtcgcaggagtcgaggggtggggagcccgctctggacggccgcgtgcgcgcgcgcccccggctcggccaagggaagcagggagggggagcttctccgctacacggctccgccgctggcccgccgcggccgcctcattcccccaggcccaggtcccgcgccgccgctgccaccgtcacggctgccgtctccgctgccgccagggccgccgccccctctgccgccgccacccccgacgacgaccgcgccgccatcttgggcgcgatgcgtcagcggcgtaaggctgcaccggcctgcgggacggccgcgcgctcgcagcgcaggccgcgttcgcgaatcgcgccctcccagttcgcgcggtggaaaccagcatctgaaaggagagggacgcgcgactccaggcgaccgctacgccggcagcgtaggcgtagaactggtggggtgcgcggaggaagccgggggagataagaacagcggcgcaggacgcctagcggccggagcggagaccgagcggtccagccgcgcaagtctgcggatggggaagcggggacttggccaaggtcacgccgcgtctccgcggccgaggatgaaccaaggtcacgccacccgcccctgggccctgccggtcggtctcgaaggggttgagggggaaggtttgttggaaaaaggaggatgtagttaaaggcaacggaagctgcagcctgagacatctgggatttggaactgcaaggaaacggcgcatgggaggcgtgtgcactttgcgttgatagcctgaacctcaggatgtcttaggggctggtgcatgtcgcccattacaaagaacaaatatttattctgcaatcttttattgatgctaaaggtaattgcttcctcttatggtaaacaagagggccagaaaggaacacgcgcgcgtgcgtgcgtgtgtacacacataatgtaaatcataaaacatcatcgtttctggcaataaatgaggagtgtgtgttgtggatgtcaaacagattctccaggaaaagatatacagacagaagctctccagaaaggaaaactggtgtatgacctgtgaatgttctcagcaacccagaacaaaccaagtaccatgcagatgccctaaacgtaccaaaaatcctgtgcagtatctgtctgtgagttgtttaatacccttttttgttttttaaatttttttatttaattttttaaaatttttttatttaacattttgttgcccgggctggtccggaattcctggcctcgaagctatccaccctcggcctcccaaagcactgggattactggtgtgagccacagcagccggctaattcccctttttgaatttgcttgtatttagcatagtcaaaaagatctggatttgaaagcaaatacaccttggttgtaacctcaattacattttttttaatgctcataccacccgattacatcatattttaacttccgcaaaatagagacctacttggccctggcacatagcaagcactcagggcacaccagatgctattaatagtttgtttgcctattaaactttcctctcttcaagaaaagaaaattagagttcagtaaatgttgaatgaatagatagatggaggttttcttttggtttctaattccttaccctgactttttatgggcatgtttttgtttgtttggggttttttgtttgattgattgttttttggagacagggtcttgctgtgtcaattaaggtggagtgcagtggcataatctcagccagctcaactgcagcctagacctcctgggctcaagcgatgctcccacctcagcctcccaagtaactgggaccacaggcgcctgtcatgcagcctggagtgctaccacgtccagccaacttttgtatgtttttgtagagacagggtttcaccatgttgcccaggctggcctcgaactcctgggctcaagcagtccttctgcctcagcctcccaaagtactggggttacaggcataagccactgctcccagcctatgggcatgtttagtttcaagagcccacaagattactcccagatcccttgactgagtaataattactttgtctttgttcagggagcattaaccaagggattctgtcctttccttgaagataatgggtaagtagtacatttaaatttgttttaaaaaattatactcggccgggcgcagtggctcaagcctgtaatcccagcactctgggaggccaaggtgggcagatcatctgaggtcaggagttcgagaccagcctgaccaacacagtgaaaccccgtgtctactaaaaatacaaaaattagccgggcgtggtggtgcgtgcctgtaatcccagccgctcaggaagctgagacaggagaatcgcttgaacccgggaggga

SEQ ID NO: 5453 - DNA, 947 bp, Homo sapiens
agttagtgcctggaccaggaccatcacactggggaccggcttctctgctctcccgttatgggggtcgggggaatgatgggtcaagggtcttccgaagaaagcgagaaaggaacaggcgccttcaaaagcccacttggcgatgggttacagtaagagggcccctccaggttcaacggtctcctaacctgtagtcacccacaagagcgtgccctttctgcccgcccttcctagcgttgctccctgcttggctgagcactgcggagtttcacgcctctaaaccccgcctcttcttgcaacctgtgttggcctcatctacccagcaactgtcgacgtcacacgacctgggcctccctgaatgggagatatttactaggcaatcccgcctactgttctgaggtttcccctccaggtgcagcttcagagccaggcgagccaggaaggaccagcgggcgaggtgtttcagagtgctggccacaccaaagcatcagccctggctctaaactccgttacagtaaggaattacaaatcctgtgtttgtactccaggaagtctgcattatcacgaggagcttggaaaggaggtaacacactcaaggcaaatttcaagtaactcatcctggaggcagctgcctactctgcagctgtggttctccaccacagagagaagaaaagggagggagatggagtgcgcaggtctgagaaggctttcattctggagcatctgcaggagcctgcaccatggcccagtagcacccctttttctccatgagctgctggtgggttcccccctcccggatagcgcctccttccagaaagaggatgtggtcagcctgctccaccaggctgaggtgctgggtgatgagaagcactgagcgggagtaccgctcagggctttcgtacaggagctgctccacctgaggaaagacatcggaccgtcagagccgggga

SEQ ID NO: 5454 - DNA, 5435 bp, Homo sapiens
ggcatttggtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaaggttctgacaacaaaggagattgtgacatattgctgggcctaacactaaggtgatgttagttatttgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctcataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttagggagaccgaggtgggtggatcgcctgaggagtttgagaccagatggccaacatggtgaaaccccgtctctactaaaaatacaaaaattaatcgggtgtggtggcgggcacctgtaaactcagctattcgggagcctgaggcaggagaattgcttgaacccgggaggtggaggttgcagtgagccaagatcatgccactgcactccagcctgggcagcagagcaagattccatcttgggaaaaaaattacaaaaattagccaggcgtggtggtatgcacctgtagtcccagctacttgagaggctgaggcacagcagtcacttgaacttaggaggcggaggttgcagtgagccaagactgtgccattgcactccagcctgggcaacaagagcaaaactccatctcaaaaaaaaaaaaaaaaaaaaaaaggttgtgtcatattcctggctaaaaacccagatgatgtgactctcctctctccctattcataggcaggattgtaaaatatatctttttttttttgagacagtttcattttgtcacccaggctggagtgcagtggcatgatcttggctcactgcaacctccgcttcctgggttcaagcaattctcttgcctcagcctccttagtagctagccaccacacctggctaatttttgtatttctattagagatagggtttcccaatgttggtgaggctgatctcaaactcttgacctcaggtgatgcacctgcctcagcctcccaaagtgctgggattacaggtgtgagtgactgcgcctggcctgtaaaatatatcttgacctagatcacagatgcaatgattactctcatacctcacagtatttaataggagagatgctctctcttgctctcgctctcttttttctttttttttttttttgagacagttttgttcttgttacccaggctgcagtgcaatggcgtgatctctgcccaccacaacctctgcctcccaggttcaagcgattctcctgcctcagcctcccacgtagctgagattacaggcatgtgccaccacgcccagctaattttgtatttttagtagagatggggtttctctatgttggttaggctggtctcgaactcccaacctcaggtgatctgcccacctcggccttccaaagtgctggggttacaggcatgaaccactgtgcccagcccaagatgctgtctcttaacagctaggcctagagtcatgaatatgattctgggtctccttgtacaaaggtcatgaagaattgccactttcttgcatactgtataaatctcttgtggtacagagagtgtcattacagggttcagcatacagatgagattgtttctcatatacactccccaccaactgttagaattgtcaccctcacacatggacagagcccactggtgaggccctgaatctcacacacacacacagtctacagttaaaattgtgactgtcatatgtgaacatctggctagagttgaaataatgacttatttctaaatccagttcataggtgagaattctacctgtctaagcctaggtaggatagtcaacatgtccctaattggctgggggacatgttgactctcctacctgggcttagggccaaacagttcatggaagggatgaaggctctcagctctcatgcacagatccagttggtgagattgtcactagcatacttagacccaacatactctgatacctagaactgggacatgtgcaggatttttaattactggaccttcctgcaggtgtgattgtgacatatgtctttgttacacacctgagtggtttgatgttcctgccttggttcaacccaaagtgaagattgtgatgtgtcactggacccagcatctcagtgatgtgactcttctttttggacaccacaaattttgggtattgtcaaatattgctggatcctgtacccatgttatgtgactctccaacctatgtcctgcatgttgtgccatattgcagcacaatgtgtcacattagacatcattacatattgctgggctcaacacccaagtgatgtaacattttcctgggccttgactacagggggctttgtgacataactgaatgcccataaccatggtaatgttactcttctcctgcctggtctctgctcacagggaaattgtgacataccattggcctagcatcttggtgatgtgactctcctctttttctcaggccccacatatttgggtattgtgacatacccaaatgtgacactgggctcaacacctaagggacgggagttctctacctggccccttcctgaagggggcattgtgacatacttctgcacaggtatgtcacagttattacctaggagatgtgactctcctcttttgccagcaccctgcttacagggaaaattgtggcacatttctgtggccagcaaccaggtgatgtgtttctcctgcttgggtctttattacagaaaagatggttgacatatcactaggcccagcatctaggcgatgtgactgtcttcttctgcctggtccctgcttacaggaacattgtagcatattgctatgcccagcacttttctcttcttttaggttttgcctgcaggagactttgtgacattgctgggccctgcactgacattatctgactcttctgtctctgcctacttgggccattgtgacatattgctgggtccaacatccaggtgatgtaacttttatgcctgggtcctggcaccagaggacattgtctttgcaccactcacacaggtgatgtgattttcttctgttacctggtctctgctcacaggaagaattgtgaccttggccaggctcggtggctcacacctgtaatcatagcactttgggaggccgaggcgagtggatacctgaggtcaggagttcgagaccagcctggccaacatggtgaaacccccatcttacttaaaacacaaaaattagctgggcgtggtggcaggcgcctgtagttccagccacccacgaggctgaggcaggagaatcgcttgaaccaggtaggcggagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagattcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttaa

SEQ ID NO: 5455 - DNA, 2494 bp, Homo sapiens
aagactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggtatgcaccaccatgcccagccaattttgtatttttagtagaggcagggtttcaccatgttggctaagctggtcttgaactcctgacctcaggtgatctacctgcttcagcctctcagagtgctgggattacaggcatgagccaccaagcccggcctgaaatacatttaaataaatgaagatggagaatcagacattactttcatttatctgaatctggtgtagtttaattaatctgtaattgtaagtctttgaatcatatgtcaatattctattttgttagtcatgatttctaagtgttacataactgtggccccagccactttatattttggtatcatgacagaagactctgattgtggttattttctacctatgcatttattcttagtgatatatgttggttaaattatggcatagttttaaaatacatgacaaaaatagctaacagtaaagaaatgtctttgtttctggttgaataaactgaccacgcaaggttccaatttaaaataaattctaaacgaatcatgttattttccaaaactgttcctcctctcagtaaatgaaatcaatatccacccggttaccccaagacagaaatctcaagatcatctgtgactccttcctcttcatctgccacaagaagagtagcttctatctccaaagctagtctctgatcagtctacttctcttcctatagcctctgctttagttcaaatctagaatcctgctgtggtggtgctgtggcttccaagttcatcttcttccaatccgttctctaaactacagtcttgctctttctaagactcagatcttataattttacttcccttcataggttgaatttaacctgctaaatcacataaaatttttctgaagataccagcctttctgccttaatcaaacacattagccaaatccatagcattactgggataaagcctgaagatcccaaattgataaggcatctggattccctttgataacagtattcaataacaatgaacacctactgagtatactattccaagcatttaaagtgtatcaactcttttcacaaaatcaacaataattattattgctaccatttattgagagtctactttaatccaggtgttacatattcatgtattcattattattacctttttttttgagacgaaatcttgctctgttgcccaggctggagtgcgatggcatgatcttggctcacggcaaactccgcctccctggttcaagtgattctcctgcctcagcctcccgagtagccgggattacaggcatgtgccaccatgccccgttggccaggctggtctcgaacaccttacctcaggtgatcctcccacctttgggattacaggtgagcccagcctattgttacctttaaaaccaccctgcagggtagctcttactgtctccatgaggaatatcagaaaagggaaaggacttcctggagggctggttctgcctcaagccaatcagctgacactaagcagtgaagccggaatctgaggtccctctgcctgccctggtctttgctcaccctgacaaccagacacctcactgtgtcctgagcagcatagatgccacacgcacagtgccacatagagaagggtgatgtaaatgaaaattaaaacactgtgacaaagtcaagcagggcatttgtttttgttgttgttaagttatttttggtagatacagggtctcactatgttgaccaggctggtcttgaactcctgggctcaagcaatctgcctgcctcagcctctcagaatgttgggattatagacatgaaccactgcacccggccagtgtcagtctttgttccctacaagtgaaatcaaaacagcctcacgcctgtaaacccagcagtttaggagcccaaggtggaaggatcgcttgagcccaggagtttgaaaccagtctaggcaacatagtgagaccctatctatacaaaaataaaaatagcctgggcagggtgactcatgcctataatcccagtactttgggaggccaaggtgggtgcatcacttgaggtcaggagttcgagaccagcctggctaacatggagaaaccctgtctctattaaaaatacgcctgtagtcccagttactcgggacgctgaggcaggactgcttgaacctgggaggtagaggttgcagtgagccgagatcgcgatactgcactctagagcctgagtgacagagtgagactccgtctc

SEQ ID NO: 5456 - DNA, 7991 bp, Homo sapiens
gtaacctcgcggcgggcgtgcagaccggacgccctcccgcttcttctaccgactgctaggcacaccagtgggttcattttgaaagaggcccttgcaccgggctttgcaaggaagccggcaaggttagattgaaggttagaagccaattagactagaatcctgcgatctggtgagactgccgccttaaaatgcaccaaacagtttttgaacctggagggctaacaggcgggaaaaacatctgcaagactgccaccgtgtatttttctcaagtaacaggctatccacagttttggaattccttagtgaaactgtcacacaggcacaaacacatgtcagctttccttctagtttgtaaataatatttgtaatttacaggccactgtattcccaactttgcaccatgtgatttagagaaagcaaagctccctctttaaaaataatatgttacttctgaaataccgggatattccacggcaagtaagccatattgtcgccagagcaaataaaccgcagccccatatcataattcactgggtgctataagatgtaacttggctttgctttgaatggaaagaatcctgaacgtctgtgatgtgatgaagttttggagactgggggcaggatttcctttgaatgtaaggaattcggataacttgttcaaggatgattctagtgaaaaacgtttgtcccatgtttgttgggacaaaaatgctggatatggtacaacattcttcctgcaggttcggttttgttgaagagagtgaggccagctcgaggtgaaggaaaaacatcagaaaggtgctaaagtgcagaaatatcttccagaggcactaatagccgactttagttcttgacctttagctagatccacaaagcactgagttaaaattgtacactgatcccttccagaacaaattaattaattaaatggtgcctcttcccagcgttaatcgtttaaaaggactcaagtacccacacagtttaagcaaactaaaagaacactgacactttctcagagaacagggatgggaactttctatctgcccattagtatctaccccaagctacgaagacttccattcctcttattaagcattcagcaactacatttagtgcctactatgccagtgatgcaagaatggataagacagtccctacactcaaggataacgcctctagtaggtgagagacaaaccgattaattctgcataagggataagtgctgtatgtgggaagcaatccaatgagggctctgaggatggcaaaggaagggttcctggaggatttacatttaactggtgccttgaaaggtgtgtagaagttggcaagatcaaaagggagtagagtccaggtggagaagagaaaagagcagggcaggctggatggcatggctcacacctgtaatcccagcactttgggaggccatggagggaggattgaggccaggagtttgagaccagcctgggtgacattaaaagaccctgtctcaaagaaaacgaaaggagcagggtatatacaaggggtctgccagccttctcagcctttctgtgagaagcgagggtagggtagtacaggagagtggcaggagatgacactaaaagtaggtctgtgttgatctaacgagtctcaactttactgccaaaactaatgaactaggaaagtttaggcagcaagggccagagatggagtctggacttgtattgcagaaagttcctgtgacggcagcttggagggtgaatgagagtgtgggatggaggggtgaatgggtgtggacagactggaaaaatgactcatgcagggaatgaggaagggaggagccttgggagactctcaaatccctggcttagcctactgaattgcttgctacttgcctttttatgtcttcattttgcctcccattgtctgtgatattaaaggcctaacttcttagtagagcaaactttgcatctgctagcaggttggtgccctagctagcttccatgcccctctgcttagaatgcctgcgaaccactaaggactaatcctagtggtagaaatttattttcaattgttctcaaacccttgtagaattccaagttagaactgtagtgttcttttttcatgtgggttagaaaatttgctgtttggagcaacatggtgaaacacaggacttttgaacctgcttatggtgcaaaaggggaaattatatttctacttcaacactggaggaggggggacttctgggagcaaaagagaaatggaaactgagatgagacatgttttttactccatgacagaatacaaagaaatacaaggatgatcctttaatgttagaaacagtagaataaccatcctggtaaataaaaaaggagaaaaaatgttattttacattagatacagaaaaacagaatggctaagaaaactcacaaagcaatggtcaatctataactcgagtccaaataaattgtgatataacactaaattaccactgatttggcctaattgactatcactggataacattataacatgaatgataatatttaaaattttaaagcactgtaacaaacaccagatcatgttaaaactattcaatcatgttgtcagctttcaactgccagtagcatcctaaccacatttcaaactatggaaattactaaaaaatcattattgtaataaaaagttaatagttcctcatttagaataccattgatattccctcagtgccaggagaacattatggtttctcctatttctgtgaagtgtatagtctacaggttcataagtgagtatatccatgagtataaaaagaaggtcatttatgggtggagagggaaattatagaaaacaatttcagatgaaataaactacattttcagataaaggaaagagtgttcactgcaggttcctgaaatatttcagtccattcaagttttaattataccaatgaatctcaataaaaatacagttaaggaatatggtttttatagataatgtcagctccttgtttaccaataataaagataaagataatggcagcatttatctttttcagtccaatggggatatttaaggtacctatgtaagtgtgtgagtgcctgtgtgaattgtgacttacttcttctgcataccacattcatagctcaataagctctcactgcctctgcaatataacttgtctttcctgacacacacacacacacacacacacacacacacacactctcacacaaacaaatcacctaaataaaaatatctcaaggaggtatactcttttaaaatgctatttttattataccaggataaaaataattgattgaaagatggtgtcaaaaccagaacctagtctcatgtcctgtgcttcctaatcaatatttaaatatagatggtcaagagaagatgactctaaaaggcaatcaaaagttgcaaacattcttgtatggagaatcaagtttaagtagatgcattaaatttatcacattaaacttcacaacagggttgaggagagaggtgagaccttcttttgtagaattcaaacttgttcagatatttgaatacatatacttgagagaaagaattacatgaatttagtttatcttcaaggacctttatatatttcatacacaacacaatttctttgtgctcattatttaaaaataaaaatatgtattctaatagatactatgtataataactagataactcttgactgctgtgtaaaggctgatagtctaatctcagaagagactgcatgaagtccaccactgctgagaatgacagcaaaccaaaagtgggctctgtctaggaggcaacagacagcaaatggctggggacccagcagcggaatgtgatttggttgaagaccctcggcaatggggtacaacaaaccttagaaccttacatctcagagttgaagagaagccataagactcatgatcctcgagataacataacttgagggaagggagatgtggtatgcctgtttgtgtgtgacttatttattatttggagtcaacacaatgtagaaaattcgaaattagtgaaggtagaatattttgatatcagcagtgtttccagttcccagagatagggaactgtttgtattacagtttatttccttctaggcttttccaatgcatttttaaaagcatagttaatattgtactatatatgcaatttcttttccaaatttaatcttttaagacaatcttataaaacaaaggccacctcccccatgtcatttatatataatcttcatttttcatgaggtaatggaagctggagagttggcccttgaccaaagccttgcagctaacaagaggacaagcctcctgccccacagtgtttcacagccagtaccccaagctcctgaattcatctgtctaatgtgtaatatatttataaacactctacctgggatgtatgcgtaccttctactatggactgttgttaaagacaagtaaatatgcaatcgtggtctttcaataaactaaacggatataaaaataaatatagaatacagccagaagatcaaaattgacatattatctatttatgcttataatatgtaattacatgtaatattgtaaaacactttctaccatttcataaaattctgtgttgttatttagcccagaattcccttgcaatcttttaaaaatagtatctaatagggcttttaatataaatgtcgtagtgaaactgttttatgtactgtaacccaaacatttctacgtagtaacactgttccatatagaaaacaaatatgaaaaaatatggccattgtcttatttatttctaaaggtaaaccaatctttgacaatgccaatagcagtgtcaatgttcctaaatgttggctgtatctatctacttactcattgtattcttgaggttcctttcctttggtttctatgatattccacatccctctcttttcattccattgtgtgagttctctctgtggatcttttgttagctcctcttattccttcttgcctatctgagtttcctgaaattaccttcaaatcatgtctcgaaagatgttctaaagagacctttgaataagaacaacatttgtcccattaataaatggtgggagtttcatatatctgtttctttttctcttctttcctctttgccttgtccaaaagagtgggaactgagcagtacagtcataaattaattttaatatattaacttaggcatcagtacactggctattgttccttaatacatttaacacatagtcattgactgctgattatgtgccaagggctgtgcttggcactggggataaagaagttattaagtcttttgcaaggtgttcatagtctagcggttggggacagacgtgagggaaaaatcacagttggaaaagagcgtagcaaatgaaaccattcagttaaattcaacaaaccctgcgtgcttaccatgtgccaagcagatggcaaggaggataggactgggcaaggccttgctcctcacggactcccaagcagctggcaaatggtaaaactacctgatacttgttaagagcttcatggcagaaagaaagtcagaaaaaaagtcatgaaaggctattggacagacaagaggcttgatcagaaaaacacttttaacaaatattgtcctagcaacatgaggagaaagtttgttgttcagatttttcatgctgtcattatggaaagcttactacatgtcaggtttctttcctagaggctgaggcttccttggcttgcctcagtgaatcccaaactggccttgcaactctctctctttgcctcccctaggctttcggtaacaaatcctcaactaggtgataggagattatctgattaaagtcattcacactaaggcgagaatgaggcttaatccctcaagagcgtttgctttaacaaaggatagcttgttaaccctaatgaactgctcattggaagaactctgcagaaggatccctcctcctcaccttcccagacttgccaaccccatgtccttcctttttatttgtctttcatgaagcaaaggagtaatgaaagtgttaaggactctaaggtcacacattatctccttgaacttaaaacaagaggtatgtgaggtaattatgaccccatgctcataatgaggagactgaaactagggcggtggttcttaaccctgactacattttggataggccggctgcaactcagacaaattaaatcaaaatttctgggaggggcatccaagcgtctgtatcttttttaagccccttagatgatttcaaagcgcagccaaggttgccagcttcttgcctaaactctgcaagaagctagagtttaggaaatggaaattaaccagaataggtagcaatccattgacctgttccattttttcctttggcaagtaaagtttatttggctcaatagaaacagaattatctgcaggaaactcgatctcatatagaattagatttgggtaggctggtgcccatatgcatctagaaatgagggagttaggactagctgtggatagctaaactggtggtgcaaggtggtacattttgtcatgcacatgcttggaagtggtgcttcttaggcaaccaaaatatgtttcactttatgccgggtaagcattagtggtccataggattaaaaacagataagacaaagagttaagatcacacaaaggagaatcctacatattctaaaatgcttagtttgctgtttgtttaaaattctataccctgtctcttgctaagaaattgtgattataagcacccccttgagagtgacatcagagcctctgagagataaagtgtgtccttggccacttccttttgaagatatacatatcttcaccagttacatactcatacatgtaattatgtgtattcaacaaaagctattctgtacattcaatatattttataaattcgttcaataaattaacatagttaaattataaacacaaacaagttagcagaacatacctcacttgaaactcatttgaagataatgctagacatcttagtttatggccttcgtgaatgtgccgtcagtccagttgaccctcctggccccacctggatggatctgaatgcccatgtttctgcaatgggcttagcaatgagtaactgctgacagggcctgattccatcgagccctcccagtaatgaatgtgtttttagacaatgtggagcattcttttcctttttcaaacttttctggccataggtcaccagctcaccagttactgctgcattttcattctaaaccttattgctatcaactttcctatccagtctacaatagtcactgagcacctggcataattccagtctttcctagagtctgaggctacatggtaagaaaaactagacctgaagcctcttgaaatatgcagtataacaaggacaatgaatatgaaatggtaaataattatgatcaactaagtaaataatataaatgtgcaaaatttagtgaatgagaaaaatgagagtgtgtatctggtgaatctaaacagataaacaattataattattttattgctctctcccttttttattgaattcaaatgtctcacattatagttgaaagtcttcacagtatttgtactacatgtgcacattgaattcttcttcatttgtaaggacagaattctattactagttgcatgaaatagtgactatttgtgttaagtggcaaggtgtccatcacatagcctctaaaggcagggtcggaagaaatctctgactgatcattagtactatgctcttgctgttgcagtctttggtgttactgtcattcacttcctgggcttaatcttttaagggtatgatatctacagacaaagctagccagcttatctttgataacttcaagaagtacagcatgtcggcttttggattaatatttgaaaataaaataaaaatttaattttattatcacttgttttgtcaaaaatcaaaggctcttttaaaatcttttttggctggatgtaaaatgatttttttctgtttctggatataaggtaac

SEQ ID NO: 5457 - DNA, 11335 bp, Homo sapiens
gtcgataggtctgctagcaacagccgtgctgcagcagagagagagagagaaatcaagaaacaagtcatagcaacaccgggcaccaggttctgccagctcacttgctgagcgttcagagatctgtcagggccagaggcctctgggtagcctaggctaggagatgacacgcaaggtggcacgggcggttcccgtggggaggaggtggggtggtggtggggggcaggggtgggagcaagaggttgtggggcgacggtggagggtttgatgggaccaaattctggaacattcgggactgcggcaccttacggcgggaccaagatttgggtctgcgcaggcggcgatgggtggtccgacgggcttcaggacttgatggcgtaacccccttcttcccccacatttgcattgacgtccggggctgtccagaggccctcaagagccagttgtgagctgagcccagtatgggaaagatctaccttctggaagctactactacgtggtgcttggaaagatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgca

SEQ ID NO: 5458 - DNA, 596 bp, Homo sapiens
gtatgttgatttatcaggaaagttaaatgaagaaatcttcaagaggccatttataattctgtttttaaaagtcaaaattgaaaagagttgggccaggtgcagtggctcacgcctgtaatcccagcattttcggaggccgggtgggtagatcacctgaggtgaggcgttggagaccagcctggccaacgtggtgaaaccctgtctttactaaagatacaaaaattagctgggcgtggtggcatgtgcctgtaatcctagctactcaggaggctgaggtaggagaatcgcttgaacctgggtggcagaggttgcagtgagccaagatggtgccatgcactccagcctgagcaacagagtgagactccatctcaaaaaaaaaaaaaaaaaaaattgatagagtttatactatttaatgtttaaatgttttctgtaaattaaacatcaatagacttgataatcatattttaggaacatttttttccattgaattatttacatatactgttgtactgtaaggctttaaattaattttaatattttattattttaattagcatttgaaatgtatagtgttcaataaatggattgctaaatta

SEQ ID NO: 5459 - DNA, 336 bp, Homo sapiens
tccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgtttattttgt

SEQ ID NO: 5460 - DNA, 4600 bp, Homo sapiens
acacccccagccgggagaagcgcccgagctcacacgggcggcggagagaggagtggacgctgcaaatcctccccgacccccgctgttctcgcccggaggcccaggacgctgccaggcggggcccttggggttcgcaccctgagccccagagcagccgcgggaccccgacggcgcgcgcacgctggctctggcctaggtttcaccttacaatcaataaatagaaagcgccacctgcaaagcaagggagggctggtcgtccaccaaactgctttccgctccccgctttgcaaggcatccgcagaaagggcggggtactggacccaggtcacagagccggagccagactcactcgagtaattggccagcccgggctctgggctcaaatccagcctgctggctgttccctagctgatgggcctttccatcgggggttcccttatatgtgagatttagaaaataaatgagtgtacctagcactttcactaatgcatctatccattacaacgggcggtgtgcgtgcagtaacaacaccgagacaatccttgtcccgcacttaaaaaaaactctgggcgctccagtgtttttgtttttgagacagggtcttgctctgttgccctggctggggtgcagtggtgcgatcatagctcactgtagcctctacctctctggctcaatcgatcctctcaccccagcctcccgtgtagctgagacctcaagtgcgcaccacctcactcagctaattttttaaaattttttgtagaggcgggggtctaactatgttgcctacgctggtctcgaactcctgggctcaagccatcctaccgcgtcagcctcccaaagtgctcggccaggcgctccagtttttatccaggcatctacactgtaagatagatgttgttctcccttggttgtaagtggggaagccgaagctaggcgggcagggactctcaccctcacgtactcacacaaacactgtctgcacagcctcttgggcagagctagcgctggcaccagtttagtttggtgctgaaaccatacccctcttgctctgcaagagcccatctccccttagaatattctttcgggtccacagcccaagacaaacctttgccacaggggaacgcagaggaggaagcggggtgcgagcaccagaatcagccctggcgtgtcccgcggggtggtagaaggtggtttgaagaacactccttggtggtcctaattgctgcacgtgaggtcaaggcagggccgcccatcccaggcagatgagctccaggagccttcctcgtgcctgagaagacggcaaggagaaaacactgccggctggaagccctcgagaatctcgaagaagcccagaatgaaaggaccaggcggccgggactcggagctccctagccagggcgcgcgcagccaggcctgacgcttccctccgccctcggcggcctctgcgtcctcccagcacccggcagccttgccaggggtcccggatgcccagagcaccccccaaggaggagagagaagagagggagtccaggatgagaagacggggggccagggtgggaggggacactcctcttccctggccgtccctagaagtcacacacagacattcactcaaaaagacacgcatgcagatgcgcacacacagacacaggcgcaatcatgtaaacggacacacagagaccacagacgctcgtgctcatacacgcgctctcgctcttcacaccctgcaccaggtgggcactcacccgcccgcaccctggctgtgctttcacagatcccgggagagggcggagcccgggccgggggctggagaccgcccccggccccgcccccacgccctcccatctctccctccttcctgccgtcccccgcctgagggaggggagcggtgcagcagacatccgagggcagctgggaccccctgactcagccgacggtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtctgccaagtgttggcgtgatttgttaaacagcaaccagtaactaatacgccacccatggctgccgcgttcctgctgtggggccagcactattccatgcttagaggctccatcaatacctgtgatggactaaatgacagggtctcactttttcactcaggctggaatgcagtggcaccatcttggctcagtgcagccttgaccaccctggttcaagcgatcctcctgcctcatctcctcaagtagctaggtctgcagacatacgccaccacacctggctaatttttgtattttagtagagacggggtttcaccatgttggccaggctggtcttgaactcctgacctcaagtgatctgcctgcctccgcctcccaaagtgctgggattacaggcgtgagccaccgcacctggtctgctgctgcaatcttaagatggccatataatatctcttaaaactacaaattccactttccttcttctgtcctgacctcaacttaatcacaaacaaacaacctccctcccaaaacacacacacacactcatggcagtccccccgtcaagtgtcagctatgtggtagttcgccccattctcctggggtgagatctgcagctggctctctgcccaggcactcggcactcaggccctccttccctacccggctgtcagcttaggggtcctcctccacctatcctcgtgagatctgcagacaaccctgtaagctctgaaccaaagaggaagaaatcctggggatgacatagagggctctggacacctcatcccaccagtcattgtcctggtcacactctctccttggcagggggcccgtgacaatgcttccattctcagagcaggtctctgggccactcctgcccctggagcctctgggatcggttcagactctgtcccatagcacagcctcttcatctttcaacaggctcatcttcaaggctacagcggccagcccccatgactaggcacctgatgtccattttctcattaaacattgtgacaagccccgaaggcagccattcagttttatgaatgaggaaagtgggactcaaggaggtgacggggaaggaagtgggtttaggtttattctggagcctgctctttaccaccgtaccactgcctctcccaggccagtgcactggagccagatggtatcaactgccagctcaaggacacctaggtcaacttcccaaaagaggcctaggggttgggcaaggaggccattgagattgtagaggccaggccttgcttgcccctggcattggggagaatgggcaccaccccaggccaactggggaagggccaggcaccagagctgcgtccttctgcccactcttgctgtagaggatcagagtccaagacgccaactccatcagacacaaggaccttcaagagcaaggaactaggctgggcacggtggcttacgcactatggggggctgaggcgggaggatcacttgagcccaggagtttgagaccagcctgggcaacttagcaagaccccatatctacaaaaaatctaaaaattagcttggtgtggctgggtgcggtggctcacacctctaatcccagcactttgggatgccaaggcaggtggatcacgaggtcaggagttcaggaccagcctggccaacatggtgaaaccccatgtatagtaaaaatacaaaaattagctgggcatggtggtgggcacctgcaatcccagctattcgggaggctgaggcaggagaatcgcttgaacccgggaggtagaggttgcagtgggccgagactgtgccattgcactccagcctgggggacaagagcaagacttcgtctcaaaaaaaaaaaaaaaaattagcttggtgtggcggtgcacacagtagtcctaactgctcaggaggctgaggcaggaggattgcttgagcccaagaggttgaggttgcagtaaactatgatcgcagcactgcactccagactgggtgacacagcgagaccctgtttctaaaaaaaggaaaaaacaaaacaaaaacaaacaaggaactctgcctggaagtccaactaagtcctgggaaggtggggacggggggtgggggtgaggggacaagtgaaaaagagccaggaagcccctcctgcatagccgcctgactcccagaggcctcctgagtcctcctccctgggatctggactcccctcccccaacccagcacttcttcctgggaacaagcccgtgtttggaggcagcatggtgcagggttaggagcagcctctgccactttctggctgggtaagacttaggtaagttacttcccctttctgtgcctcagtttccccatctgtaaagtgggaatcacagtagtacttaccaaacagggttgtctttttt

SEQ ID NO: 5461 - DNA, 348 bp, Homo sapiens
attctaaaggggaaggcccctttttattaaacttgtacattttactttccttctttcagaatgctaataaaaaacttttgtttatacttaaaaaaaccataaatcagacaaacaaaagaaacgattccaacatcacttctgtgatgagaaaagaggcaatggaattcaacataagcaaagaaaactctacctggaggaaagaaatcgatcagcgaggaaacaactcggggctgctgccagactgcaggccatgcgaggaggagcctcctagaggatttccaaagcaaacccatccctgccagaccaggaagcagccgtcctacctcccagagaaacagacctcagccc

SEQ ID NO: 5462 - DNA, 715 bp, Homo sapiens
tcacctacaccggggcgtggggaacgtcgcttcctgcaccccacatgccctgcgctcctggggctctcccacagggggctttcgtgagccaggaagcaagggtcatccccctgctccagcccagccaggctgcacaggcagaaggactctcccaacctgcccgagcatgcggggctttgtgttcactgtcctggcccctccctccgaaactggggctctcccatcctcagactccctggtggcctccgaaccccaacaaatgacaggaagaccagaacccacagcgcgacggcctgctgggcgcgtgctcagtgggacagcttggggcccctcaagctgagtcacaggggaaaggtgtgcttgcaccacccacgtcccaccggagtccgtggtggggctggagccccaggtcgccagggcggcatgggaacccgaagacggggcaccttcacctcccgagctcgtgaccccggaggcctccgcgtcaagcgcagatgccagccaaccgggcacctcccaaccgctccaggagccggggctctcgtctgcactcacctccagcctgttagatgagctcctgtcaaccccagagtttcagcaaaaggcacaacctttcctagatccggcgccactgggggagctgaaggacgtggaagagcccgctttgctggaaccactcctcagacaggaagaacacagggctctgctggaggag

SEQ ID NO: 5463 - DNA, 3284 bp, Homo sapiens
ctctacccacaactccccggggtcgcatgcggtcaacgtatgcgcgtgcgctcgccgtagccccgcccccaaatcccgtgggcctctgcggcatggtatttaatcgtctccccggggagattcgttctcatttttctactgctcgtggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcaatgttcagcccacaagagcttactggtgaaggaatgggacaagacccatctttatgcaaagccagcgttacagtaatgttccaggtaggtgtacatggtttatgctcttacagaggagaccttgtagataaccactccatgatgaacacaaaatgacaagcatatggctgaactttcaagtgatgtcatcttactactgagaagtgagagagaggtcttaaggggtctttgaatgactatttttaggtacataaaatgctttcctctgttgtctacagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaataccttaaaataactaatttgctttcctttccaggtattcctgatgacagtctgcctctatcttacagagcagcttgttgctatataccattgaaaagccttcagagctgagaggttagttgatattttttgttccttacagcttatgccaccaagtaggcagtttctatgatgaatcaaactagctcactatgaccgacagtgaaaatacatgaacacctgagaaactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacatagtcctgtttactttttttgtgtgtatgtgtctcttagcatcagtgtgtaa

SEQ ID NO: 5464 - DNA, 1700 bp, Homo sapiens
ttgcaagcctctgcagaggcgctggagctgggtcagtccgccgctcaccccgcggccgcaccttcccgccttctcaggtaactaagtgcgggtctcgggcctggcagaagcttcttcggccccgtgccctcgcctggccccgccccgtcggttgtgtgcttgtctcgtcctgcccccaggccctgccggtccccaccgttaggccggcgtccctgcccggccccgctgcgggctggcgccagctcaggaggacgccccgaagccgaggcctcggaagcaggtttttcccagaccttctcctgtcccgcgttccccctaggccggccgtagggaccagaccccaccctaagcccatagccggccttcgcgctccgggtgaccctggctggccctgtttgtctgtgggtcctgggatgcgccactcccggcaggaaggggcgccgccgaggcccggtctcagcctggaaccccgctcctgccgtcggggcgctttctgcggctgcccacacacgaccccaggcaaggggtgggggcgcgggaccctccatgacatggcggcggggcgctctcacttctttgaaaccagcgtaaactggacccgccccacctcccataccttgggggagccccgggaaaggctgtggcctgggggtctgcagggcgttggcagtggaggtggggagagaccccagccctttcctgtcccccccaccagccttgccttcctcgccgtgagccggggacagtggaggggagtcagggagggcccaccagatggactttcttgtgactcatcctataaagcccctcgggcttagccaccctccccaggacccgtgtggtctcccggactgtgctggaagcttagagccagaatgacttttccaccctcgggctggctggctcagtgggcagcagggacagggggctgtgaagagaaaactcactcgccagggtcaggggccgcttgctcactgaggaaagcagaggggttcctgccgcttgcctcaggaacaaagctagttggtgaggcactgccttgcagttgtaggagaggaataatggcccccgtgggtgcttggttggaacgattaaaggagaataacagtttagcacgattatttcacacagttgttcaaagagatggctttgaattccagcttacatggcgtcttcaacaaaaagtaattgtttagagaagtgacaagatgaaggaggactctgagtcctagtctccctcctcgagtccctgtgtgagcagaggtaaacaatgaaaactcaccaaccaggagaaattcacctaggactggcgcagaaggtatacaccatgagcctggaaatgatttaaaaaacaacacaggctgggcgcggtggctcacacctataatcccagcactttgggaggcagaggcgggcggatcacttgaggtttgcgagttggaaaccagtctgaccaacgtggagaaaccccgtctttactaaaaatacaaaattagccaggtgtggtggcgcatgtctgtaatcccagctactggggaagctgaggcaggagaatcccttgaacctgagagatggaggttgatgtgagctgagatcacacaattgcagtccagcctgggcagcaagagtgaaactccatctcaaaaaaacaaaaaaaacaacccacaactgtgggccaaagggacacagcgacaaggggt

SEQ ID NO: 5465 - DNA, 25444 bp, Homo sapiens
gttcaagcggccgcagagcggcccagagttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatgtaagtaaaatcggggtgcaggaacaaaacaagtccccttgctccggctttcaactcattggcccccgctcagcaactacctgcattgaaattccaaccccagttgcaggagcggtgttagtctcaaccaatactggagatgggagcctctctttccaggattggacggacctccgattccctagcacggtggatctcagactaaagcgtgtgtctctggagggcttgagaaaacatgcccagcttaatcctgggcctggcatcgagtgggggccagattgggtggatcacaagaactaatctttcatgatttggaaaccggaaggaaagaagcacttttgtagctgacttacctcaatgacatgaccagtgtctgagcctacaactgcgctatcttccctggatttttcttcaccttttccttactcatgagccaggtatgtgtttttagttccataaaaaagagccctggccaggcgtggtggctcacacctgtaatctcagcactttgggaggctgtggcaggcagaccacttgagctcaggagtttgataccaggatgggcaacatggtgaaaccccgatctataaaaaatacaaaaaattatccaggcatggtggcatgagccactattcccagctactcaggaggctgaggtgggaggatgtcttgagtctgggaggtggaggttgcactgagccgagataagtgccactgtgctctagcctggttgacagaaccagagcctgtctcaaaaaaacaaaaaaaagaaaaaagaaaaaaaaaattaccattccactaaggtcagaggcaacaaaaaaagacatggatttcagtctatcctcatggagtactagctcacgattacagggtttcagcttgcttgtgatagtcttttcctgacattcccttactgactgctttccctatggactctatatcagatgcagagacacagccttacagaagctgcttaaccaactctaataaccacataagccaattccctgtaacaagtttctttatatatgtatgtatgtgttcgactagagaagcaggaccagtgtgaggtatacagaggtactattcccagactgtgtgcatattgcatactgattccccttcgtcttttaggtgtttatttcctaggcttcacagtttccttacaattccttacattagtattctgctgaatacatggggaggactaaagaactttccagcgttccctctctgtgaagccctctcctctctaatattctgcttgcaaactctagctgccctaatatttttgcactccactttttctacttatggagtctgctgggggtctgcctgtgttccctctctgctgtgactagaacgtgttccctaaagtttgtgtgttagaagcttaatctccaatgtaacaatattgagagttgggactttcaagggatgattaggtcatgaggatgattaggtcatgattagggcattagctctgccctcatgaaagaattaatgttgttgttatgggagtgggttagttattgcaggagcaagttcctgataaaaggatgagttttgctcccttcccctgtgtgctctcttgctcttctgctttctgccatggaatgactcagcaagaaggccctcaccagatgcactcttcttgaccttggacttcccagtttccggaactgtgagaaatgaatttcttttctttagaaattgcttaatctgtggtattcagttatagcaacataatatggactaagacagaaaattggtactgagaagtagggctgttgctatgagaaatacccacaaatgtggaagtggcttaggaactggataatggatagaggctggaagaatttggtgtagcaaggtagaaaaagcttggattgctgtgaatggtgcattaagggcaatcctggtgagggctcaaaaacagagaagacgagagaaagtctggaacttattagagattatttaggtggttgtgaccagcataatgaaagaaatatggacagtaaaggccattctgatgaggtttcagatggaactgaagaacaaggtattggaaactagagcaaaggccacccttgttataaagtagcaaataactgggctgaacagtgtccgtgcccagaggctttatgaagggtgaaagttaagagtgatggactaggatatctggtgaaagaaatatctaaacagcaagtcctccatgctgtgcatggctacttttaacttcttacagtaaaataagacaggaaagagacgatttaaagacagaatttatcgttaaaaagtccgtatgcattctgtcctgcccttctgccttctactgtgggatgatgcagcaaaaaagtcttcaccatatgcaagcccttcactgtggacttgccagcatccagaactgtgagaaatgagttcctttataaaataaattacccagtttgtggtattctgttatagtaacacaaaacagactaagacaccttttctgtgctccggcctgggacactctttcaaggcagaaagatgggccaattgcagggctcaccttatttgtttcccatccctcaggaatcactgtcctttgtttgatgtggagtgttttgaaaaactgttgtttcttatattttgtcctgtgatttggttgttttaggtggaagagtaaattcagtccttgttacttcatctaagttgaaagcaaagtttcaatacatgtattttgaatgtaagaataaatttctctttggcatctatcatgaaattaaaccttgaattatgaatatatctgatacttaggaaaaaaattaacttttttagagtgatgaccctttatccaccagtggtgtgtgtgtgtgtgtgtgtccatgtgcacacacacatgcacaaattttttatctaccggtggtgtaaatttgttattgtactaaaaaccttcacttcagaacacttttagaaatgtgtattagtgttgttttatagcaaggaatctttggattgttttatggctaggaaatgaaccaacctgtaaattgtgtaattgtgtttttgttaaattagtttgcccatctactcacttttataattgaaacctggcaaattttcttagtgtttccaagtactatataggaagttaaaatactatgaatactaggtaaatatgagttgacccactttatagctaaaaagagaaaacattctgaactgagatacacagtgagtaagcaaagggagttgctactaatattttgtattctccactgtgggccaggaaaactgccaagcattttatattatttatttactcttcatactcttcataacaactttgtaagtggagtttattgtcccattttacagatgagaaaaatgagacccccaagaagtttattacttgcttaagaatatacaacaagtgtcatagctaggatttgaactcaggtttgtctgcctccaaatttcatgtttttttttttctcatgttataattctgtcatggaggttaagcctaccattcgagtcattacatttagtggtgttttcgcagggaaagagtgaataagtctggccaattggtgacatgtaagacatggaccagtaaaatacagtttcggtggttattaattaaaggcctatagtcactcatgaataaagaaatcactaaagcttgtgtgcagcatactaaagctaatttatcataatcatagggtttaggtgataacaaatgaagtataaaaccactggttaggaagaaaaaagtgattgtatctcccttattttcatcatagtcaaggtaatatttcttaaccttacccaagcactgaaacagtccagaaattcctccctaagtgaagagtatgaataagtccattgactcagttacaacatcaatcaacttttattgagggcctacaatgtgcttagcactcttccaggttttgtgatgaggtatgtatgtttgaatcgattagagagtaattcaatatgtgctatagatcaaaggttgaaaatataggtctacccattgtatttagaaggtaaattagttgtatatttcatatgaaaattccgatttatttcttcttttaagaaaaaaaccggactttccagcttatatttaaaaaattaagaagagctggtagcaattgctctaccttagataagggatgggttcttgaatttgtcacaataactactatgtcctattggttcttctacaaggaagctacgtatcaattgtcattgcagttgtcactgtcgattgtcaagaatattgcctgactaactgctgatggcatttggtttgtagcctcgtgctgtagacttagagaaggcattatagatgcttttgtgcattttgtttagctcagagtttcttgagagttaagggaggaagaaaagaaataaatggattttagaatgtaagactgactttggaagagaatctatagttggataataaaactggatgttgaaagggaagtattgatcagaggagcatttcaggaaagaagtgtgtagaagaaggaatgggtaacaaggtcattagaaggaaaattatcttggtaaagatagatgaaagaagagaaatggaaagaaaagggagaaaaaagggaagaaagaacagggagaaaaaggcaggcaagattttctgtggaaagaactgcatccctatgacaacaaaagtgaggaacgtcaagagtatagtggacacttaaccaagcagagtttaggtcttggtcaaatagaggctcacacattgttttttttaaaaagcaaattagctgtcattttatcatataaaagtccagatttctgttttaagaaaaatctgaattactagcttgtatatatatgtgtgtatatacatatatatatttagagatagggtctcactctgccacccaggctggagtgcagtggtgcaataatagctcactgtaaccttgaactcctgggttcaagtgatccttccacctcagcttcccgagcagctagaactacaggtgtgtgccactatgcctggttgcctttttctttagagatgggatctcactatgttacccaagctggtctcaaactctggcctcaagcgatcctcctgctttaacctcccaaagtgctgggattacaggtgtgagtcactgagcccagccttctagcttattttctttttcatcaaggctgatttatagagaattcacttctgattactgaggttgtgggattccctccttatgtaatggaattatgatgagagaaactatcaataaattaagaaaatagtaaaggtggagccaaatgtgatctagattgttccaccttaggggacattttgggaagagtttgtgccaagtcaaagggtgaagtcaccaaggacataatttgcattttattttaaaaagttaaattataccttttttctcaagaaagatctagtgctgcagaatttttggttgatcttctgacttgggttagttcagcataaataataaatcatgtagttgccattctttgttgctttgctatatgatttgctgtaattggtttgtggtggagattgtgggttgccagctaatatccattctctccttttttcgtagtaaaacagaatcctgattttattctgggctgcagtgtgcccagctaaaagactatactacgtttcacagctttccttgcgaggtgtagccaatgggatgtaggcagaagtgttgaatgggttatccaaaaagattgctgtgttacttcattttctgtatactggaaactgggtgatttacaaagagaaggaatttatttcttacagttatagaggctgagaggtccaaggtcaaggggccacatctggcgagggtcttcttgctggtagggactctctgaagggtcctgaggtggcacatggcatcacgtggtgacagaactgagcatgctagctcaggtttttcttcctgttcttataaagtcaccagtcccattcccatgataatccattaatccattatcccattaattcttaaatccacgaatagattaatccactaatgagggcagacctcccatgaccccgtcacctcttaaagccctacctctcagtactgccaacattggggattaagtttcaacataagttttggaggggacaaaaaaatattcaaaccatagaaattgtttaaaggaagctgactcagttgggataagcgcctgttttggtcttctttctttctttttttttttttttttgagacggagtcttcctttttctgccaggctggagtgcagtggcacgatcttggctcactgcaagctccacctcctgggttcacaccattctcctgcatcagccttccaattaggtgggactacaggcgcctgccaccacgccagcgaatttttttgtatttttagtagagacagggtttcaccatgttagccaggatggtctcgatctcctgacctcgtgatctgcccacctcggcctcccaaagtgctgggattacaggcgtgagccaccgcacccagcctggtattctttcttattccttccgcttcctggaatgccaacacgatgctggaagtctgatagctgccttggaccatgaagtaaccgtgctatatggatgtgctgcagctggtggggcagaataatagatggagtctggggctctggactgcctgtttatggacttgctatatatgagagaagaaaccccatgtgtttaacctcttctcttttgaattttcagttaagtgaagttgaacctaaccctagccgaaagagcactgttgtctgaatgcaaccgcaggacactgagaagctggataagcactctcttagtgctctgtgttggatttgtgtatggcttggatcacactccctaccctaaccttgattccagagagttgggccagctcagggtggggtgtaggaggatacactgtatacactctgacagtatatgtgtctcctcaacattcagaggccacatggcagggcagatgtccattaactatcttgggcttatcacatctctttaataaacaacagtggggacagatagtgccctacaggcatattacagggaagacttgatgaaatttagcattgtttattgtctgtcttacaaacaatgcacttagatttttaccatgaaactagcagtagagtccctgaagctcaagtttaaaaagcctcaagtcaaacgatatatatatatatatttgtaattttgttatgtgttggagagttgacatcagctggcatatatgactgtccataccagctgttatattattaaaataatttcggccgggcacggtggttcatgcctgtaatcccagcactttgggaggccaaggcgggcagatcacgaggtcaggagatcgagactatcctggctaacacggtgaaaccccgtctctactaaaaatacaaaaaattagctgggcgtggtggcaggtgcctgtactcctaactaatcaggaggctgaggcaggagaatggtgtgaacctgggaggcggagcttgcagtgagctgagatcgcaccactgcattccagcctgggcaacagagcaagactctgtctaaaaaaaaataataaaataataataattttatactgattgggaaatagctattgttcaacctccccaacaccaggctcctccctttgggccttctagacccctacatgaaccagcaagtaagaggtgaatgcttgacagcagggatcttcctggatttagtcactacccatttgcaaagttaggcatttgagcctatggtgttgttgacaaaaagagtcaaactctataaaatatttgaagagatttaaactgagccaaatataagtggccatggcccatgactcagctttcaggagatcctgagaacatgtgcccaaagtggtcaggggtgcagcctggttttatacatcttagggacatgtgagacatcaatgaaatacatttaaggtatatgttggattgctgtagacttagagaaggaattatagatgcttttatgcattttgtttagctcagagtttcttgagagttaagaggggaagaaaagaaataaatggattttagaatgtaagactgactttggaagagaatctatagttggataataaaactaggtgttgaaagggaagtattgatcagaggaggatccagaaaggcagggcaactcgaagtggaggtggggtgtggaatggggtggggcttttaagttataggtagattaaaaattttttgggttggcaactggttgaaaaagttattgtcaatagaaaggaatatctgggttaagataagaggttgtggagactaaagttttatcatgcagatgaagcttccaggtagcaggcttcagagagaataaattgtaactgtttatcagacttaaggtcctgttaatgttaaatgctggttggcttttcctgaattcaaaagggaggaggacataatgaggcatgtctgatcccctctccagcccctgaatcatggcctgaaccagtctttcagattaaatttagaggaccctggcctagaggaggaagtctattcacatagttgtggggcattcacattttattcctggattatagtgtcattatcccagcagtaagttactgccgtccaatatttatccgtagtttgattgaaacagtatacaggggatatcgctccaggcagtttatagttcacccctggatcaaatcagatccacagagaaactgagaatgtgtattgcatttcaattagcctctgctaccccttgtcaccctgagaactggtcttgctgaattgtcatgcaatcagcatgacaatgtgatgtcatcagtctgtgctgtcaacagcctgggctgagagacagggagggaaacagcacaaatgacactcattgtcatctgtcttttaggaatgttgtcaaggatgtgttttttttatatcatggtttctatttatgaggatactcagagaactgcctaactgcttttcgatgtaagaacaattgtattactcctgagaaactgttctctttttaactttacaaatctctttgtaagtgtctagttttcccttctccttgtttttgtaggtagacttacatctattctggtatgaagcagagaataaataaataaattaagttaaattaaatgaatcatatcatatttaaatgaaattatgaaaaaactcaaagcccatgatcaaagaaacctaaatacgtaagcatttcgcatttttttcctcagtggaatttcagtattaacttatcacaattatactaattatgatactcaattttaaaagctctggaatgaaaataataactaactgaagagaatattctctttaaattcatatgttcacagacatataagctcttttttattaccatatttttacagataaacacttcagcacagtcaaggccttgcacaattaaatttggaaactttgcttcaattctaagggaggcacagtatgaatgtttttgcaggctttgtcctaattttcctttgaataaacacggggagagtctgttctccataattttcataaacatgtaatctggacatacccaagtactatgtcttctgggattttctttccattttctccttctgttgataaatggattccaccaggcacggtggctcttgcctgtaatcccagcactttgggatgccaaggcaggaggattgcttgagcccaggagtttgagaccagcctgggcaacaaagtgagacttgtgattcccaataagtaaaaacattagccagatgtggtgaatcacatgcctgtagtcccacctactcaggaggctgaggcaggaggattgtttgagcccaagaggagctgtgattatgctactgcactccagcctggcaacacagcaagaccctgtctcaaacaaaaaagaaaagaaaacaaacggattcaaatctcgtcccatgtaactctggaatgtcctgttcgctctctaagattatcaaagattcccaagagggttgcattctcctggttatctcctactgatagcagcaggagacagccaaattcctaggcagacaggggcaggtccttggtgaaacctgatgttcaaggcaaagacagcttagagcctgaaaactgggctgccagttccaggttgggtcctcaacccgaagtgagaactttcttgatactatttagctaattgaatggtgctttttccaggccagtccgtggaccactcagcacacactcccctattctgagcccataaaaaccccagactcagcgacatgtcggaactacctgcctttgggtaggggctacccacttaaggtcccctctggtgttagcagctgttttgtcactcaataaaactcttctccaccttgctcacgctctggttgtccacataacctcattcctcttggacacaggacatgaacctggagcctgcccggatgcgaaaggagctgtaacactgaatccctctcaccctatgccagtgctggatggctgtcccatgtgatgggaagtggtggtggggccaggccagcccaggagccatcatgggccagagtggggcagcaggaccaaacaagctataacacaaataagctgaaacatgttcctggctggcctgccaagctgccagcagtgacatgttcccattcgccagactacaagacaagagagctgtgacccttctggggacccagacctcgggactccctgagtcagagctgtgacatgctgtaacacccccttggggctctgtggttgctggtgtctctgagtttttgggcaccactgcattccccctgtccagatgctgctgcctggcccagctacagcccctcacaaaactcacgcctgtgctggtgcctggagctgcccaccccactgcagcagctggcacacctggctgtgcatcatggctggaccctacacttgctcactcacacaccccttgccattctgtgcctggcttgtccacagtgggcatgggatctgggccagtagcgcaagctcagtacagcctgccaggccgagtgggtggagccagctcagcagtcaaaagtgaaactcaggcagaggcaccactggccacagaggttaccgaaagaatcgtgtgtcactactgttagcggtgcctaatttatacaggtctgcagcaacttcagttcttgccttctaagaagagagaattcaactgaggtgggtcataaggcagagtcagagactgaggcaagttttaagcaggaatgaaagtttattaaaaagttttaagtaggaatgagaggaagtaaagtacacttggaagagggccaagcaggtgatgtgagagagtcaagtgcccagtttgacctttgacttacagttttgtatgttccagcatcttctgtcccttctcacctgattcttcctttgaagtgggctgtctgcatgcacagtggcctgctagcacatgggagggaccacaggcacagtgagtttactggagttgtatgcatgctcaggtgaggcattcttcccttaccagttgagtgttcctagaggaaggtcatataccagttaaactctgccattttggctcttaacgcacatgcttgagaccactcacccaattcctgagatcttatcggaaagctgctgatcaccagtttcagttttttccatctattgggagactgcctttctctggtgccggctgcgacccattagtattttggagagacagttaactacctgactatcacctgatggttgcctaatgttagtaggggggcatctctcctaccctgctcatgtctgcctgactacctaatgtaacactactttaaattattattctggttgatttcttagccccaaagatgaatcatccctcctcctttcttatttcccaaaacattactaacacagggttattttgtgtagtactttttaaaaaattagagataacctaagaggccacagcactgcacaaaatggggatcaccttaaagttcagtgttaggcagcattgcccctggctatttccatcataagtaaacagccttctttctccagagccccctcctgctggcttgttgctggcccctcctcttcttcttgtttattgtacaacaaaaccgcacaggcaaagcttaaaatttgctggtactttaacttgcagagaaatttaactgcttccctcaacctcctgcccatatcagaatagaggcctttgtatgctagagtttccaataccaaataatggcaacaataataaatagtgacaacattttacattatatattactttaagttatagcaaagcaaattttgagtagggctctctccccaccagcaagattcttgggatcttatcgtttgtggggaggaatctggaaactgtattataatagacacccttttatctgatattattgaattgttagtagggtaactattaacaattaattgaaaagtcagttaatacaaagattcataaaatgatatgttttatattttattaaaatgtgtaacctgttcatcttttgatgttgggctgagttttcttttgattacttagtaattagagttctagtgtttcttttttatgaattctagctataatatatttgatacagtgtcttgtttttatttaaaataaaatgagaacttaatattttaaagcaatcattgcaaaatccacttagatttttacgattatttttcaccaatatttatatttatctaatatcttatttgaccacagtcctctttagcaatttgcttttagtttttccaaagtagtcaatttatgtgtcctagaagtgacaaccatcttttttttcattcatttaatcagtttcattatcttttaatatgcagttacaatcggatgtaaaattagcattaacatctttggggctgggcgcggtggctcacgcctgtaatcccagcactttgggaggccgaggcaggcggatcacttgagatcaggagttcgagaccagcctgcccaacacggtgaaaccctgttttactaaaaatacaaaaattagctaggcgtggtggcaggcatctgtaatcccagctactgaggaggttgagacaggagaatcgcttgaacccaggaggcggagactgcagtgagctgagattgtgccattgcactccagcctgggtgacaagaccaacattctgtctcaaaaaaaaaaaaaaaaaatctttgggagcagacacgatggactcctggtaagtgtgtatttcatggtgacataagggccaaatgaggcagcagcacgtggggcaggtgatgttctacagaaggaatggaggatgttgattagtttagacagctggttagtggaggtgctttatgacagcttctctgagagcagattaatattagtaatcagaggcccagggccagctctgcctaccaggtatatgatttcaggaatgtaacatcacttctctgaaactcagtttcatctgtaatttgtgaaaaaaataacatttgctaaacctacctgccaggaagatcaaatgaaataatgtacatgaaagcctttttttgaaatagcaaaatactgttaaaaaataggtgtttttgctactttaggttttattttatttacaacatttgataagctgtagggacatacttccttggagtctctcctatcttttcctttatttatgatgactggtattccagattttcagcttaactggagtggtatgtgatgtagaaaggctattggagctttattgtcttgaacatgagttaccttttctcaaatgataagtaacagcctttccagattctagtttcagaaataaattgggttccaattatatatacgttgaaacatgatggttgacctggcaacataatggcccccaaacagaagtattcattttccccaaaactgtacataaatttcagcttctgacacttaagacctctgatggtgttattcaaacatacaatcattttggctaaaagtcttcatagtgcttatatgtagatatataattttatatagtgaatgtaaacaatgcacatgttatgatattaattttacagaaaaggaagctgaggctgagagggattaagaatcttattgaggctcataagcgtagtagcaagtagttggactgagacacgaatctagggcttctgatgctaaatgtcataatgactacaactgaaactctctagatagcagagattgaataaatatacctgaatgagtcacagagctggagcaaatagtagatacactggatgtctgacaagtcaagatgtataggaataatttcatttttaaaagtatattgattgcatttaaaaataatatagtccttaagattttctacaatctacagaaaacttttcaggtgaagtacctcagagtttaaagcaaaggtctaattttttattctgaaaaactacaataaatatactacttatgtatccagacctattggacactgtgatatcaaggttagttagaaaatgccagtaaaaatctcaacattttctcatgagacttgattgttgtatttatgctttatattaggatcgtgtgatataaatgaaatacttagtattgtaagaaggatttaatccttgtatttataacattaaacagagtagaattctattacaacaaaactattatgaatgtttgcataggccaaaagtataatcatggtaggtcattaaaagtttgatgacaatgaacgctgatagtatctttaaagagaagagatggtgattggcctaagagggcaagctaaacatcttcaccataaagctatctctaataatgtcagaaaagatatatttttggaaggaataaattcagtgctggacaactgccatcagtaaatgagacatttctgtcctcttgaagaagaacacaggtgaagatcaatcagtggagaaaaccgcattcctaaacactgacaccactggattattgaagatcatggtgtaatagcttcaaaattctgaaggaagatgattgtgaatctaaaattctatatccaggcaaactaatatataagaagaaaggcaaaataaaggcattttcaaaatatgcaacaactcagaaagtttacttccacagacaactccaggaaaataaaatataaattcaaggaaaatgaagatatgggataaaggaaatataggtatataaagaaatcagtaaaaattgtggttgtatctaaatcatattgttttgtaatgagtgccaaccgaaataacagccagagagaggctctctaaagtaaaatgatatttatctgggaaggaacattgcaagggaattcacataccatagtaaagtgtgtgcatattcagggaggtaaaggaagacaaaggtttttaatggaaaaatgagaaggattacataatcgttttgagttaaattgttttgagatctttggctacaaaaattagttacaagggtggcaccagtcagaggttggagaggcagttgctgggcagatgccctttcaaaagcatttttgtgtgtgtgtgtgtacggttgtgatggctgttgtgtaagggtgtggtttttgcagtcttttatgatagttcttattatcaggcatttgcatatgagacccccgctgcccctgcttcatggcttcccctggctctatttgtcaaggtttttaatatgagtgactccattttgattctgacaactttcatataagggtgaaatactttactggtactttactttactggtaatttctagaagaatagaaatatgtattttctaacccacaaaaggcatgaagaggaaaaaagagcaaccataaaccatagtaaattaaaaatattaaattaaagaagttaaaagtttacaattgccagtaaccacaaaaaatgtacatgtgttacatattttgtattaaaaggcaacctttggtttaggttaaaactgtctcagaacttcaccttactgctgtttataagacatgctaaagtgaaataacagcaagaatgaaagagggattgaaaaatttgtgccaagcaactactattgtaaaggagggtataacaatattattatcagaaaaaatgaattcaaggaaaatcacattaaatagaacaaagaagaataattcatatagatcaaagtcatgctaccccaagaatatgagttataaccttttttgttcctagcaactcagcagagttgttacacataaacaaaacggggagaaataaaggaatttgtaattaccatggggtataataacgcctgtttcagaaatggacagatacagtaatcaaaaattaacatacagatttaaaaaataatacaatgaccatgtttgttccaataggcatatataaaactttgtacccaatgcaaaacataccagttgttttcaaacaaccatgacaaaatcattttataaagggaaacaaaatttaaaatatagaaattatatagaacatagtctctcaccagaatttagtaaattatttattaatttaaaaaggtagctacagagaagctgggggtggtggctcacacctataatcccagcactttgggaggctgaggtggtgggatcacttgaggtcaggagttcaagaccagcttggcaacatggtgaaaccccatctctactaaaaatacaaaaattaaccaggcatggtggtgcatgcctgtgatcctagctacttgggaggctgaggcagaagaattgcttgaacctgggaggtggaagttgcagtgagctgagatcacactactacactccagcctgggtgacagaggaagactgtcaaaaaaaaaaaaaaaaaaaaaagtaactacaggaaaatatttacttggaaaatttaaaatttaaaattttaaaaaatattccatctgaagaaaggaacctggccaaattgttttatagtcaagtttttcaaacatcaaggattcttcattatggaaaatgtttcaaagcatcgtaaaagatggaaagcttttcagcttattaaataatgctaaacgcaaatatgataaagaaatgtgagtatatcaacttctaagtaattattagattaaatggcaagtcaaaattgaaataataaaccatattaagaattcagttttaaaatgaaaggagtgcgtatcaaaacttaggggatgcagccaaagcagcattaggggaaaatttgtaggattacatgtacttatgagaaaacatgaaaaataaatggattgtattttcaattcaaaaactagaaaaagaacaaggtaaacccaaagaatgtggaaaaaataaaataataaaagcaaacattaaagttatgaaaaaaagagtaatgatcaatataatttgttgataagttaaaaaagcaaattttgttcttttaaaatactgttgaaatagacaaacttttggcaattgtgatcaggaaaaaagagaaggcttgtaaatataaccttgataataagaaagggacatacttatagatacaaatgactttttaaaaattataattctttataggaataaatttaaaaatctaaatgcaaaggatgattttctataaactcctgtaattaatttacaaggtagaaggtagaaaaatattctttcctaaaaaaggcacctggcccaaataggtttacagtcacatttaccaaacactaaggactgtacatcaaataaaatgttctaaagcacagaaaaagatggaaagctttctaaagtatttaatagtgctaaaagcaaatatgacaaaaaaataatttacaatagcatcagaataacaaatacttaggaataaatttagcagaataattgtaaaactcataaaactgtaaaacattcttgaaagtaaataaatggatcaaataaataaatggaaatgcatctcatgttcagggattagaagacttactattgttaagatggcagtgttgccaaaattgaactacaggttcatcacaatccctatcaaaatcccagttagcttctttgcagaactgacaagctgattctaaaatttatatggaaatgtaagagacccagagtagccaaaagaagagcaaagttgttgtattcacacttcctgatttcaaaacttactacaaagctatgttagtcaagaatgtggtactgaaataaggatacacatctaggtcaatggaatagaatggagggtccagaagtaaacccttatattacttttgacaagaatgacaagaggactcaataggggaaacaacagtcttttcaaccagtggtgcccagttggaaattaacatgcaagagaatgaagttgaaccactatctcacaccatatgcaaaaaataattcaaatgaatcatagacctaaatgtaagagctaacactataaaactcttagaaaaaacataggcatacgtggctcacgcctgtaatcccagcactttaggaggccaaggtgggtggatcacttgaggtcaggacaagcctggccaacatgatgaaatcccgtctctactaaaaatacaaacattagccgggcatggtggcacatgcctgtagtcccagctacttgggaagctgaggcagaatggcttgaaacagggaggcggaggttgcagtgagctgagatcatgccattgcactccggcctgggcaacagagtgagactctgtctcacaaaaaaaagaaggaaaaaacataggcataaatcttcatgaccttagaatgggcagtggttccttacatatttcaccaaagtacaatcaataaaagaaaaaagtagataattgtatattaaaattaaaaattttatgtttcgaaggatatcacaagaaagttaaaagaacccacagaacatgaagaaatatctgcaaatcacacgtctgataacagagttgtacctagtatacataaagaactcttacaactcagtagtaaaaaatagcccaattaaaaaataggcaaaagatttgaattggcatttctctgaagaagatatacaataaccaacaagcacatgaaaagatgctcatcattagctctcagggaaatacaacttaaaatcacaacgatatgccacttcacacctggtagggtggctacagtcggacagaaaaaataacaagtgttgatgaggatacggaaaaagtgaaacattcatatgctgctggtgggaatgtaaaatgctgtagccactttagaagaccatctttcagacccccaaaaggttaaacagatttatcatatgacctatcaccccatagaaatgaaaaccttggtgctcacaaaaacttgtataagaatgtttataatagcattatttataatagccaaaaaatggaaatgacccaaatgtccattagtttggataaagtaaatgtactatgtacatacaatgaaattattcatccataaaaagggataaagaactgatgcatgctacaacatgaatgacctttgaaaaacactatactaagtgtgaaagaatccagtcacaaaagattacatattgtatgattccatttatatgaatcgtccaggatagtccaatatatagagacagaagatagattagtggttgtttagggctggggatgcatttcggggaaatggggaatgactgctaatgctatgtagtattttgggggtgataagaatgttctcaaattggttgtgatggttatatagctctctgaatatactaaaaatgattgaattctacacttaaaatgggtaaattatatagtatgtgaattatagcttaataaaactgttagaaaaaggaaacaagctaatacccagtttcagttattcactatcaacatattaaattttatttttacttttatttgataccttatattgataaatcagccatgtgttaaaatcttattagcctagaaatgctaggataactgatcataagtaaccatattagtataattgtaagtaaagattcagaaggcgggcggatcacgaggtcaggagatcgagaccatcttggctaacacggtgaaaccctgtctctacatattgtatgattccgtttatatgaatcggaaaaaaaatacaaaaaattagccgggtgcggtgacgagtgcctgtaatcccagctactcaggaggctgaggcaggagaacggcgtgaacccaggaggcagagcttgcagtgtgccgagatagcgccactgcagtccagcctgggcgaaagagcgagactccgtctcaaaaaaaaaaaaaaaaaaaaaaaaaaagattttaaatataaggattctgctgttttggaggaacaaaggagagaactgttccccttccttgcacatcaaaatgacaggtttcttttttaatttaattttttttttttttttttttttttttttagagacagggttttgctctgtcacccaggctggagtgcagtggtgtaatcataactcactgtagcctcaggatcctgatcctgggctcaagcaatcctcttgcctcagccttccaagtagctggggactacaggagcgtgctgccatgcttggctaatttttaatttttttgtagagataggatctctacatgttgcccaggctggtcacggactcctggcttcaagtgatcctcccgccttggcctcccaaagtgttggggttacatgtgtgagctacagcgcccagcttaaaatgacagatttgaaaacactaatacaactggtcattttcaagagttgccattgagtcaataaggttggaggggccttgagattctcagaaggggaatggagaccttgcatctctcatgtggaggtgagactccttgacagtcagtgtgggaaaggaaagcagacatcatagtcaatagccagctaactattttgttgagatttttctcattttgctgagacttttctgtaatagttacagacatgaagcaccattatattgcgaagagactgatccatccctcccccaacacactgacaaattaaatgacacaagctctgtggtcatctcaataaatgcacaaaagcatttgattttaattgattacctggttctcttctccaaggacaccccaccccctgttttgttttttccccagtgagggaagggccaaggatcacagtgtggaaattaagactgcgttttatattatctcatacaatttctggaaatgggatgacacagaagcttttgcttcacattttgggggtagagcagtgacctttccaagttttaaatctatgctgatattcagaatgtaataatagttcatctgaattcttttcttagctcactttaatgtaagagctactttattgattccattgctcttttaactgagccatcttttttaatatataatatacccacatcatagtcttcccatcatggtatgtaattccaaaccaaccatgcccttatattacaaggctgtggaaagttctgataacagctatgttgagatgtaaacctgtggtgctatgtcctcatagaattttatttaattgatatgtacttcatattttgtcagtttcttaagccattgggtctacattttcaagacttttaagtttaatcttattttattggaaacaatttctgtacataatggatttacaatgctggtgaaacaacctcacccaagatttaggctctttttttttgaaaggattggatctcatctaagcaaacaaacaataaatattcatgtggcagaacagtaatagcttgcatttaatgagtatgcagtatgtaccagatcagggttaagtgctttacacgcaatatttccattattatctagcctcattttaaattcaggaccacaaatctcaaatgggaagtcagtgccatacttcttactgcacttcctaggatgtcctttttcttactctccacaatgatttcatacatctctcacttcaaaacccgactttctcccctgtgttttctctcagctgatgaccttgcccatactttgttgagaaaatagaaacaatcagataggaacaaacatcatccagccaccaaatctccccgcatttgtacccccagtctctgccttgttatttgttgcaatggacgaagtgttcctattttcctcttttgccctctcaaggatgttactcctgtgagcatcccctctccttcctacctttataatgtccctctctatatagtattagttccatcaggatgcagatattttctggaatcttgcaactaaacaaaagcaacaacttcccttaaccttatatcctttcctttccaggacccatttctctgttcttcttccaaagaattgtctatagtcactgtctctagacagtgcttgtgacccacctttcctctaccccaccaaacaggcttttatctccactgctacacagagctcattcttggccaagttggcttgatctccatattgtcaatccagtgccatttcactgtcattattttactggaccctttccacagtgtttgacaaagtgaactcttttctcttggcttctatgacaggaccctctcttggtgtcctttcatatcatttggtcacatgatttccaagtcctttgctggctccttctctgcccaaccactgccagtgtgagcactgagacaggaagaaagcccagagatggtggtttcttggaagccaagggaaggaagtgtgcatcctagagattgggtttagaaggagcagtcaccagcagaggacagctgaacacagtggcctgacaacctcatagttgtgctcgtgacatcatgatgtcaggatgagggggatagagccaaattagaggaggaagctagttccaaatactcatgagaccaaggagaatttcagatcatttttgtttgtgttacactggaggcaataagccaccagcaagaaggaaatgcattagaacttccccttgagttaaaaaacagggaaagaaagctattctgcatcaaaaacatctttgagtaagagaagcaaaggaggacaattatgtaaataaagccaatcagactttagaaatgagtacttcatggagacagggtgagaaaacagagtattttgggttctttttggttctgtatgaattttagcatagtttttttctaattatttgaaaaagatgaccttggcagtttgataggaatagcattaaatctatagattgctttggtcagcatggacattttaacaatatggattcttccaatccatgagcatggaatatttttccatttgtttgtgtcatctctgatttctttcagcagtgttttgtagttctccttgtagagatctttacctccttggttaggtttttgttgttgttttgttttttgttttttggtgtggctatcataaatgggatcgtgttcttgatttggctctcagcttgaacattattgacatatagaaatgctactgatttttgtacattgattttgtatcctgaaattttgctgaagtagtttatcaggtctaggaacattttggtggagtctttagggttttctaggtatagaatcatattgtcagtgaagagagataatttgacttgataattcattttttcctatttggatgcctcttatttatttttcttgcctaattgtgaattttaggcttttaaaagtaacactccttaatagaaacaagagaatttgtggagctatctgtaataataatgagtttggagggcaatgacattgctttttggagtataactccaaaataaataagggaccccaagcaatattacagacgttcttcaacagaattttttgtggtaactgcagaaagggatttaatgtggctttttcttataggtgataaagagtgaagaccttcaccctgttagaaacagttgtgtgtttatctaagctacccaattacaaaaaccaaatctgacttttcaaagtaagcacattattttctatataattgctataattaactatggggatatcactgacccattagcagaaaaaaacatatggaatgagatttgtctttatgcttgggctaggatgttataaaattacacatcgttaaccataaactcagtcactgtgttgtatagctgggatgctaagacacaaatagtggcagaaatagcacaaccagtccattaccacttttaattactcaggatgataattttaggtatcttttttttattattatactttaagttctatggtacatgtgcacaacgtgcaggtttgttacatatgtatacatgtgccatgttggtgtgctgcacccattaactcgtcatttatattaggtatatctcctaatgctatccctcccccagccccgcagcccatgacaggccccggtgtgtgatgttccccttcctgtgtccaagtgttctcattgttcagttcccacctatgagtgagaacatgcagtgtttggtttttttgtccttgcgatagtttgctgagaatgatggtttccagcttcatccatgtccctacaaaggacatgaactcatcattctttatggctgcatagtattccatggtgtatatgtgccacattttcttaatccagtctatcattgttggacatttgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccttgaggaatcacgacactgtcttccacaatggttgaactaattcacagtcccaccaacagtgtaaaagtgttcctatttctccacatcctctccagcacctgttgtttcctgactttttaatgatcaccattctaactggtgtgagatggtatctcattgtggtttcgatttgcatttgtctgatggccagtgatgatgagcattttttcatgtgtctgttggctgcaaaaatgtcttcttttgagaagtgtctgttcatatccttcgcccactttttgatgcggttgtttgttttttttcttgtaaatttgtttgagttctttgtagattctggatattagccctttgtcagatgaatagattgcaaaaattttctcccattctgtaggttgcctgttcactctaatggtagtttcttttgctatgcagaagctctttagtttaattagatcccatttgtcaattttggcttttgttgccattgcttttggtgttttagacatgaagtccttgcccatgcctgtgtc

SEQ ID NO: 5466 - DNA, 1152 bp, Homo sapiens
cacagccagagcagagtggaagggttgggggaggcgataaagacagatgtttccgtattaccatttttctttcatggtccgagggagctgcccttcccccaagcccaggaaagtgaaaagagaagcaggaacagtaaaatactccacaggaaagaaaaatcttagtgatccctcctgctgtctctttccttttgcctattctggcaaattttgtaagtgaaatttgttaccaagatgtgaaaatcttataagaaagtctctaaatatttgagaataaaattatcaatgtctcagctctgcaggctgaaaaaacggaggctttacaaaataaaatcatgcttggaaaacttctcctctgagggatgtcaaaggctgcactgaataagctctaaggtggtgctgaaatgagtcatttatttgcctgtgtaagctcaggcaggtgttggaattgaggaagtataggtaatgaaaaaagtaaacatgtcctcgggacatagcgactggtgatgaccacacaatcaacacaataaactctagcattcacattgtagtccagctcattcaagcaaagctatctccaatagggagtttaccctgtacagaacacgtgcatttccacctgttctcagactgaccctttgctcatcacaatagtgaaaaaaaacacagccctgggtggagatttaagatgctaatgagtcatgagatgtatgaacaagcatgtacagctactgcacacgtgcacccagaagaccgcccagaacatgcttgctagtaacacctcttcccacccacctcctgtgaataatcatgtaagactcccataaagggagtttctccagcagtgatcaatgctgtctcatccttaggagcagcccaccctgaatcctctcagggtgtacagtttattttgcacttaactttcaaaataatatttttcctttgtaataaattgctttgtacttcatctcctttgctgcgtgtttcttgtttaaattcttttaaatgaagaagtcaagaaccaaggtattacaacagccgtcaacatttccggtgccatgactcagaggtttgtctgcttcgttggtttcagtttcccttcactactgggccgtcgttcaccctcctccaccttgtcccctgcactgggag

SEQ ID NO: 5467 - DNA, 1169 bp, Homo sapiens
tctttttggaatgcccttgatttcgacttgtctgatgtcttctactgatgacactactggggaggatttgttgaggagacacgtgtcccctgcagggctccacagcaggaggtgtggtggcctctctcatccctggtgatgggaactgtgaccctggagttccacttcccttggaagacctcgtgacagtggctgctgccttggtgccccagcggggcctccaactgccctggttccttcaccatttataactggaatcctctggttgaggaggcgctttctctgcgtacacatggtggaggtgaagatatctgtgtgctctctggttgaggaggcactttctctgcgtacacacagtgcaggtgaagatatgtgtgctctctggttgaggaggcactttctctgcgtacacacggtggaggtgaagatatgtgtgctctctggttgaggaggcactttctctgcgtacacacagtgcaggtgaagatatgtgtgctctctggttgaggaggcactttctctgcgtacacacggtggaggtgaagatatgtgtgctctctggttgaggaggcactttctctgcgtacacacggtggaggtgaagatatgtgtgctctctggttgaggaggcactttctctgcatacacacggtggaggtgaagatatgtgtgctctctggttgaggaggcactttctctgcgtacacacggtggaggtgaagatatgtgtgctctctggttgaggaggcactttctctgcgtacacacggtggaggtgaaggtatctgtgtgctctctggttatcatctagtcatgctgctgtctaggttgctgtgcagggtgttcagtgctagcccgtgggaggctcagcctctgacgccgtcagacctgcctcccgcaccagcctcactgattcttgttcagcagttccttacttttttgctccacaagaagtttcaggctcatcttgtatttcccttgcctcagccctggaattaaccccttctctagggctctgcgtggtgggggacggcacagggtctcgtccgcataatctgcaacactgagcttgctcactaccgcctggttcctgattctagccactcggtgtatggcctaggactgtgtgtgtttactaagtcatgctcacacatgtccgtgtttatttc

SEQ ID NO: 5468 - DNA, 1418 bp, Homo sapiens
ggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagaaaaaaaaaaaaaaaaaaa

SEQ ID NO: 5469 - DNA, 2666 bp, Homo sapiens
ggggggcgcggacacgcgtggtgtgcgcggtccccgtgcagcccgccctgccgcaggctgccctccacccccagccccagctccagcccccagcccgtccccactgctcatatccgagcagatagaccccggccccaccctcccgtgctgagcctcctttctgccgggaagttcgtccgggagtcaaacatcgctgccctccggttgcgccacggagggggagccaggataggaagctgccgtgaaatcaggaagctgagcgcgccgggccccggatccgaacagaaaaggcttccacccgctcccctgagggatcccacgctgagggactgaaccccgcaccccagccgcgctcaccacccccaccctctcgcctgggctgctctgacctggggattccagaactgccactcaaagtgccctatgaggagctgtggtaacaaggaaatgttctcatgactcaaaaatcagtggaaaaaggtacaggatgagaagccttgtttcccaaccctatcaacaggttgtagtgcaacggcacaacctctgctcactgcatcctcaacctcttgggctcaagcaatcctcctgcctcagcctcctgaatagatgggaacataggagcatgccaccatgcttggctaatttttgtattttttgttgagacaaggtctcactatgttgcccagggtaaaaataatttcagttggaggaaggcagtggagaatcaataaaaaccaacaaggatttggactggtgaaagaaaatacgcatcctcatacttcatagtgggaatcaataggtagacttttctgaagcagagaggaaataagggtttaggcatacatttttttttttttttttgagacagagtctcactctgtcacccaggctggagtgcagtggcacgatcttggctcactgcaatctccgcctcctgggttcaagcaattctcctgcctcagcctcccgagtagctaggattatagacacctaccactatgcccagctaattttttgtatttttagtagagatggggtttcaccatgttggccaggcttgtcttgaactcctaaccttgtgatttgcccgcctcgacctcccagagtgctgggattacaggccaccatgcccagccaagggtttaagcatacttaaacaggtattcacaagtagaactaacaatattttacatctttcaagcttctttggtgggaggggcagcaacctagtaaaagatataaaacaaaggaaatagccagaaaaacataaaatataaggccgaaacaacttaattatttagccacatgaagctttttccatgacatgtccataaacacccagctaaaggtttcctgcagatagtacaagcaaaaactcaaaagagaacatatttactggctcatgtagttatgatgaggatattagtgcagatcagagaatcaaagggccaggatgtcaggaaatgaggtcagatgttagagctgccaggtctgacaatgcaaaaagtgttaaataccacttatttatcctgatcactgcatatagtcataaatattttcattaatgaataaaactaaagataaattaatcacttaggaagataaaaggaagaataccaaaatttagaaaaaagaattataagatagtatacagataaaaaacaggcccaataaagaaactaaaatgctgctaactatccaaaagagtgctgctattaattctttagatatagatgaattacttctaatcttcaagtaacattaaagtgtaacactatatcaactgttctagagcacagcaaaagatgaaaagcttaatttttttgaaacaaaataaaatcgaaaccaaagcctgggagagatgatataaaacaaatttaaaaccccatatgccaatctcattttaaaagagacactattcaacattaggaaatctactaatatagtttattgaagtgaaggaaaaatcctataaaaatcccatgatagaaaaaaaaaatcccacgatagaaaccaaaagtgcacggtgaaattcaacattcatatctactacagaaacaacaaaataaattttaaaaaagaaaaatataaattaaaaaaaagaaattcaacattcattcctttatatgacacacatattctcagatatttttcaaatcaacaatcagcattatcgttaatggtgaaacactcctgtagcattaattccagtgaagcaggaaacaagtcaaaagtagttgttagcatcactactgtttaatgctctttcagaaattctagtcaatgtaggctaggcgtggtagctcacgcctataatcccagcactttgggaggcggtggggggcgcggatcacctgaggtcgggagttcgagaccagcctgaccaacatggagaaaccccgtctctactaaaaatacaaaattagcgggtgtggtggctcactcctgtaatcccagctactcgggaggctgaggcaggagaatcgcttgaacgcaggaggcagaggttgcagtgagccgagattgcaccattttgcactccagcctgggcaacaagagcgaaactctgtctcaaaaaaaaaggaaattctagtcaatgtaagtagataagaggacaataggagagatttacaagtaaaaaagagcatatttatcaccatttgaaa

SEQ ID NO: 5470 - DNA, 613 bp, Homo sapiens
ttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaatatgacctcattaaatgtgctgttttatttggaccagtcacacaaaatgtctctctagagttgacttttacagaaatttaaactcaattccagagataacagctcatgggcttagtgtcca

SEQ ID NO: 5471 - DNA, 6383 bp, Homo sapiens
ctctccaggcccgctgcttctgccagctggatgttgcgtcgtccctcgctattcgccctcctataatcactgcttccatgttgaatcaaaacaattatgctttcgttctcccttcttcaattgccctatcttcacacctgaacactattgctccggtatcctgccattttggatcagggcggttgacggtggattcacttcccatcagcccttgaggctgcagggaccagccctttgtacagtggagaagcccaggcggcctagaatccagtgtcgtccgtgagtgcttggctggtgttcaagtgcatcttccagcctgagaccgcgtggactcgctcatcgtgagggcgagaggaggataagcccattgggctgtcggctgagagtgagaccatccacaatattgtttgaacatctgaagacatggggaacttgccatctgatatctgataacagacttcctgtaaagcaggactggtagtttcctgataacaaattcttcaatatgaaggtatggataaagcatttggctgccaataatgaactgcaccaaagtcaccaattcaaaccatgccctggtaaatagtatcatcagtgatgatgatgatgatgatgatgataatgtcacatgttaaaaatgtcatatagattttagcatcttgaggacctgatactctgtaacagtggtccctaacctttttggcaccagggaccactttcatggaagacagtttttccatggaccaggagagggggtggttttgggattattcaagcacattacatgtattgtgcattttatttctattattattacattgtaataatatattttattataatataaaataagtatacaactcatcataatgtagaatcagtggaagccctgagcttgttttcctgcaactagactgtcccatctaggggtgatgggagacagtgacagatcatcaggtgttagattctcataaggagcgtgaaacctagatccctcacatgagcagttcacaatagagttcgttcctgagagaacctgatgctgccgctgatctgacaggaggcagagctcaggcggtaatgcgagcaatggggatcggctgtaaatatagatgatgctttgctcacttgcccactgctaacctccttatgtgtgacctggttcctaacaggctacttaccgggggttggggacacctgctctataagatatccttctagaatgattgatatagtactaagctgatgctcaagagaaattttgaactaaatgtgtaaattcggctacctatataaacaagaacttcctaaatcattctgttccatagcaaaacacaaccacataagccagttcttcacatctaggcaccacagtgtttgtttttcatttccaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagactaatatcaaaattctaatgttgatactgtgtaggattgcactgaagtaattttaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggccaatagataattaagactaacttttcagcaaactgatttctcctatattcaaacacaaaaatctttaccacacgttcagagctgatattctataacagcacaaataagaatcctggtttacaaaggaaaccacattagcaaggattttttttttcccatgggttcttaaccaaatgtctgaagctgctagacatctgcaaagaggggataagtttagatttcctactgattttggaagaaaaatattttcctaaggaagccagagtcatccatgagcagggacctgtcttcagaatcgaagaagcataatgtccttaatgcttacactcatgacaagttgagagtcagcaaaactggcaggtggaaggggaaagagaaatggagagtttgaacatctgcagtgtactttggaataaagtggctcaactgctttcagaaatgaattgctggagtactgggagaaaacccagttctctagagtcagggggtggggagagagaggcctcccatccccaggaaccctctgggctgagctgtggcccagaactcttgttttggccttatttttcatgagcgcattcaagtggagaatttatgactttgcccagataaatatttggtttggttactttctctctaaaatcaattggtcagtcaagttactggtgatttccctaaatgaaatctagctgcactagtatcttaaggtgccaactaacatagattaatgcccatcaataacgctgctaggtatcaactgctgtttctgaagaatcaacccacaaatgacctaaccgataatctatcacactaggtgcttttactatcttgagttttttttttttttttgagttttagagaaatagtccttttaatatgacttagaaactgcttttctctggctttgtttcactcttcttcctcttccccttccccttcaccttcctccatcgtttccacaatgagctctgctgtgcaggtggcttctccaagactgttgacagccttgcaggtgtacttggcatcgtcatccccgcaaacatcactaataattaaagagcagttcccgtcctcatcgtagtctatctggaagtggcgggactccctgattgactggtcatctttgaaccagacaacctcggggtctgggtatcctgcatcacagggagagaacacaagttgcaggaactgttattcaaaatttcttatcaactcatgcaagcaacttgtaagctaccactattgattaaggtggttaaggagaaaattttgatgttggcctttatcgactgttttgatatctacattagaatatggacatgtcttgtaaataccaatatctgaaaccccaaatagaatattttaaagttgttccatttcccacacatgttggactagcaccacatcccacctattaaaaaacttatttaatagtttttttatttttttaaagtgatgagtctcactctgttgcctaggctggagtgtagtggcatgatcgtagcttactgttgctcaaattcctgggctcaaacgatcctcccttctcagcctcctgagtagtgagactataggcatgagcgaccgtgctcagttaaacatcacacctttcactttttggggggtaggggggcagggtctcattctatcacctaggctggagtgcagtggcatgaacatggctcactgcagcctcaacttcctgggctcaagtgatcctcctccctcagcctcccaagtagctggagctataggtacatgccaccatgcctggctaattttttaaaaagttttttttttgtaaagacagggtctccctatgttgcccaggctggtctcaaactcctgggctcaagtgatcctctgaccttgacctcccaaagtgctgggattacaggtgtgagccaccacacccacccatctttaaacagacatagagtactacctgaggctaggcatggtggctcatacctgtaatcccagcactttgggaggccaaggtgggcaggagttcaagaccagcttggccaacatggcaaaaaaataaaaattaaaaatagagtactacctgaaatactgctccaattccaactctacacctagatctgaataccttcttagattgaaaatacaattttctttttccttttttttttgagacagagtctcactctgtcgcccaggctggagtgcagtagcgtgatcttggctcactgtaacctccgcctccttggttcaagtgattcttgtgcctcagccttctgagtagctgggattacaggtgcacgccacgacacccggctaatttttgtatttttagtagagacagggtttcagcatgttgaccaggctggtctgtatctcctgacctcaggtaatctgcctgccttggcctcccaaagtgctgggattacaggtgtgagctacctgtgctcggccgaaaatacaattttctatctttttttttttttgagacagagtctcactatgttgcctaggcaggagtgcagcagcatgatctcgggtcactgcaacttccaatgtccaggctcaagtgatccttccacctcagcctactgcatagctcagactacaggtacacaccaccacacccagctaattttcgtattttttgtagagatagggtttcaccatgttgcccaggctggtcttgatctcctggactcaagtgatctgcctgccttggccttccaaagtgttgggattacaggcgtgagccactatgcccagcctaaattttcaattttgtataatagtttaagtgaaataatttaaatgaaaaataagagtcaaaacaaaatgggaacaagggatctttttggagtgatgaaaatgttctaaaattggattgtggtataaattcattaaaaataattgaattgtgcatttaaaataggtgaattttatagtatataaattataactgaataaagctaataacagctatataaaacataatttaaaagagctgataatattgctaagaagaagaaagcaatatttgtcttagtctgatccaaagcaggtaatttgcctatggacaattggaaatggacctcaccaatgagcctttatgcattagtcatatctctgcaaagttcagcattaaaaaataaaatacacatgcatataaaatatatattatatgtatttaatgtgtatgtgtacatatatatgtacagaagcattaccaacattatgcattttgtttgcaggtacatagtatatacatgtaccccgcttttaaagtcatatatatacatacatttaaaaatatacaatatattccacctgactttctcttaaatgttggtgaagtatttttataggaaaaaaattgtagccctgatacggtttggatatttgtgccccttgaatctcatgttgaaatgtgatccccagtgttggaggtggggcctggtgggaggtgtttgggtcatggaggccgatccctcatgaatgtcttggtgcccttcccgaggtaatgggtgagttattgctctgtcatttcatgcggatctggttgttaaaacgtggcacgtccttctctctcgctctctcacttgccatgtgacatgcctgcttctgctatgattaaaagcatcctgaggcctcactggatgcagatactggcaccaagccaaataagcttcttttctttataaattttccagcctcaggtattcctttatagcaatgcaaacaggctaatatgagccctaaccagaataaaaattatacataagaaatcaagaattctaatgttcttttcaatgttgttttttcaaaataattttagaaattgttttttcgaagtaattaggaacacccagaccatgaggaaaattgggtcaggaagagctggtcataaagtaccctccactcccatgccctgcaccctcagtgcaaaagtttcaattttgtttttatcaaaacagcatccatatgctttaatttctcatcagagccccaggcaaaagttacataaatatcaatgaaacaattccaaag

SEQ ID NO: 5472 - DNA, 3062 bp, Homo sapiens
aaaaaaaaattagccgggagtggtggcgggcgcctatagttccagctactcgggacgctgaggcaggagaatcgcttgaacccgggagggggaggtttcagggagcctcctctaaacagaaaagactgacccccagtcagtgttttattttccctgatgaccgcaggccatgaacttatggaacaataaggaatgcccaattcagatgctgcagagaagagcatgagaaccgggtgtcttcaggacaggtgtgcatctgggagcagagtgggcattcatcagcagggaggagcaaggcctgggtcgggggacactggggctgctgtcccagaggttggcagtgtagccctgaatccccaagacttcactcagtctcccctcaaccacctaaaccagaataaactgatgtagcaggactcctcaaacactgtgcagggtctccatgtcctcgatggcccctgatgagccacagtaccctcaggtcctagtgaaggagctggtgctgcctcctgcctttccccacatggggtcctgcagctcatcccacacagcctcagattccctctacagaacctgcccacagatgtcttctgagaccagcaatactgggaggcctgtggcccagacccaggaggaaccagctgagaggctccgtggaggtatcgctgatggtgtaaccagaatgaaaatgcccacttctgttctgctccctgagaacaactgtcaagccagcatgagtttccagttggaacttttccttttctccccatgtttgtcactgttttaatggacatcgcctggctattaaatcccccgatgaactcactttgaaaattatctattgcactgggcaccctttcaggaatcactgagtgttaattttctcagtctgagtgataatttatgagtcaaacaaggacagatctgaagccagaggctgctcctgttgggaaatccctgaggatgatgttccagggaagcctccagccttgggagtcccgtggaactgagccagcccaggtcatgaagggagctggtgccagacactgactggggacctgctggcctctgggcagaccgctctgtcgctgcacttggcctgctgggtatccctgtgcagtcataccaagtcctgtgctcagaagggccccagagtagtttaaagttctgctgccgcccctggaagctcatgattttgaacaacaacaacaacaaaaaacccacgttttccactcggccccacacattatgtggcctgcgcagctgtcaggctgtggccacagtgctggcatctctcacacaatgaaggctgctggagtcctggctgacttgttttgactcttttgtgaggcccacacctaagctaaacactcacgtgcccccacgctgactccccacactctaaagcatgaatctgccccttcagctgggagagggtcctcgtgtcatctgggtttttggagagaaggtcaagggagcctgggttctagttcttcagtaatcaagagcaatggtcttacctgttcacaggtccctgtggctgctttacagaaagcaggaagtggccacttcagccacacggctgcatttccagctcagtccaggcagagctgcaccctgccttgcacctctgcagatcctgaggggagtccttaactgagccagggcgagtcctgggggcactctgcccctgggcaggccctgaatctcctctgctcccacactctagagttcaacaggtctcaggggctctgcctgaggactgtccttcaaccaggtattcgtaatttccccaagacccaggcttgctgagtcactcagttacctgaatgcctttttcacaaaggaatgactgtgctgctccgtcttccttcttttttgtttgcgaggccacagggaaatctggatcctctggtgaaaaagcaaatccagttgctgctgctgctgctgctgctgctgctgctgctgctgctgctgctgccgccgccagttcttgtaaatgtcctcacttggtttctgggcagcaacttccttgacttgcctggggagcggatctgagctgcatttaccaggccatgcccaggggaagtgatcagtgtgggaccgtgaagctggatttccccaggagctccctccaagcttctgggatgatgataagactcgggatgaaccaaggatctggaaccatgggacaatgtgaagtctagacccagtggaggaagagaaaggctatgggaagggcaggcttcacgttactgagcatccgctacctgccacacactttcacgtggacttattctgtgtgtttctcacagcacccttgagaaatagagactacgatcacatcttttacataaaagaaaaccaccatccagggaggcgaagtcccttgctcacagactgtcatgtgggaagctctctggatgcaatgatgtcctccagttgcagtaccaggcaagctgtcccagagttcatggagcggaaaggctcgagaagcaactgaggatgctcaaatcacaggtttataaaatccattcgtaaaacacagcaagaagctgagggaaggagatgggagggccgtatgacctgattcctgtgctgtcaacattcatcggttctcttctttctctgctagtcaacctcacccactcaggtgtgaccacgaggaccagagccgaggtctgggcaagagtgctcacagcttaagggcttatgacacacaccggctcaacgggacagacatgggacaagtgtgcctgatcatggtggcgttgccaagaagcagctgtcgcactgccatgggttctacgtgtttcttgggcagaggacgcatgggaccagaatgggcaccaggaatggtggtgaacaaaggccccatggttctgcatgtttaggtgtctcttgtataaaggcacattgtgaattgaacatttagtgcccaggagcctcatgcatattaagtatctcttggcccttgtgtctcttccttcccacatgtaacatacctgttctctgtaactatctattctgaacgtatctaaaaaccatgtcttgcctgtgtt

SEQ ID NO: 5473 - DNA, 1778 bp, Homo sapiens
gcattctcctcggaaccccagctgctgaggagacagcaggcggggactggaactctgtgtgcgagcgattcggtgcctggttttaccagggccccaggggccaaatgaagcaaaccaaaagcaaagagagagcacaagcagcaactagagacaatgccagggtcctgggaacgcaaacagaagcgcggccagcttccgacaggacccctgccgggggcccacagcccctgcgctacctctcggcgatcagagaccaagtctagccctagaacgaagacccgacgcgagtcttcgccgttcgtctcaaaacagaaataaactggccacgtcaccgggctgctgagaagggggctcgggagaccagctcgggtcgttctgcgaggcggggtcggaggtcgcggctgggagactggggcacagacctcgttctcaggccagtcggcgggagcggaggccgcgccagagacagcatcgaggccgcgagcgcaggaccaggagggacgcccaaggccctcggggaggaggcccgggtttcagggccgggggccggcggacaccggataaaggacggccggggtctcccggcgtcccgggagggggcggggcggaggcgtggggaccaagagcggcgtcccgcacgcgcctggcagggagcagggacggggaagggggaacagaccccagtgcccgctgaggcgccggctccgccgctgcagccgctgccacctcacagcccctgtccgcagcttcctcttccgctgcctgtcagtcacccgtctctatggtgaccgcatccggccgctcgctccgcccgcgcgttctctatggtcgctcccacggcctctcagcaccgcgcacctcctcggctgggatccgggctgcctggccccaaccggccgccccccgataagacgcgttcgcccccacatacgcgaatccaggcaaatccagagtggaccaaagctgccccgtaacttgggctgaacaccatctgccctggaaaaagcatacccccaccctcgagagcgcttttctcccaattggctgtggaatcccatcagcctttcagttgcctaagaaatgtttgttgtttgccaggcacgtacgttcatctaaggatgctaagttccgggcatcttcgtgagtgctgggtaaacaagcggtggacgagatgggcatggtccctgctctcagggaactgaaagttgagggagacaggtaataaacacgcttgacatagcaagaataaaacaggtagaaatcccagtctgataagtaccattgcagaaaagcacagagtcctgtggaaaaactaaacaaagtattaaattagactgggaatttggcaatgctgagatccaaaggttcaggaaaagttatccagacatgaagtggacagttttccaggcaaagaaaagagcaccagaatgtcctgagagaggaaagagattggcttggagaagaactgggaaggcccagggcatctttgagcctggtgaggggagaacagcccaaggtaaggctggggaacagggaacaggtaaagcattcagaccaccacagtggttccccaaccagaatggcaccctccctaaggagcaatttggaaatgttcggggcaattttgttgtcaaatgattgggggagaggagccaaggaggctccatgtcttgcacattgcaagatggtatcacacaagaaaactgtcctgatcccacacagctttcacatgtcctactgaatattcatataggttaaaaaaaaactggttataatca

SEQ ID NO: 5474 - DNA, 288 bp, Homo sapiens
gccgggcgcggtggcgcgtgcctgtggtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagaagtctgtaatgctactggtgtcccctaattttcttatagccacagttccttt

SEQ ID NO: 5475 - DNA, 3518 bp, Homo sapiens
cttctgaagtaattgcaaaggaatagaatcgactatttttatagtatatttaatatatttgtatataactataataggaaccctctacatgcctcccacttttctaatttacttccccttttgccatagcactagtatagcctcatccgcatgggtaatgtgcctattgtcagcctaccaaaagatagtgctgctgctttatgagacaggtgagaagacccaactctcatgcctggggatcctttacggaaggaatagcacacacttttaaaacaacataccacagtctaaaagcatcattttgaaatgtaacaagcactttattgcaattactcattttgataaagtttattcttaggcgttaaccatttctaaaggatccccaaatcatcacttacttaggtgaaattatataaaatgacacatttctgagaaatgtttaggtccagtgaaccgtagttggtttatgggagtgatttcaagatagccaaatgaactttgatttttgttttgaatgtggtggagtcaagagattgtagatgcctagtttgatttaaacactattgtaaacctatcttgcctattgtgtggacaccaaaagagaccaatgagcctgtttatttttcagaggtctaggaaaattgcatccgtgtgagtagatgtacagaactaatctaaaagtgattgctagtaacattttagaatataataatttcaagaattattctgagtgttttaaatgtgccctgaaatgttggcatgtcatttcagcatttccatttgaattgctcttgtaatatttttgcacaaaaaggactgagaaaaagaatactttggttaaaggaaaaaaatagtataatttggtctttaattttaatgtctcctgtggaaacactggggatgaattttgttggcacagttattcaggatatttaaaacagtgttgaacagttcacaagaaattaagcaaacttggattttaaaaattaaaatactttctttccatgtgactgttttgcatagttttttccccctatgtcataacactacattccttgtttttcttaaataaaatactctgcaggttttgttgtgagtgtttataacagtattttgtaagctgcctgggtttcctcagggaaacattatttagtggaataggatatagtttatggagagacaactaagtgaaattccatcaccaccaccagcaaacactgaggtgctgcattaagtgacaatcaaactagtaagtatttatgaaagaatttagaaaggggttcaaagaagcaattgcttttaaagcagttctctggggttcttgaataaaaatggctaaatgtatttatttatattttaaaatacctgtgtgttctgttttctcatcaaagtgatttcggtgtcatgtatttaatgtgtggtttgttttgttttgcaccatattcttcttagggaactggctctgatttggggtgcagtcaccaactctcatgataatctttacggacagtctgaatctactttacttcaggacggcagtggaggggccaactccagatgcccctgcacttccctcctcaagtcatctaagaaagaattttagaaataactcctttcaaatctgattcatacagttccaacctttttctagtttcacttgctgccttctttgttttatgggcactttttgtgtgattacttccccaacacagtcaaaggccagtatgacagaaccaatggcacatgatgcctctattttgcccatttggggaaatgttagtaaaagaaatagcatcttttaatggctgtcattatcatatccatattaaaatccatttaaagttcttaaatttggcggaataatgtatacaggctgtaaacttctacaaaaaatgtttgctgtctttaatatggtgtcaagttacttggtcctttgaaaacaaaacaaaacttccatacacagcactgcccagtaaagcagtgttggaatattggaaacctagacatttgaggatccttcttgctcacaagcattggaacagaatcctccactttaggactcagagaagctatggagtcccacaggctaggtatagcacacaacttagagaacggtagttaaagcacgtcaaccacaattgaatttaatgatctaaaaaatatttcttaactctgagggttaaactgaagatacgttttcaaataaaagcttttaaatttcttaggaaacaaactgtgacatcgcttttaaaaatgacattcaaatgtttataatgtgtgtttttgagttggcttggactagtgcaagttcactgctggcaatggttatgccagtagttaagttaaaataagttgttaccttcagattgatgtcttgtataaccagacaatcatcttcaagcaaaaaaattggccaggaaatgtctttttaaaaaaaaaaaaaaaaaaaaagatgtgtcagccagaacagttaccattcagaccatactggaatgattttgaaatctttactatggtttaagttggggaaggcctcagtatggcattttcatattcactctatgtaaagattgaagcccaaagatgagttaaattcagtgctgtattgaaaccagtcagtgcaaaaaaaaaaaaaaagttttacctttgtaaatttttcattgttaacatcagttggtagttgttaaaacatgcaccaaattctttataatgttctgtgtggttctcaatgtgatattcttgacattgctgtccttactgcttggttcttggttttaaattaaaaagtagatgtagctcatcatttttacttccaaaacggtggagctaaaaacggctaattgatcttgagataagaataccctttactaaggcaaagatttaattgaaatccaaaatgatttatagaaacgaaaggcattttccatttgttgtcttctgccgaaattctgaattgcatacacacatgaaggataatgaatggtttcaacggtgctatattaggttctctgattttcatgacctatgtatgtttggaaatacaatattgtataaaatgtggatcgttttgttaccgatttaatattgccattttaatttggtgtaacaattggttacacttgtttttcaaagctatcctttgaggagaaagtcaaaatgtgttgttagcctacctccactcaggcctcttgctgtgtaatcattattccaggttatgatgtgcatagcttttaaaactgcgtgtactattattctgctctttcccatactcttgtcatgtattcagaacctaaacttatagcaaaagagccaagcagtagcagtttttgtaaatgtaaaaataattagatccagactttgtttccttcaattttaaaaataaaaaatacctcagtgctatgtttttcagttatcacctgcatttctcaaaaaataacacctgcttcatgtggcacataacttgtaagaatcacattttggattttaaagaaagactattaaatattttaagatcacta

SEQ ID NO: 5476 - DNA, 2432 bp, Homo sapiens
ctcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagt

SEQ ID NO: 5477 - DNA, 2139 bp, Homo sapiens
gtgaaagaatctttttttaatttttatcctagagtcagtcacttttattccaggtagtcatgctgatctgcttatccaaagccagctaaccaggttcatcctaccatcctcatggaagactgtgtgtatgaattggagtaacagaactgaaatacacttaaacagtgacagcagtacttcccagggtgggggccatatttctctgtgtcctactctgagcaacttctcagagatacgagggggctagggttttcccatctgggaaatggggtgaaagtctgcagattgttaaatgaaatatagaatcagagaaaaagaaaagtcagtgatataaatagatcatttcatagaaattagggtagatttttatttcaactactactggagaatttaataaaaggcattatttgaaaagtttttctaacatagatttagggtttttttttttagagtggacacactacatttaaaagcaattattttgctattcagattttttattatctgaaaatgaaattatctgttttacttttcaaagctttgtgaaacaaacttgaagttatagggaggtaagccatctccaactctgcaggtcaaacgaaagtttgggaaatacttttgacatcccacaatacagaatgtcttaacatgagaattgaatttcatgatgtgtggttccatttaatagcggacaccaccccaatctcatgttttcctgttaccctaaaacagtggaaggaaactgggtgtttggtagacttctaaatcatggtctctgacaatttgaatctgagattctcacctccatttactaaagaatcgtgacttaattcaaattgcacagtaatcagtaaagtgaatacgtttttaaaatggaattttctcccttcagcaagcactcattaaggagtgaggctgagtattttaagatagagtgagatctgtgagtgattgaaaggtgatatttaaaaacttggatttcattccagtgtcaggtttgggttttaagttcctttggtccagggaagggtccaagcagccacagttgccctaaatctccatcattaagtcttccagcaaggttaagtgcagtatggaaggagaagggggaagaggacggtaacggccccacactccaggctgagaaagagtaattaggaggcctgaggaggggccgaggaaaggctgttggggtgtgctggggttggtacccgagcgccttcccctcacctcaaccagagaagagcatccggttgctttttaaagcttttagcctgccctagcaaggacaaagcatgttagattagagatgcttctgctgatcgcaggggttcttatttgaaaacatctatgatgggggtggggtgggaggagacaggttgtggttatgcaggaaaatcttgtcctaaaaatatatgagtttgggggtaaggggtgggatagccaagcaaaatcagtaattattttaaaatgaacatatgtatttttattaacttttagttaaatacagattttacaacgaggtcagcataagcctaaatctatatagagggctaactcaggcattgtcttgtttatttgtagactggattaaaaacaacctgtcctgttttgtcagttcccagcttcttcgtttagaataaattagaccaaaagaagaaacgtgcttgtctctgtatacccgcagaatgaagttactgttgttaaaactggattttttcattttactaggttccgaagagtccagatgcttggtagatgttcaatacgtgattttttttttaattgaatgtgttcatttaaaatcctccttaacatttctagaaagacttctttcaataaataatggaatcttagaggaaaagtggttttttaaaagctagggaactcctccactaaaagtaaccattggaaacctcgaatgagggctaaagttttaatcataagagaaaaggcagcataatgaaatgtgtacacatacatagtcagtggtccattttaggaagccagtggcgtctgataaagaaatgttaagagtagtgaggttgaggaaggaaattgtggggatttgaaatattctctttatgttgtttctcttctgagtcatggtaaaacaataaattatcatctctaggtggc

SEQ ID NO: 5478 - DNA, 3752 bp, Homo sapiens
cttttgacccgttgcctgtcctgttctctgttgtttccccagcatctagaacaataggtgcctgacacaataggtgcttcgtaaatatttattattattattattattttagagacagggtcttgctctgttgccccggctggaatacagtgggatgatcatggctcactgccatctccaactcctgggctcaaacgatcctcccacctccgcctacagagtagctgggactataggtacacagcaccaaattttctgtagagacgggggtcttgctttgtagcccacactagtgttgaactcctggcctcaagtgatcctcctgccttgatgggattacaggtgtgagccaccacacccagcctaaatgtttatttcattggtcagtgtcagaactaggattggaatttagattgttaatctcttgccacaagataggaaaatggagcaagatgaggagaaaaaagcatttaatgggagagaacacccttgtctgaggtcagggacctgggaagcaagcacgactttgccactgtcactgtgtgttacttggacagtgccttattttcccatctgtgaaataaaagagctggataagaaccttagttttgagatcctgtctcccttaaaagctgaagacaaaggtaactgatccaagggcagacaagggatggtaccatcatctccagcttggactcccactgctgacaaaatttgtcccttcaaagttgagatagctaccatggggaagagcacttagttctatactgaatggctccaggcattttcatgaaagctctttcagctttggggaagaatattcatccatatctttaccccatcatattagtgtctaagccctgcaatcaggcatgtcagccacgtgatggaatgggagggctgcagggcagcactgtccagtagaaacgaaatgcaagccacatatgtcattttaagttttctttttttgagatggagtttcactccatcacccaggctggagtgcagtggcacgatctcgcctcactgcaacctccgcctcccaggttcatgtgattctcctgcctcagcctcctgagtagctgggattacaggcatatgccaccatgcctggctaatttttgtatttttagtagagatggggtttcaccatgttgatcaggctggtctggaactactgacctcaggccacccgccttggcctcccaaagtgctgggattacaggcatgagccaccgcgcccagctaatttttgtatttttattttatttatttatttattttttgggagacggagtcttgctctgtcacccaggctggagtgcagttgtgcgatcttggctcactgcaacctcagcctcccaagtagctgggattacaggcatgcaccatcatgcccagctaatttttgtatttttagtagagatggggtttcactgtgttggccaggctggtcttgaactcctgacctcaggtgatccaccggcctcagcctcccaaagtgctgggattataggcgtgagccactgcacccgtcctaatttttgtatttttagtagagatggggtttcaccatgttggctaagctggtctggaactcatggcctcaagttatctgcccacctcagcctcccaaagtgctgagtaagccaagttttctaatagccacattagacaagtaaaaggaaacaggttaaattcattttaacatgttttacttaacccaatgtatccaaaatagcatttcaacatgtcatcggttttttagttttttttttttttgagatagtgcttcgctttgttgcccaggctggagtgcagtggcacaatctcggctcactgcaacctccaccttccaggttcaagtgattctcctgcctcagcctcccgagtagctgggattacaggcacccgccaccatgcccactaatttttgtatttttggttagagatggggtttcgccatgttggccaggctagtctcaaactcctgacctcaggtgatccacccacctcggcctcccaaagtgctaggattacaggcgtgaggcaccgtgcctggcgtcatcggtattatttaaatgaattatgttacgttcttttgtgctgtcttcaaaatctgttatatattttacacttacaccaaatctcaattaccatggtacatttttatctgaaatgcttgacctttattttgatttcataaaattcatagttggagaagtagattcacatatccaagttgttccaattatataatagttttccaaaaactgagatgggtgtccattttttttttaagtaaagatgcaggtctggttatgttgaccaagttgctgggttgttttgttttgttttgagacagagtctcactttgtcacccaggctggagtgcagtggcatgacctcagctcactgcaacctctgcctcccaggttcaactgattctcttgcatcatcctcctgagtagctgggactacaggtgtatgccaccatgcctggctaattttggtatttttctcagagacggggtttcaccatgttgggcatgctggtcttgaactgctgacctcaggtgatccgcccacctcggcctcccaaagtgctggtattacaggcatgggccaccacacctggcctcagctgttcaattaaaagtaaatacaacttaaaattctatgtttcattggcagtagtgcaacattaatactgagtagccacatgtgattagtggctatggtattggacagggaaggtacagaatacttccatcaacatagaaaattctatcagtctagctctaggggcagatagtccttccactgacttgggcaagtcactctacaaatggcatctacctcacatggttatggtgagaattcagcgtatgtatgtacatgcaggcacacaatatgcacacagacacataacatagtacaccctttcctgaaaagcctgacacatggagctcaaacatgagtgccacccacccctgggcagcaccaagatggctctagtctgggtgcctttgtctcacccccatgcctttgctcggagtgtgctcctcatttttctgccactttgaccctgtctctgatttggtcctgtctgacatcactgctatatgctttgctcctctcaatttcctctgccctcatgccagcaggagtcatgccagagatcatatctgagaaagcaagacaattttgtgtgtgtgtctgtgcccatagaggagtgctggttgtgttgatatagttgtagattggttgtgtttacacagttgtatatattgacacccttgagtgttatgacttcttttgggggtggtcgccttttaaatcataacttttaatgggattccattttagtctttgtgaagacataaggttgttggcaggcatctgtccctgggagcatccaagcagaaaagactaagactcccttgtagacagatcactggccgccactgaagtgtgtctgcatggcaccacagggctggaagacccttgaaggcaggaattcaaggaaatgtatgatgaattttggcattgccatcaaaagcagaacaggcatggaaaacttgggtgagtgggcgagacaacctcctcaccacagcagagttccatccatgcctggataatgatggagggatttgtgtccactgcagtggggaaccatgaaggacacatcaagggtgtggttggcctgtggtgctctttggaggaatgaataaaaatgaatagaaatccta

SEQ ID NO: 5479 - DNA, 794 bp, Homo sapiens
aaggaccggacgagacgctacgcctgaaaacaggcggcgggcgagggacgaggcttaccacggcaccacgcgagtggaaagggtcgtctccgctagcggcggcccacaccagctcaccgaggggcggcagcgcgcggcccggctgccggaccgtaccatcccgggcggtggagccgccgcggaggggcgcgcgcgagccgaaggcgcacccgggaggcccaggtagcccgggggccggtgctggggcgccgggcaggcccggctcccgcctcgacccacccggagccagccccctctgcggacacgacatccccatggggacggtggcgcgaaacgccccactctgccgcacccaaactctgcagacccccagcttccctgggcggccgcgacctcccgcctccccgtctgccgctgagggcccgcggcgtacacaataggcttcccagaagggttaagaggcagaggtagaagaaatacggactttaatgaagagttttccctttggtataagtgagacccgtggaaacatccaaacagcaaaaggaggccaggatgaaaacggtcaactctcccttatccacaaggccaaaagagggggggccggcttgctgtggtgtggccaccccgggcctaggctgggccgggcctgtagaaggtactcaggaactgcaggttttgcgtttcccctccatgaaactgacaggcattcgggctgacttctgcctctcagtctcgcggtaagagacccaagtttttctagtcctagatggaaataaatttcatctgcctca

SEQ ID NO: 5480 - DNA, 1655 bp, Homo sapiens
ggtgccgggagcggggcgaggaggagggtgggtatgaggcggtagcggaccgcggagtcgagacctacccgaacgacgcgggcgagcggggctttggacgccggtggagacgcaggcgagactccagcgggaggaagaagaggcctttgccagcagtcagagcagccaaggggcccaatccctcacattctccaagtttgaaggaaagaaaaccaacaagaagacccgcaaggttaccacagtgaagaaatcttcagtacgtcttccagggtcggatcaaagaagggctggagtgcaatggcgcgatctcggctcactgcaacctccacctattgggttcaagtgattctcctgcctcagcctcccaatagctgggattacagatattgaaatggattccaggcgtgtgcctcgagacaagctggcctgcatcaccaagtgcagcaagcacatcttcgatgccatcaagatcacctagaacgagctggcgtcagcagatgacttcctccccaccctcatctacattgttttgaagggcaacccccatgccttcagtctaatatccagtatatcacgtgcttctgcaatccaagccgactgatgactggagaggatggctactatttcaccaatctggtgagtaagtgagttcttggcgttgtggagaaggactaggaaggtggtggttttggggatgtgataggtcactcaggcccatgacaggtgaatgcttctgtgtgagaaggcagcacggctgaggaagctcactttgcatcagggagcacaaggaccaggccgtacagacactccgcctccccgcacttgatcagagattgtgtttatcctacagaaacagatgacatgtgttgggcatcactccccacggtcctgggtagaagagtccttcacttggcagggctttttcaaccaatgaataaggcaaattatatataagttaataatgccatttcgaaccgagacagatggcagctaaatgaagtttaattaaagaatgagcgctggggccctttttattgggtactgcatctacttcgaccacaaaagacgaagtgaccccaacttcaagaacaggctttgagatggaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaacggaattgctgtgtgtggacagccacagcagttactgcaggccttacagcaaactcttccaccactagtgttccagatgcttttgactaagctcccaacaattagagaattctaagtgctcagagcttggctgaagatgatgtggaatgagaaacaaatgttaacataataaaatctcagttaaaaatatttaaaaaattcttggtagttgagcagctctgggggaataagggcaaatatccttgttatgaactacactgaaatctaccaaagttaatgtttactttgtgtaggtccatttgtctattttatttatttttcccagtgaaaagtgtattttgatagagaacttttcattttataaatacactatgagttactgaaaattc

SEQ ID NO: 5481 - DNA, 8193 bp, Homo sapiens
gtcagcaggccgcacacgcgccggaccgggtaccgctgtgcccggcctggccgcggcctagtcccggcagacgggactgacgaggtcaccaagcccaggccgagacggcgcgggtgtcagggacttgggaatccccctcccccagtcccgatcccgctttcctttggggtttcacctcagaggacccgacagcactcttgcaggtgggaacctacacaataggagtaatgtggctccaccttcctctcgggactcgggacctgggggtggagacttggaagttgcaaagctctcggtgccgggaatcggggctacggttgagtgggatcgggccagggctgaggtggtcccacccgtgtaggggcgcggagaaacgcctcgactgcttcactgtaccaccacccacccgccacgggcctggaaggagccgctaaacattcccgagcctcagtttccttagcacaaacaggctggtagtttcctggtgcttgccagatgcctgatggatgagaaagcctcctgcggccccgaaagggagtccagagcagaggcgggcccgcggtccacttttacaggtctggacggactcacgggaccacggtctgggtggggcatgcggaagggcctaggccaaatggggagtagtggtgagggcccagggtcagactggggggtggagtgaggttgtctgggagtcttggctttatgaaccggaaaaccaggctaataattgaatccaatccaagggatattgtaagttgtgatgtgttgactgcagtgccgctccctatagttgcgcagggtgaggggcgtttgggtactgaaatcccgcacggtctccttgctacgcccgtgtctaggccagacagcctctgcttaccatagacaccagtttctcatccacaaaggtgcccaaggccctgcttgacacaacagtgttacaagctgttagctttgatgattacttgttatatgggggagttcaacaagttggtcggtgtccttaggaaagtcacccctcttctttcctgtgcctccgttttcattgtctttaaaatgggtataaagttggctgacaggtgaagttgaaatgtgcacaggtaagggaggtagtgctgcccactgccagcagggggcagctcaggcaaggaaaagaccccagtgctctcaggaccccccaaccagctacgtgatcacatttttatgatcacagataagatgagcatatactgaggtcccttgctagcagtttggcatggaggacctcatttaattcttgcaaaaatcctgaggtatgatcactttacccattgtacagatagggaaactgaggctaagaggttcgccgactcctataacaccacacagttcagatatccctggccccaacatagagatacacacacacagtcactcacatggagcagtctatcactggagtcataactccccagccttggctcttccccatgggaatgcaaaaggggtcggtgaggagcaacagttacgaatcaactgtgttacaggtgctctctgtatattcacaaccacctggcgaggtagtgactgttatcccctttagcactgaggaaactgaggctctaacagctggcaaaggcagagctgggacaagaccagggctctgacctcctccaccaatacctctgaatcctccccagcatctactgtggtgccctttgctggtctttcctcctagggtctgaggttccccactggaaatgggatcagaatgttcccctgcctggttcccaacagggtcagaagagagaacttggaagagttggattttgagtgctttgtgtgttgtgtgtatgttgaggggagagaagttggaatgctcccacacctcctgcagcatccccaccctccccttcacccccactgcagcagtgccatgctctggaagcaagaatctgatcacaccctcctccttctctcatcacattcgggtgccctctgtcttctcaataacccaggtctgatctccctggccgcaaccagctgtgtggccttggtcaggtccatccctccccttggaatctgtacttccctaggctctgtcatctattggggacgatgcccaggtcaggcctatactcagagccttcttctcttcatctccagaacagccgtctgcctgtcttcctggctcgctccctgcaggaatggtctggggcaaccccagcaacacgcccacctgtggccaggatgaataggaatccagttcaggcttggcttccatggcaatcaaggcccaccaggccccagcaaccttccctaccccccattcctttttgctgcccccctccacaccaggcatgttccctgccacaccatgctgttcccctcacctgggctgccctcccaactcctctctgcctctggagatgctctgccattcaagacttggctcaggctccaggtcctccctgggccttctagagcccctggttctcactcctctgaacacttccagcctggctaatagcccactgcatcctggcctggggtacaggtggccagcacaggtgtgggggccagcttccaacacaagcacgggtaggtccctctgcagaccatgggctgcaagaggcccggccttgcccactgcaggggccctgcgcagggctgggcacgaagcaggtgggtgtccaccaatctagtatccaaaaccctgcttggttcacccccacctctgttgaaggaaagcaacactgtgatggagaggagcagctgtggattcaaatcctggcttggccactttctagttgtgtgacttggtgcatctgccctcatctcctcagagacaaaaatggcaacacctcccttcttgggttactatgaggattaaataacaaaacctccaagaagcagagcccggtgtctggagagtgctcaatggacgtagttattattatcatcatcagcacagtgcggggcacatggtgggcattcagggatgatggcccttgtgtcacagccgacactcttgaccagtgagtcctctctcctccctttgttgactcctgaccgtccacaaatgaggttcagaatcctccatccagcatcttccctggtcacatggtcccaaccttttgctccacccccttctctgttccccccgcagtccatgctccagccatcctgactctgtccctggatttctggcttactgacacctgagcctgtgcacaggccctcccttctgtatagagcacgcttcccatcttgtggacttgcttcccatcttgtggactcggagggttccgagcagccgttgaggctgagctcctatgacacctcctccgtgaagcctccctcacttttccattaccagtgaggcctgccacagcctgatttgtactctgatcctggcacgcatgaagccgtgttgccatttgttaacagtctgtcctccactagactgtgaactccaccagggggggaaccaggtctgattgcctctgtgtccccagataccacttagcacagagtcgagcccatagtggctatcagcaagtgctaggcccagcctgccacccacccaccactcacttgggggctggaggcattgcacgcatgcggggcatgtgggacttgtgggggcagctgagcagcgaggtttatagaggaacccagggcggcagcaggaaggatgaaggatgagtgtctgaaactgggttggcaggctcagggcatagccagcctaagctgggggtcaaaggcccctggccccttcactcccccaggggcacacagtgtcggcggcacgatgtgggatgccccaggaagggcaaggccatggggctgggctttcctccatcgacccaggacagagctggtgctgaaggccccatcagcatgactggggtggagatcttggggacctccttggggggccacagttggggggaagggcacagcccatccaacatgtccatctggtgtggctgtgccagcagggagtgtcccacatgcagagctccctctgggctgcaggaggtggggacctgggtgggcaggtgggcacagcagcagggggccccagggagcctaatccagcgggccctggaaaatgaggcggacgcagccatgctcgccggtaagccaggccccgcaaaaggggcaggcggcatggaaagcatgggtgccgtggggcagtggtgtctgggcccagtagcgggcagtcttctcagagcagacgtggccgcaaggtgcaaaggcatggctaggcggcccagggtccaggcagaggccggcctcctggccaagccatagaggcacataaggccccacaaggcggcagagaggacattcgcgctcctgggggccccgctcccgccggcagccccagccgtggtagccatggacgtgcccgcagcggacgtagacccagggctgctgtttgtcgggcgctgtgcggccacgggctgggctggggaaggccagagtgctgaggcccacggggcactggggccgcgctgcatttgcctcctgccgctgggcctccagttgcttcagtgtgggagcccgcagcagccccgccggtgtgcgccacagcagtgtggccccacacaggtcgatgagagagccgtcctgcagcacgttggactcgttttccacctgccagaggcagtagaagggccttactgcccaagaggcccctgctgagccgcgggtccatcccacagagcctccctggagaggacaccctggcgggcagggcaggcagggcagaggagcaaggcaggctaggaggccaagtgggcaggcaggtgcatcccaggcacatgctgatcccccctcccaacggggcatgggccttggtttccccatctgtctaatcaggaagtctgacccagacagggtttttctaaaataagatgttttctgaagtgccctcctcctgacagaggcaggaaaggcctctaatgaggaatgctgggtacttagctcaaagctaacggggaatgctgggtacttagcccaaagcagctgtcccagtagttacagttaaaagcaaaaactcaggagctaggctgcccaggctgaattctggcctcaccgttgactaactgtgtcccttgtcgagtaacttaacctctctccatctcagtttcctcatcctcaagatggactgcaccttctggcatctcaagtggttcttgtgaagattaaatgaatccatcaggccgggtgcggtggctcacgcctgtaatcccagcactttgggaggccgagacgagcgcatcacctgaggtcaggagttccagaccagcctggccaacaaggtgaaaccccatctctactaaaaatacaaaaagttagccaggtgtggtggctcatgcttgtagtcccagctacgtgggaggctgaggcaggcgaatcacttgaacccaggaggcggaggttgcagtgagccaagattgtgccattgcactccagcctgggggatagagtgagactccatctcaaaaaaaataaataaataaataaataaatggatcaatcagtttaaaaacttagaacagtgcgtggcaaatagtgctcaagaagagtaggcttgtgaaacattcacatgcattgttttaacaaacaatgcttccccagacctccccacagagttgacgctctggaaagaaaagccaggcttttctctgaggttttgcatctccttggccaatgtgctcatgccagagaagagcagtgcatggccagtttgaggagcacggccatgtgaccttggacagcccctgcctctctctaggactcactcccggtccctaacctcagctctctgatctgtaccacaaggagctgccactaacacctgtgtcagaactactgtaaggaccctttcctcctgcgagaggagaacagtgctaaacctgtctgaacgtgatagacatgctacaaactgccaaccctttaggctataaactgctcacacatgggccaagtgtcactctcataagaaggtgtgattttttttaagctgccagcagccttgaagccacctgggactgcacagtatgtctgtgtgtgccttgatcgcatcaccccctggacctccagtggtatgcatgctatgcttggggaccctggtctgtctgcctgtctgtgggacaagtggctcatgctaagaaccccctgggcctgggattccctgatatggagcctgttggggctccctggggcagaaggactggagatcatctcctggcttgggcagggggatgggcagcttgtgagggcctggcaaggataggggtggggaatggagcgggccacctaccagcttgccccgctgctgggctgagcggctgtcccgcaatgtgtacacattcccacagaccgagatctcccgccagacacccggggctgagtcctcggagaagccgcctgccgggtgcatcaccaggactccattggtggtcagtccatccatcaggccatctggggtccgccatttggccgctcgctcctgggaccacatgagggatcagatcacatcccccaggggccccccagcaggccatgtgccagaggcactgcccccgctaccttcaagttcagaggcggcccagagaggactggcattgaagctgcatgacttgagcgtctctctgggcctcactttgctcatcagttaggtggggttgctaactgccaggaccaccatttggattactgtgggctggttcatcacctcaagatgctgcacctcccaagcctaccccttgcctcacagatgaagagttggtcccttcctggggctcactcactccaaggaagatgttgctagaggcatcgaagccagcggcatagatgcgggcagtatagggtggccggcggtcacagaggatgcggcaggcatagcgggagatggtgctctgggcagaagggccctcggcagcccctcctccaggggacgtgtctgttaccacgaagtcaatcatgttctctgtggagcggccaatctgtgaggacagggagagcaagcagggactgtatgtacataggggactctcatgggccttccctcccagagtaccagcagctgctctgtatgcaaggtcaccaaaaaaggaggctgccaggccctggagaaggggcagcaccaactccataggccctctaggctcccaggtggggtctccaagtccaagaagccgtggcctggagcagcttctccttctctgttgcccccacagcactagggatcgccccattcaataaatacaagttgatttgctgatataattataagagggtgctcaaatgttagcagcagatagtgacttctaagtaactatttgctatatgccagccaccatgctaaacattttatatgcaatgcctaagttaatcttcccgtggggtgggtactattatgggcctcattttacagatgagtaaaccaaggcccagagaacttaagtgatgcttccccaaagtcacccagtggtaagtgatggagccaaaatctgaacccaggcactaggcctctcacacctgaactcctgagctgtgtgacctcccacagtctaggagtcttgaatttgatccttgatatagccactgacttgctgtgtgactctgcagtcaacagcccacaccgggacatcctgcttcctcgtctggagagaagcagctttcccatggcctcccaacccgtagcctcacctgaaatgcttgcagagcctagaggcctggtggccaggaggtgtgtggagaggcctgagcatacctggaacatgtctgtgtcgctatcatgtgtatactccactatgaccgagtggctccgggacagtgtatacgagatgctgtgctgaccacggttactcagtgcctggtggggagaaaaaagtcacttgccagggtgtgcagccatgataagtgtatgccttgagcaagcacctggagctcaaggcccagcagccactccctgggaagggggcagctccatccttctcagagggtggacagtgcagcagatgtttcacatgatttaagccctacagtcaccctaaggatggggttatcaggctgggtgcggtggctcacgcctgtaatcccagcattttgggaggctgaggtgggcggatcacttgaggtcaggagttcaagactggcctggccaacatagtgaaatcccgtctctactaaaaa

SEQ ID NO: 5482 - DNA, 1284 bp, Homo sapiens
cttccattgtacctcctgatacctggtggggccagtcctcacatattgtgctagcagtcttcacagcattttcttcaaaattatcttaactattgttgcccattcctcatcatacacagtatatcaagcttgtccaagccacagcccaggacagctttgaatgcggcccaacacaagtttgtaaactttcttaaactcctgagtggctgggagtataggcatgcaccaccatgcccagctatttttttttttttttgtagagacagggtcttgccgtgttgcccaggctggtcttgaactcctagactcaagtgaggaaaagaaggagttttcttagcctccttgccagaggtctgtttactatttacatttcatataattttcattaaatgtggagaatgcaagtcttaggagtcacctgaggtacatccagttttttgtgactatttcctgatgtttgacagactgttctttcaacttggtgtggctacctggagtttctgtgtcagttctttgttcttggccaactgttcctgcatagcttggcgagcctccaggtcatatttggccataattgcctttgacttggcccatttcccactgttttggtgcttaaggctcattctttccatcattctggcattttcaattttttccatttcttccagtgccacagttggattaaccttctgtagctgctcaaactcttttaaggctttcttggcctttcctttcttcacgactttgtgatactttttacttttgattttcttctcttttcgagccttggcctcatagtaggactgcagagcccgagccctctgaagctctgctcggtgcatctttgcctcttccaggctcatggcttggagagaggccttttccatgggagtcagtaaaggatctgtcactggctgcttgttcttatggaggaggttaaaaatttcctgctccaggggagttcttgccttccagccactgagcgcatgttcaatgggagcaatggctggctgctccttccccaggggaaaaaccagctgctctgcctgctggttcttcaggatgatagggtcccatttggagaggacctgtgaggttttactgaatgctacttctctgtggatctgttcaattttttctttgttaagaggtaactccaccaccttctttgatttgactctattcagttgcttttttacagtggccaaagaagatgaagttttaacgggctcaagcagatctgcaaggcccagcttttctcctgatccttcagaactgacactg

SEQ ID NO: 5483 - DNA, 2532 bp, Homo sapiens
ctgagaaaagctaacaccaagaaaatgttttaattaaactacagaaacaatggttataatacagaatattcataagcaaaaagatacaccatgttataagtacttacaaagttacaaccatttgcttccttaacattttccatgttaagttcatacatgtagatatgatcagatttaccatttttagggggaagagggaaaaaaaggtgtatttatcatcagctagatgtgctcactgtatgctccgttatttatatgcaaggcccgggtgactggaagtgcagttgtcaggcattttaataaactggacagccatttgtttctgcacgacaaggcatctttacacaggagcaatcgggagaaaacaggaaacagccaagcactctgcactgcaacacgccaccttaacagctaaccagcattactcaactgctacacaactgcgcctagtgcacaaaaatacataagagaagagattagaattgtgtttgataaacaatcctttcaaaaaatcaagtcttttcacctgaaaagtctttatacaaatttgggttcagattaccatttagatctgaaggtaaataacatatacaaatttacaccaacttttgtaggtttttaattttaaggaatgaaggcaatgctgagtcaatctcttgacagctttaggctgtgtgtaatggctgcacacgttttccttaaaagtcaggaggccacaaattaggttaccaatctgtttaatttcaaacaaaaaaagtcagcactatataacaaaatgaaattttacctcaaatatccaaatccaataatgaaatctgaagtcgttcacctcactaaattacaagaaatttgaataacagcaacaaaatggcacataaaatgaagtttgccaactgaggcaaagcttaaacaagtaaaaagttagacaaatgttacaaaataaccttttcaatagccagttgcttgttccaaggactcttcttcgatggactatgtggtcctttttccccaagtcctccgtttacactgcttgccgatacatctaggtttgaaaagaaagaagttcagcttaccttccattaaagtgcacatggtttcagtttcaggcacgtacttactaaggctctggtcaaaccagtagggtacagaaatgttccacccagccatgtttttaaaaggcccaattaggaaaatttcacaaaggctaccatcagcatgtacaagtttgaatttacgtattcctggccaaataaccaaggtgaagaaaggtaaggggaagaaaaaaaaagaaaaaaaaaagggctgtatccaaacaaaaacaactcgagatcagagaattggtctatatttcattaagataaattgtttcaaatgaaacatttggtaattgagaatactactttaatatctgagctacttagggccctttcctttttaaaaaataggaccaaacaatttaagagttaaagacaaacctgctccaatacacgcccacagaaactggtccctggaggatcagccaaatcagttaaaatctgcaatactggccaatattcttttatcaaacaggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggtgagtaacctccgagcagcactcctaatgataggagtcattcttacattaacacgactcaaaaagacctaccccaaatcccatttatgaattagggttatgtgtctcggattcccagacattaccattttcttaagaggacaccgctccttcctcttcaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggccccgtccatggcatccatagcgtcctcagcgtcgcgcttgtcgtgaaagcgaacgaaggcgaagccgcgggactccttggtgtagcggtcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctgagtaacaact

SEQ ID NO: 5484 - DNA, 3269 bp, Homo sapiens
agtgccaccgccgggagccccgggtctcggcttcagccccgggctgaacaagcagggaggggagaggcacttaggcctcgcctccccgcggccttcctcccccagccggggcggaggagacccaggaagctgcgcccggctcccgggggtggagggcctaggcctcggcccgcccgaggcggagcccgggaggtcggggcggggtcccgggccggtcacccacctgggttgccagtcattccagctccgcgaatagttggtgccgttggtgccgccgccgccgctcagccgagaccccggggctctgcggctcattaccttccccgacacgacatggccaagcgccgccgcccagagaagcgcgagtcgccgcccgaaccggccgccgccaacaccccgctccggcccggggctgaggaggaagccgagaaggaggagaaggaggaggcggcggcgggcgggggaagaggacgaccgttccgggttccgcctgagcccgcagcacaggacgaggaggcgggagcggcgcggtgagagagaggtggatgaaggggaggcgacgtctcttccagggccgtgcgcggcccacgtcgccggggccgcggaggacgaggacgacgaggagcaggcggtggcggcagctcctcacgctcacaaggccactgctaacccgcctcccggctccgctggccgcgccgccgctatcgcacgggattcgcagaggcatttttggaacatctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccattttactcagcctgccaagctgtgttctacacctttgtttttagacacaagcagcttttgagcggaaacctgaaagaaggtttgcagtatcttcagagtctgaattttgagcggatagtgatgagccagctaaatcccctgaagatttgcctgccctcagtggttaacttttttgctgcaatcacaaataagtaccagctcgtcttctgctacaccatcatcgagaggaacaatcgccagatgctgccagtcattaggagtaccactggaggagactcagtgcagacctgcacaaacccactggacaccttcgtcccctttgatccctgtgtgctgaagaggtgaggtctgtgcagaccctgggtgaggggcgagttggctatggcctgtttaactccacctgtgcagactgcagctcagcctcgtccatgcttcgtgactcagccttgtcctcagggaagctggggctggtgcaactttcagaagtggtcccagtgccgttggtggttgcctgacgaaaagctgcacttaatagaaatcactgtggatgcaggagatggacggtgatgagctcaggaccagccagcaaccccatcaggcggtaatgcctaccatggtcacccatgacttcctctcgccactgctcggagctcctgcaaagccacaggcaacaacacatttctgctccgtacgagaagctcctattgtaagtcggtgacatggctggggttttctctcagcaaatattgagcaaacactgactgtgccaggtgatgtgctgggtcccaaacccttcccagacccagccctggcactcacggagatccagctaggaagtccgggaaaaggtcatcggggaaataaacaaagtcaagcacagtggatgaacgcgctgctgccgctccccacacctcttgtggtggacatcacttacgcttcctcatggtgcatgtcacttatgcttcctggtgccctcccagatgacccccccttgggccactacacacagctgcacccggcaagagcagacaaggatggtctactcactgagcctgcaaggctggtgtgcaggacaggccagctacactccccaggtgtgtgcaagaccggggacgagtcagtcattgggaggtgaggtgctcgggcagtgtgggatggaggaggagggagggaaactgagtgtgggctcttcgtattggagaggaggggacggccatggcacaaagactcagatgggaaagtgtgagaaagcagagatttcaaaggagctacggtggagacccacagaagaggaatgctgaggcttttctgtctgaaatgctgaatagactctagcacacgcaaaacagcccaccacagcgagctgcaggattcttccgggcttttaacagtggtcttgtaaaaaaaattagccgggcatggttgtcccagctactcaggaggcagagaggggaggatggcttgcgcccaggaggttgaggctgcagtgagccatgatcgcaccactgcactccagcctgggtgacagaatgagacccctgactcaaaaaaaaaaaaaaaaaaaaaaaaaaaaaagactggaacattcaaaacctgttgatgggctcaagaaattctcaagaaattctcttgcctcagcctcctgagtagctggaactacaggtgtgcaccaccacatgtggctaatttgtgtattttttgtagagacagggtcttaccatgttgcccagtctggccttgaactcctggactcaagggatccaatgacaggcgagagccaccatgcccagccacatttttgctaaattctttacactggtgaatctcaaagaattctctgatcatcacaccatatcctgctaagtgtgcaattaacctgtggacttcagttggacactttcagattagcattagctatgtggggccaccaaatgccaactgttaaattatcactcaaagataaatgacacttgagtgtgctgtttgagtttatacctctaaaaaatgcttatagtaccatgagactagtgtgccaacgtgtctggctgccaacgtgtctatagctgagccaataagaattagtctctagagcctctgtttccaaggaagtcaatctctagattcccacattggctgcatgatggaataagccaggggctacgaaaaatactgatgcctgttgaagcttggaggagctggggttggggtgtagggcagtgatgatcacatatgaatagaactgggagtctttagtgttactggtggcaatgttgaaatgcatgagggttgtttattgtataatgaagtatttttcacatgaa

SEQ ID NO: 5485 - DNA, 9131 bp, Homo sapiens
cgtgcgcggcgtctgggcgcgcccgggagttcgcgggtcacgtgccctggcggccgggggcggagccgggtgggactgggcgcctgcgcgttcgtacccggtccgggtcggctgggctgcccgccgctccgcgcgcccgggcggtcgcaggtcgcgcctgctttggccccggcgggttcggcatccgagcctggcaggggccaataggtagggtcgcgagggtcctccccggccgcatgcgcagtctgagcgcgcgcggggtagggctcttggcctggggtgggggcgcgggcatcagcagagccaggcggcggtgtcggggcgcgaaggtgcccgtggtgttccggtggccacacccgaggagcaggggagaccggggggctgcggggtcagaagctccgggtgtccccggagactaggagggggacggcggggtccaggaggcggggtgggctccgccggcccaggacgggggcgtcgcggggaggcctgcagggttgtggggcgtcgggctgagctcctgggaggacggagtgtcacttcctgagatggggacacctcgggcgtgctggctttggtgaggagaattgaagcagtttttctttttttttttttttttttgagacagggcctctggagtgcagtggcgtgatctcggctcactacagcgtctgcctaccgtgttcaagcgatcctcccacctcagcctgttgagcaaccgggaccccaggtgcacactccaccacgcccagctaatttttttgtgttttgggtagagagggggtctcactgtgttgtccaagctggtctcgaactcctgatctaaagcgatctgcctgccttggcctcccaaagtgcgaggactacaggcgtgagccaccgcgcctggcctgaagcagtttttccttagactgtagttggagggggtgagaccacgtggagtggttggcagacaggcaggcaccctttgaggccaaaagggcgcttgagacagagccagcaggcgagcgggccgcccaggtccctggccccctgctgccagtatgaaggtcccaccaagcctctgctccaaccaggggaaccgtcatggttgggaacagccaaggtgaggaattctgtgggtcacaccccctgaaaaccactggcctccgccgggcgcggtggctcacgcttgttatcccaacactttgggaggcccaggcgggtggatcacgaggtcaggagttcaagaccagcctggccaagatggtgaaaccccgtctctactaagaaaaatacaaaaattagcagtggcagcacctgtcatccaagctacttgggaggctgaggcgggagaatcacgtgaacccagcgggggcagaggttgcaatgaaccaagattgcgccactgcactccagcctgggcgacagattgagactccttctcaaaaaaaaaaaaaagccactggcctctggctccccctggcccagcctggagaagggtccctgacccccgtcagacaagcagtgcaccctgcctcacctgacacagagccctcccaccacaggggaagtgggagctgggagctcctggtacaggcaaggccgagagttgggttagggagcagaggacggagctgagtgagtgtccagtgttaggtgggtgggggtgttagtggatggaggtgtctgaagcctcgcaggcctgcggtcacaccacaggctgggcctagccgcttggagagctttctggatctgcacaggatcttgtcccccacagacacacactgtgggcctcaaacccgggagcaggaggggcaggttggagcaggtctacctgcttgcccagccccacctgcactggccccaaggtgtccctgatggagctgagctggaccagccacaggtgcagggctgagtctgcagcagccccctccccattcctcttcccctcccccaagttagaacagcagtatggaggaggaagctggaagccaggcttggccctcacgctggcggcaagtctaatgcgtgtgtgtgcacctgtgtccacaggtggtgtgccccctagtgtacccttgggtccccaccgtagtccaaggtgtcatgtctgtgtgtgggcatcgctggttcccggcacagccaatcctgggaaagtgcatgtccctcatggcattcggagtcagggtggccagccagggccccaccagcaagccatagcatcagcccaagggcagcagccagccaggaggcaggaaccgcacccgaagttcctaggcgtcccgagtctcctgtgggcaagatcacccttgtaccctcactgctgagccctggagtgtgggtgcccccaggtggtctgttgctgctccgctactccgcagcagcccccaaccctgtgtgcccacccagggtgccgccatctcctcccctgcaagaggccagcctctgctccgcgcctctctatccccagcaggtgggaaagggtgcttccagggtactgctatctcccccgctccaagaggccagcctctgctccccgcctctctacccctggctggtgggaaagggtgctcctcaggccctgtttagggctgacattgggccaggtgacaggacacctgggcatgattgggcagctattggggagccatgggcagagcacctgaggtctgcagtcagcagcccagtccgggtgatgcctcctgggaaggggcccagacttgggggtaacggcgtcactgatgtgggtccctggccccactgtggggtgtccagggttgtgcctattggaccgcccgcctcaccatcccacgctactgagcctccttcctcagccattgtccagcttcgtgtcaagtcctggcgtggggctcaccgcctgccccttgaccgtggagttcggacgcgtctcacagtgagtgccccagcagagcagggttgggtgctgagcatcagcagctctgccagagcaagtggcaattccctggaacctggggtcttgcctttgtttggagaccgagagactcacagtgtgggagggtcacaggacatgtcatcagcagtgaaaaggttttgttccgtttcctgccttcagaacttgcacgtgctggaatccaaggatgggtgggagaggggccgttcctggagatgtctgcccttcggggctggcccatgccacaggacctcccatcacccctgctgccttggttggtgaattcggggcatgctgagcctttcccttgcagcctttgcacttgctactcttccctccgcttatcaaactcctaaccatccctcgaagtccatgggcaccagaagcaccgcctcagagactcacagactcagatgtacagatgtccctcagtatccatgcggaattgattccaggacccctgcagatgctcaagtccctgctataaaatagtgtagtgtttggccaggcatggtggctcacgcctcaaaaattagctgggcgtggtggtgggaacctgtaatcccagctactcagtaggctgagggaggtgaattacttgaacccaggaagcggaggttgcagttatccaagattgcgccactgcactccagcctgggcgacagagcaagacttggtctcaaaaaaaaaagggcggggggctgtgcgcagtggctcacacctgtaatcccaacagtttgggaggctgaggcggggggatcacgaggtcaggagttcgaaaccagcctgaaaccccgtctctactaaaaatacaaaaaattagccgggcatggtggcgtgcctgtaatcccagctacttaggaggctgaggcaggagaatcgcttaaacccaggaggcggaggttgcagtgagcagagatcatgccattgcactctagcctgggcgacagagcaagactccatctcaaaaaaaaaaaaatggtgtagtgtttgcatataacctacacgtgtccttctgtgtactttaactcatttctagattacttataatacctaatacaatgtaactgctgtgggaagagttgctatattgtgttgtttaggaaataacaagaaaaaaaaaagcacaaccacccatgtttgttttttcaaatatttaacatccttgcttggttgaatccacggatgcggaacccatagatcctgagggccgactctacccccttctgagaacatcccccacagatggctgccctgggtgccctctgttagctcagcccgactaccaggtggacctcaggttgagggctgggaccaggagacatgggcttctttcttgggaaggggcatgttgggcagtcctcgacgtggcccagacagggccctttcccagcggggtctcagccaggttcccctttcaccaaggctgggctgggtggagtctggatagttagaccccagcacctgtgagtcacgcagacccagaagcaggaagcagacagtaagtgacagccgctaagacgcagggaggctgggccagggctggggcacgagggtaccttcacctgggcgtcagaagcacttgagaggacaggggctgctggctctatgtctgcccccctaggctggcatgaactggccagagacgtcagacgtggtacatgccggcctctgtggcctggaggggcttgcaacaaggaggcaggccctgtcccaagctggcctagcctagtgtccaggacatggaggacagggtgcagcagccccggggaggggtggggccgttccctcccaagcacacttctggagctgctgcagtcgggggtgaccctaacctaccttgtgccttccttcccatgtgccggggcgggtcccacacacctctctcctgccccgactggctcccacctggggcacgcagttgggcaacccaggccctgctctgcccgtcgagcctccagggcaagtgcaagctcagcctgggcctggagacggcggatcggagcgtgtccaggtgctcagggactggtcaccgaaaggcaaggagccctccctgggacgagggagacacccaagagtcaggccgggacctgcagcggaccggggtgggagtctgcagcagaaagtgcccccatgggccttgctcactgtgccctgcttctggaggattccgcctgggaccctgcccgtgtccaggggagggcccggaggtgatcagcagcctcaccaagaatgcactagggtgggagtcccgggagaggagtcgcaccctctcagcagtggggaggggatgctggagaggaaaacagagaaacctccccctagctcaccccgttctgcactgggtgataaatactacgtgcaccctaggaagccacgtgtgtcactggctgctaacacgaggatgggggacttgagatgctggtgcaggttcccagcaaggctcagagctgcgggtctccagggagttcccgcagagcctggggggcacagcctgcctcagacagtccccggaccccagacccgtggacacctctgtccccagagatgatgctgcgcgttggagctttcctgcttttttcccgttttccagatttccttataagcgatttgacttcacagcgtgacctttttatatacattttatatctggtatttgtttagaccttagaagtgttctgaggccgggcgtgtggctcatgcctgtgatcccagcactttgggtggctgaggtggacggatcacctgaggtcaggagtttgagaccatcctggctaacgtggtgaaaccccgtccctactaaaaataacaaaattagccgggcgtgggggtgggcgcctgtagtcccagctactctggaggctgaggcaggagaatggcgtgaacccgggagtcgagatcgcgccactgcactccagcctgggcaacagagcaagagtccgtctcaaaaaaaaaaaaaaaaagtgttctgtaataaaagtgaactgataagttctgggcatccctgagaatttgttttcctttcagaaagtttcctacactactgaggtttaggggcactgtgaagcaaaagccacgcctcagaatcccaggcggagactccgacctcgtcccgggagggaagccagtagctgagcacctgcgggagattaaagagaggaataaggaggtgagtacatgacaaagagccacagtcgcaggcggtggggcctggctcagaacaggctgtgctgggaagcgggagcaggagctggcgccgccttgcgggctggcagaggaccatccactccctggcgctggggccgtcccatctcatgggcaagaaacgtgagacccctggctcgctccacacacaacctaagtgccagatggatgagacgcctacgcgtgagtaaatgccaggaacatgagactcgaacgtggcaggatatccttctgcccacgaatctaaaagcttactcggtaatgggagaatggttccaatttgataaactcgggtttttggaacgtctgtgctccagaaacactggaaggcaagtggctgctgactggaggagataattggatgctgcaagcggcaaagggctcgggatgcaaaacaccgcaagaaatgcaacaagtgaggagcattcccgcaaagaaaaaacgcacaggccgagagcagtggctcacgcctgtaatcccagcagtttgggaggccgaggcaggtgcatcgcttgaggacaggagttcgagactaggctggccaacatggtgaaaccccatctctactaaaaatacaaaaaaaaaaaaaaaattaaccggctgtggtggcgagttcctgtggtcccagctactcgggaggctgaggcaggagaatcgcttgaacctgggagacagaggttgcagtgagccaagatcgtgtcactgcactccagcctgggcaacagagtgagactctgtcaaaaaagaaaaaaaaaattgcacaaatggcacaaagaggaaaaatcaaatggtgagacccaaatagccaggagctttctttctttttttttttttttctcctttccttttttccatccttttatcagccataaaaaggaagggaaggttgggctgggcacagtggctcatgcctgtaatcccaacgctttgggaggccaaggtgagtggatcaccagaggtcaggagttcgagtcaacctggccaacatggtgaaaccccatctctactaaaaaatacaaaactagccggacgtggtggcgtgcgcctgtaatcccagcactttgggaggctgagacaggagaatcccttgaacccaggaggcagaggttgcagtgagccaagattgcgccacggcactccagcctgggcgacagagcgagactccgtctcaaaaaataaaataaaaaggaagggaagttgaatagactacagcatgggtggaccctgagtgaaataggccaattgaaaggacagatgttacacgataccatttatctgcaatgctagatttgggagagccattgaggcagaagataggtggtgggtgcccggggttaaggggaggggacggggagtccatgtgtaatggggacagagtctctggagggatgacgcattctggaggtggacggtggtaatggatacgcatgatgctgctgaactgtgcacttcaaaatggttaagacagtagattttgtgtttatacaataaacccagaaaagatgtatgctgcaccacaaacccagaataggttttacggagattttcttggtgtttttgttgttgtttgagacagggtctggctgtgttgcccaggctggagggcagtggcacagtcatagctcactgcagcctcaacctccttggctcagggaatcctcctgcctcagcctcctgagtagctgggaccacaggcgcacaccaccatgcctggctaatttttatttatttatttattgagatggagtctcggtctgtcacccaggctagagtgcagtggcatgatctcagctcactgcaacctccgcctcccaggttcaagcgattctcgtccctcagcttcctgagtagctgggattacaggcgcctgccaccaggcccagctaatttttgtatttttagtagagacagggtttcaccatgttggtcaggctggtctcgaactcctgacctcgtgattcgcccgccttggccttccaaagtgctgggattacaggcatgagccactgcacctagctatatttttattgtacagacagaggtctcactgtgttggccaggctggtctcaaactcctgagctcaagccatctatcacctcggccttccaaagtgctgggattacaggtgtgagccaccgtgcccagcctacaaggattttcattcctgctttgtctgaagttgaaaaagttttggaaaatctaagcatcgtttaatagagaatcgctaagtaaaatgaggcagcatcgtgggtggaatatcagcaccaaagcgccaagccttgtggttaaaggtggcagaccatcttcagtcttcttagcccctttcaagtcccctactatatcagaaagggttggctggttgcttttaaagcacgagccgcagaatggagagaatgggcgactggaaggcaggctgaggatggtgaggggccctgctggccagtcagagaggtatcctggcacctgtggggcaggtgagctgggagctggaggtgtgagcagtgtctgcacagagccttctctgtacgctgggctcagatcaacgggctcaagggataggctgcctccttgacttctaggaggcagcagcatgagtgggagtcgagggaggctgtcgcagggcggcctgggtgggagcaacagtgtcggttttagctggttctaccccgtgggacctccgtatctgtctgggcctgggtgtgggtgcatgaacgaggactgctgctctggggagggagtgtgccaggtgccagaagggcaggaggaagacatggctgtccccccacaccagctggaagaaggcttgggggaggaggtggtcagggagctcttgtctgctggcctcagccacctgtcgggtgagacccagagccaggaagacagagctcaaaggagcccttcccaggcaccgcaggccttgctgcttgttggcccgcatgctgcagccccacccgtggccaggcccaccagcaggcccgccggttggacacctggtcagagtgggctggggtccat

SEQ ID NO: 5486 - DNA, 3961 bp, Homo sapiens
ttttccgcttccggtgctcagtggctagccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcggttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaactagaccttcttgagaggcactatcattctcatttcacctgtcacttccagacatgggagcagaaagtgaatttcagaactccatgtcccctcctgcttttctctgagcaggacttccagttccccagccagatggggtcacaatgctgcagaaaagtgaagagctttggaatgaagatctcccggacttcaaggagattcagaaaacgtccagtgcaggtgggaaatgaatgggagctagcattccaccaacaaagtcagccctgggattctaaactcggacaagccagcactggttaagggctgaggggaaccaggcactcagtgcacccagtttactattctgtggtgtggaaagcacaggacttgagaagcaggtggcacccaggaaagcctgttcccctaagtaagtttgaactttagttacttgaaaaaaggtataactgaattatgagtgtttatgattttatctttattttattttttttgagatggagtctcaccctgtcacccaggctggaatgcagtggcacaatctcggttcactgcagcctctacctctcaggttcaagcaattctcctgcctcaccctcctgagtagtggggattacaggtgtgccaccaccatgcccgtctctaatttttatatttttagtagagacggggtttcaccatgttggccaggctggtcttgaactcctgacctcaagtgatccacccaccttggccccccacaaagtgctgggattacaggcgtgagccactgtgcctggtctatctttaaattcctatctgaatttgtttaggttttttaaataaaaatctttctttttttttagagacaggggttcaccatggtgcccaggctgatctcgaactcctcctggactcaagctatcctcccacctcagcctcccaaagtactgggattacagacatgagccacatgcttgacctgaattttaactgcagttaattatcacttaaccagcgaattcacacaggagaaatcccctggccgggcgcggtggctcacacctgtaatcccagctcttcgggaggccgaggtgggtagatcacaaggtcaagagatcaagaccattctggccaacatggtgaaactccgtctgtaccaaaaatacaaaaattacctgggcatggtggtacgtgcctgtaatcccagctacttggcaggctgaggcaggagcattgcttgaacccatgaggtggaggttgcagtgagccgagatcacgccactgcactcaagcctgggtgacagagcaagactccatctctactacaaaaaaaaaaaaaaaaaaaattcaaccaccttaggaagcctctcatttatgtatttctagcatgtaattagtgttgcacatgggaagggctaatagatgctgacagagtgaacaactta

SEQ ID NO: 5487 - DNA, 2663 bp, Homo sapiens
ggagccgtggagggaactttcccagtccccgaggcggatccggtgttgcatccttggagcgagctgagagctcgagtacagaacctgctaaggccatcaaacctattgatcggaagtcagtccatcagatttgctctgggccggtggtaccgagtctaagcactgcggtgaaggagttagtagaaaacagtctggatgctggtgccactaatattgatctaaagcttaaggactatggagtggatctcattgaagtttcaggcaatggatgtggggtagaagaagaaaacttcgaaggcttaactctgaaacatcacacatctaagattcaagagtttgccgacctacctcaggttgaaacttttggctttcggggggaagctctgagctcactttgtgcactgaggactcctagaagtaccccaccccacccctgctccttggaggacaacgtgatcactgtattcagctctgtcaagaatggtccaggttcttctagatgatctgcacaaatggctcctctcctccttcctgatgtctgccattagcactggaataaagttcctgctgaaaatccacatctcccctgggtccggtgttctggaagtgagagagacaatgtcacacctcaaggagacagctctctagacaggaaggttattcacgtcccatgtcaagtctagctagagttcagagcaattgagaagtgcgattttatctcctgcctttcattctataccctgcttctgaaccatcgtgttcaactgtgaaactcacgctttggtgaccctgactccaaaacttaatacacccaaggtcagccccagtgatctgcttcatagcgaggactttgggtgggtcttcccagggagtagggcaccctcagagaatgtggctttggacttcatcacagctagggtcttttgtgtcacttcagatctaaacttgtaactgtgctagatctgtttctaatgtgacaacatcacaaaccacgagtccagaagcctaatccataatcctacctcctcatgacgaagtctcatgctctgtgctcaacatggttagctgcacaagatgtaaaccaaagcttcactgaaccctcgacccaaatcggtaactcaagtgcatcaatcataaagaacctccccgaactcagtatttatgattatttttgaggcagggtctcactctgtcgccccggctggagtgcagtggcaggatcagggctccctgcagccccgacctcccaggctccagcgatcctcctgcctcagcctcttgagtagttgggagtagagatgcctcccacatcgcctggctaatttttgtatttttgtggagaggggatatctcgccacgttgccgaggcttgaagccagatcaagcaattgggttccttggatttccgaaatagaccccaatattctgcctttaccccggaggatgcagatgtaccttctctcaggccgatgacctcaggcctccacggtccctggagctctaggaaaggtgggcgcgatctcgcgcccacacccagtgctctgggtcataagcctggatctggaaaaacaaatgcgctttgagaagacggggactccccaggatacccctctctcccctcgtccagcctccagcccacccgattcctccccacatcctccacctccccaggccccacccacctcctccaactcctccggggaaacccaagccctgcagcgcatggaacagaagaactggaaccgacgcttctggaacaaggctatctgagagcagttcttcctggccctcgggttcatgggacggcataactggaaccaatgcttagggcgcaagggtatgtgagagtgggtcttcccgtacaggaagtagaagatcttttgtttgggggcctcgtcgtcctcctccatgtcattggccagatagctgaggacagaaatcaggttgctgctcaggggcaccaccaggagagacctccggctgaggtcagcttcccagagaggaaggtaagggaccgtccctagctcaggactggcacccaccctgcagagagccacgccttcctcaggagggctctgctggacagagacctgatcaagggcatctcccactccttcaggatggagacaaaaacccaactggtgaccaagagtggtggcttaggcctggaatcccagcacactgggaggccgaagcaggaggatcacttgaggccaggagtttgagacaggcctgggcaacatagcaagacccttgtctctattaaaaatataaaaaatacgccagacgtggtggctcatgcctgtaatcccagcactttggaaggctgaagcaggtggattgcttgagaccaggagtttgagaccagcctggccaacacagagaaaccccatttatgctaaaaatacaaaaatcagcctggtgcggtggcacacccattagtcctagctactcaagaggctgaagcataagaattgtgtgaacccaggaggcggaggttgcagtgagccaagattgggcccctccattccagcctgagagacacagcaacactcttgtcttgataaataaataaataaataaataaataaataaataaataactgtccaggtgtggtggcacagccctgtagtcggagctaatcaagaggctgaggtgggag

SEQ ID NO: 5488 - DNA, 2191 bp, Homo sapiens
cccagccctggctgcacgcgggcagagagagagattgagccccggctccgccagcccagctcgggccctgtccctctaccctttccccaagccgcccgaagtgacaggaggggcacgcacggcgcgcgcggggcgtccagcgttaaccgcttcggcgccggggacgggagcgacaggagggctggggagcaggggaccgagtgctgggactcaccggaatgtgcacgcgcagcgaacgcctcttctggctggcatttttcttgccgccgctcccgccggggctggaaacatcttttttcttcttggtgtccataaccgcgcttcccataactctaaccagaagttgattctgcgaaactcctcgggggttcggtcccctccttccctcccccggccgctgccttcggactggagccgcgcgctctgttacaccctgaagccacctcgtggggacttccgcggagagggagggtgagcagggaactcgcgcggccgccgccgccgccgaagcgccgaattcaagcgtcctttcctacggaaccctcgtaggcaaatcagtcaaagcccgtcccggttctggtgtctccccgggttactcgtggctgaggtctcccgctgggtgacaaagttttcttccttttgcaaagctaagaaacattttccaccctctcggctcctcccacagattcccagaggtaatctgaaaggcaggtgcaattaaaaccagcaatttggaaaacaagcctcctatgcctgtgcccaagtggggaatctggaaccagtaagcccgttcgtgcataaatgtaatcctcggccgcagaataaaccagctcggagcctgcagctgggtccgtcctcctttctgggcgagagggagggcggcgggggaagaggaggtgcaaggcgagccctctgcgcaattaggctacgggcggccgctggcagaagttctggcggcggcgctcgcggccctgcgcgccggagggggcgcccggagtccagcgggccaagaagggcagggcgcccgctcctcgccccccgccgcgccgcggccccaggggaccgcaaggggacagtgaggggccgggcctggcaccgacgcaagctcggggagcgcgggtggtgggaggcggcgcgtgttgaacaggaagtgcgcggcgtgcagcgccaccgtcccgctccccgtcgccccacgccgccctcgtcgccgcgcccagacccctgcggcggccgcagccgcttgggactcgctgcgagctggtttcggatccatcccgcctcccggcgtctcactgtgtgccctaccctttgaaacacgcccccgcgcccgccctgccgtagaccaggcagcgaggaagcccacagtctccgggggcgctgcgcgcgaagtagcacgtgcttctcgaaacaccgcagcccccgggtcccgccccgcccggcgcgcgcactcgaacccgcccagagagcggtgcgtggcgctgggtgcgagcagggtctagccacccccaccctcaccccaccccaccccaccctgcttttttcaggttcatcaaggtttgcgcagtggatccgcgaatgaagccagcctggaagatccccagtctcgagacagagcctgacaggggcagatgcactggaaggaccctgtctgggtttagcaaccaagcagccatcctggccccacaggtgtgggacttctgggtcttctcctggctggcttcttgctagaggatttcaagagacccagcaagactgtattgtcccactgaatgctcaagatattggttagaagtagaaaaggggagggggtagtatttagcctctgtccccactaaaaattattcccaattgtcatttgtgtcatctgtttagcttacagttttaatccttgtcaaaatgatcatttgccagggtgcataaaacaccctatttgatgagaactggttttaaaggaaaatggggccatcagaaggaagccggttggtgtgaagagacgtctgggaagagcccctggcgagggccctcattccactgggtgacccagaaggagaaaaccgcgatggcgcttctcatttgaaatgttttctttatggacagtgtttagcaattgttataatgtgtacttttgttgattgatctgtatacatatgtaaaataatttgttctctgagttaattttgttggaacaaag

SEQ ID NO: 5489 - DNA, 2138 bp, Homo sapiens
ttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcaggggagaagatcactgagggatttacggcagcagcctctgcacggcttccccacgacctccccagctgcttgctggacgctgctggagaaacagcacatcccaagatcatcatggccccagcatcctcttgaacttagtaacagttggcctgacagatgaagcggatatcatccctgccttagaagttctctagcccctttcttagagataagctgctatttcattcctaaaagaagtcatggctgttcaggtgagaagaacggtttagtcagcatctatgcaacactgtagagatgcttagtgagaggtgttgcaggagagtggcagaccgcagggcccgaggtaaggtttcttgtccatctctggaattttggctttttgcaccctgtaaagtcacgtcccctttttttctggtgctttggtggtgacgtagggagaggtgaggatgagaagaggagccatgtcctatggattcccagatccagactcctcttccctgggaaagctggattggagctggcccctccttctgtgccttcaggggctgtggaggaggaggcccctgcagggagctgcctggggcgagcgctgggggcttttcctgcagtgcattagcagcatgtcataatggaaagtggctggatttctttccagttgtaatcaatggttaagatttaacctagcaacattgtaggggtacacagccaaatgattcaggaaaaaagatgcaggttgagtctggaggaatccctgtgccagcttcctcatgctccctccctctctcagaaatcacatggaacccattctcccctcagcagtgaaaatgcattcagcctgtgtgcagtgtttctgcccagggaagcccagtagggcctccatgcccggggtgtttactgggatctggttatgtagacaccacctgcctagcacgcaccaaaattccagactttcaggaaaacaggtgcctgtgccacattatttgcacggagagactgtgtccagtgaacggttctgatcagtaaactgttgactaggaacatcccgagagccaagttcccagatgccagccaagggccatctgacctgttttgaatctcaatttcctgatacagaaaacaaaggattgtcagctgacctctgtcctgtgtgcccagtggccccaggtgacgtgtcttcaagaagaggctgagctgcggtgcttgtaaggtctcagccttagatccaaggacagtccaaggaagtcctaagaccatggagttggtgatctgggatctgggtttgctgatatttctcaccgtgaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgc

SEQ ID NO: 5490 - DNA, 5019 bp, Homo sapiens
atgcgcggcgcgagcggccgggccccacagccgcaggtcgttggtaaggcgggtccgcggaccccaggtcgagcccagcggcagtgcaggatcgcaagcggcccggcaccggcgccgcaggttgttggcaagcctggtccggggttttaggttgagcccaagcggcaatgcgggatcgccaccgggccgcgcgggcttgggagggtgacgcccgcgaggacactgcggcgtccggggcgggcgggcacactcacaatttcagcatccactcgccctccatcaccagcgtccagttggaggcggtcatgggctggacccggctctgctccggcggcagcgcggcctcctcggggcctgccgtcgccgccacagccgcgatccaggcggccaggagcgccgttagctgcgggccgcagcgcccacccgccatgttgggcgccgagcgaggcttctcggcggggagtgtggggaagggcagcggccggcccgcagcctcgctcgcccgccgggtttttcaaggaagcgggagacgcaagggccaccccgcctacgcctagcggcgcagactggcggtgctcgcaatgccgcggaggacgccacctcttatcgccgcttgcccgtcgaggccacgccccctcccgcctccacttgccgttgcccggggtgtcggttacctcagcaaccaccgccctttcttcctgaccgccaagctgacaataaacagatgacccaacgttgcctaagttagaacatgcaccgctgctgcccaggctccaataagggcagggttggcgcgtgtgggcttctctaaagggaaacatggccagtaattttaaaatccatcccctcttcaatgatagcaaatataaaagcaacgggctgcaaggtacacgtatgtttaatgaaaaatggagggacgtggtcacattagatgaatctgtaccttgggaccaccacaccgttaatatataagactggattacaattaaaggatgaggaagctttctcaaagggtgctttgtatgtgtttactagttgtgcaaaccatgaacctcggtaatgtggttaatagaccatgaaaaggatgtggtttctgccctcggcttaaaacaaagacagcaataagactaaaagtacttcagggcacatgagagcaaatttcaatcaatacttataggagagggaagttaattttgcctgaagagaagatctggcctgcattatgcattaattagtattagctaaaaactatgtggacctagcccttatcattaaaataaaacactcaagggtttacaaactattgaaatttaagaaaatgtctttgcaatgaatgctactaagactcactgttattaagtacatacatatcaattccataaactcaatggaaaacattttactgtgcttgtaaaaagaagtgactcataaacaggaattctgtcattttatcactttcatgatagaatgatgtgtagaatttgttttacaatgctccagaaataaaatgtagggaatggaaagaagataggtgaaagaaaagtggtgcaacatcagtcagtgttgaagctaagttcattttgctactttacctactcatgcatatgttggaaaatttacaaaatgaaaagctaaaaggagagagagcatcttcagcatgaaagacagccattaccaaagcatttcctatctttaacaaaaactgaagtcttagccttcagactaaggatggtaggaagaaagtagcaaggaagtatgggactgaccttgccgtaaggagtcacagaccagggtaagggacctgttgctgtcagaccatgattggcatcttagccctgacacttcctagccatgtgatttggggctaaaactagtccacaccaaagttctcttaaaatgcgggtagtaatagaacctgctccaaaaggtggctgtgaagattatatgagataagaataatgcctagcacatattctaactcaaaaagcttacatattaggttggtgcaaacataattgtggtttttgccacaatattgccaacactaatattattatttggaggcaacaatacgctgtaatgtctatttttcttatactaaagttaacttcacttagcatgatacacaatgcctctcacagcccagcttcagttttgcccactttacattccactattcccagagttccctgtgtcctagtaacacaaagctactccccattcccaaagcacattgtgtacttcagtgtctccttgctccttcattctgattagaacactcttctccagttgtccagtgaatcattcagtctctgtcatgtagtccacactgtacctctgatagctcatgcagaatgagctgctgtctcttctcagatccaattgctcttctgtataactgatatggtttggctctgtgtccccatccaaatcacattttgtagctcccctaattcccacgtgttgtgggagggaccccatgggagataattgaatcatgggggcgggtctttcccatgttgttctcgtgatagtgaataagtctcatgagatctgatggttttaaaaatggtaatttccctgcacaagctgtctctcttttggcctgctgccatccgcgtaagacatgacttactcctccgtgccttccaccatgattgtgaggcttccccagccatgaggaactgtgagttgaataaacactttttcctgtataaattaccccgtctcgggtatgtctttatcagcagcgtgaaaatggactaatacaataacttcaccacatacctttcatagtataatgcatttatatgtagctatcaccctctaccctcactcctccaaccactactaaaaactcttcaaggtcaagggctttaccttatatatctttgtgtcccctgtattgcagaatacccatcccatagatgtacttgggatagacagcttctggcactcctcccaagatctctccctcctggttacaaaaacctgagacttccattttgctggaaacttcttttcctcttgcacactcactctgcgactctgtgtggagagctccatgtgacaagggaggtctgcagcctaagcaactgagacctcagcccaacagccctcaaagaactggatcttcaaacaaccacatgagtgacctagaagcaaatctgtcaccagtgctcttgagacgggctgaagtatttaatcaccggcacaaaatgtcccagtgttctgttctcctgctgtggaaattttagagaaaagatcatgatctaagagtctacaagaccagagcagcctgaattgctgagctgcctggtggagaatagcagcattgggtggttcccaggattcttaaaaggactttacaaaggcctggcctaatcacttaagagctcttaaggagtgaatgggctcttcctgaaaaaagagcttctgctaaccctgaaaagcaagcaacaaccctgtgaactgctatggagagagatggcctctaacagctgaggacctcagtcctacaaccacaagaaactgatttctgccaacaacatgaatgaacttggaaaaggcccctgagctccagatgagaacacccaggtcaactcaggtcatgagcagagaaccctgttatattctccttggcttgtgatccataaacaatgagattataaatgtgtggtttttaagccattaggtttgtggtaacttgttacacaagcctcttttagattctttacatacacaaatatattctaaacgaataatgagtcttcctttcccatctttataccatttacttcttattcttcccttaccgctttaagacctctagtataaagttgactagaaaaggtggtagtggcattattgtgtagttctttatatcaaagggaagattttcaatgttttcatgttaagtatgacatttactgtaggtttttcatagatgctctttaatcagtttaagcaattcttgtctatccctagaattattgtcaggaataaatgttgacttttatcgaacactgtttctgcaccttttaaaaatatcatattttttccttcaaatggttactgtgttgaattatattagcagacattctaatgttaaagtaacctatcattccagagaaaaggaggtgagaatagcagtttagttatgatgctgtatcccttttataaattcttggatgcaatttgccaatatttggtctaagatttttgcattatgttaatgactggaaatgagtcttaattttcctttatttttctggcttctttgtgtttcgatatcaagaatatgcaagtctcatgcaataaattctatggaagagttggttaagattgcatttttttccttacatgtcttatagaaatgagtggtaaaatatctgaaaatggaggactactgaagaattggatatggtttcttcaggttgtaaagaaaaatatgttaagtatgctaacacttagaaacactcaaatatagcaagctaaaattgtttaatcaattaaccacttttgtggaaacatatctgcagaaatggaatgagactataaattagtgtttcctgaacatatttcactatcaaacacttcttcaatttcagtttgtaaaataaagtgtattttgtttatttaaaactttcttctttcattcaaagatccaagacaaagaatgtgtttagtctagcgttttataaacatgaaatcctgaatatgacaaatgcatgctgaatttcaatatttaatcggcatacatcagtttgttaataaatgttccttatgtattaaagctcagattttgcatttatgatgcatgaagaattataaatcatgtggtttcatcccgttgcaagaatacaatgccacactcaaaagtaatctcaaaatacttgtatttctcaagtcttttgaaagggacacttaagccacatagtgcttcttaaaataaataaataaataaataaaataaaattctatttcttttcctacccaataccttctacatcaaagctg

SEQ ID NO: 5491 - DNA, 3613 bp, Homo sapiens
aatgtttctcaggaacgctactccaggggttgctccccagtccaaatgggaggcctttggcccaccagggagctttaggttccccgggtgcttctcggaggctgacgagggggtggagagcgtgtcggtgagcgcccgggtgcagatgctcatcagcacgctgcagcgcagcggggttgctcggggcaccaccgatgagcgcgctgcacagaggggccacagggcagacgccaagccagctgccaagcccaccgtgcacaaggagcagcccgcattgcctgcctgtggtcttgttgctgactttgaccccatgagggaggaggaaactgcagactttggcccgttggtgctagattcaatgatgattccgtggaccgggacattgcggaagccatccgggagtacctaaaggcaaagagtggagccgcacagcccggggctggcaggggccagccaggcgcagcccagccttccagggctgcaggcagtggcagtagatgtaagccagaactatctcacggcagtgccccgacttccgtgtgtccccccaaaacttgtacctggctcaggtggtggccctggcagccaggtgagatccagtgaggactagggttctgccttcccggtcagagcgagcagcaacgactccttcgagcagagcattaaggcggaaatagaacagcttctgaatgagaagagatagcatgcgacccaaaaatgtgatggggtcaatagataaaaaaccagacccaaacgaaaattcgaccaagtcactcttgaaatcccacgaagagctagccgcaaaggtggcgcatcggcagggtctgaagggcgcccataaagagttcgcctttcgcaaacctccccggttagcaaagacgaacgtgcagcccagaagcctcaagtccagggtcacgaccaagcaggagaacaagggcagcccgaagccagcagccccctgcagcccttcagaagcaccacagaataaaagcggggtcaagaggagcgctggcgccctgagaaggggaaagcaagtcacaagtgcggcgcaggcgcccgaggcgtcagactccagcagcaacgacggcactgaggaggccatccaggtgtactagctgcggcaaacacgcaaggaggccaacggggacctgccccagagggcccagcgccgggaggagagaggacgcctgaccccgcacacagcacaagcagcgccacaaaaaagtgccttgcgcgagacccacaggaaaacacccagctagaggaagccagtggccaccaaggccacagacccttgcccggggtgcctagacgctgaccattccccacaagctcccgaaggaaaccaaagctccgcctccagcgagcccggcttccaggaacgagtttgtagaacggtcctcgtgccaggcagacacgtccgctgaactgacgcgcgcggaagcaatcttgggcatttccaagactaccctgccggcccccatgtaaggcagcaacaggtccctttctgcaagcccacgcttctactccctgaacgtgccttcccgctctgacggcgacagtagctccgtggacagcgacgacagcatcgatcaggaaatccagacgttttgaccctcaaggcatagtcggggagtttgctggccagaggtgagagctgctcgcaggctgcccagggcccactttcaccgcctggccccaacagccagaccagtggccccaaggcccccctctctaaaacaccggacccgctgctgagctgcaaaaggaaacgtagaggcggcggccatgccatgaggccgtccacgcccaagaaaacgcgggaggtggtgaaagatggtggccaggatgccgaccacagccaggcgtgagccgtgcccggccatgaggggcgggacctgcccgtccagggcaaagccagcgaggtcccgggaggggagggcgcagccaaggggcccggcgacactcgcatgacgcagggccagggtaagacagacgaggtgaggcacctggacgagaaggagagctccgaagacaagagcagctccctggacagtgacgaggacctggacacggccatcaaggacttaaggtccaagcgaaagctcaagaagaggtgcagggaacccagggctgcgtgcaggaaggtcaggttcagcactgcccagatgcacttcctggagcagctgggcgggctcccgagagactggaaagacagaagcccgccggtgcttaatagctgactctccaagtccaagagagacagcggcgagggtccagggaacaaacctcccagtgtctgtggcagtatggcagagaagacgaagcaggagggcgtcaggagccaggacacggccccggccttccgagtgaggggatgcgcctctgcctccgcctctgaagggaatccatttccccagggaatgccagggcccagctcccagccccggctccctgtctgacgacaggagttcagtggacagtgacgagagcatcgaactgtagattagtaagtttttggcggaaaaggccaaggagtctgagcagttcagaagttcaggcagagggccctgctgctctcgggaaatggggctcattcaggccagagttgctgtgcaggaaggagcgggccccaccgcctggcgtgtgcacgcggagtcagtgggccaggggggtcccacagccggcagaagggccatgaggtgcagagagcgctggagcacagggcacagccgacctgttcagccagggcaggaaggggctccccgctgctcccgcccaaggggatccggcaccgcccaggagcaccagtggcagtgtctccgccaaggggctctcagcgagcaggagaaatgtttacattcagaaagaccagcgctcacgaggggccgagcatgctgccagaagtgcttttattcagctgcccagcagtgccacagcgggcaccgaggccggaggtgctggggggagctttcacatgggctgcgggagccggggcttcctgacccctagccaggaagctgaaagggactctggagcccaggctgaccacaccctgccctcgagcgacttcacccaccggaacccgtgcgcgctgcgctcggaaagtagagatgcggagtggaggcggggcgtcgggagcgggaaagacaaggggtccgagggccccgcctggggcctgcccagcctaccccttgtgggcttctccccgcgctgtccacccagctcttccattttggaaagggtgtctcccaggggggcaggcaggccagcctcttcagcccgacatggggctgcctccacagggcccgtccttctctgccttcagggaggcccaggccgggcccagccctgtctttggaagcccacacttgctggcgaagaaggacggcgggccctggccaagcagcaaggcacagacagggcggagtttgcccgacaggaggaactcgggctcggaggaaagcattttagacctgaggtattgacgaagggtcatcgatagggacgaccaggaccagggcaccttgggcgggcacgccttggttagtgacgccagtgacttcagcgacactccgcgcacggaggacagtggcggcagctcagcagtgaa

SEQ ID NO: 5492 - DNA, 3653 bp, Homo sapiens
aatgaatccaactactgtccttgtcctctcctctctaggtttgtggagactgaattccacaaacctagggacagggcactctctaggggcaagtcaactctcaattatagtgagggcaggttccccagttgccagcctacaccctggccagccacccaagggaatacctgctgctgctaaggcagtcaatgttgggagggtcagggaaggggagaggaagtagctgagtgtagagattatccaggctttccttcccgtcctctgtacagaaaggcagacatacactgactcctgaagtgccccaggatcatagttggttcttcttagggggagggagtgaaacggtggccttgctccaattccaggcctctggagaaaggagtgctcaactggagagtctcagaaccttttacagtacttcagcaggcccagcacccaaccttccccaccatacccctgccctgggaatgccccttaccacagtggcttccattcctgacatttgaaccagctcctgcacttgaaggacaaggcagccactgggcagctccgggaggcgggaggcgtgactccttcatatcaggccatctggaggagcaccagatttccctcttgtgaaacaaccccccacagtggggatttaatggtcaccacacaagccccaaaaaaccaggccctgcagagccatgacttcacaggggagaaaaccagcccaagaggctgccctcacccaacacttagctctaagtccagactcttaaaggttctgttaaagatctgcggccaggcgcagtggctcacatctgtaatcccagcactttgggaggccgaggtgggcggatcacgaggtcaggagagcgagaccatcctggctaacacagtgaagccctgtctctactaaaaatacaaaaaattagccaggtgtggtggcgggcacctgtagtaccagctacttgggaggctgaggcaggagaatggcgtgaacccaggaggcagagcttgcagtgagccgagatcacgccactgcactccaacctgggtgacagagcgagactccgtctcaaaaaaaaaaaaaaaaaaaaaagatttgcctagtgagcttggccaacccaagagccttcctgggctctcaggtttcttgaggcaaaacttctaaagatgcaaatagaatccttggtagctacaaagctcatctagccaaattataagtactatccaagcccaggattcattcttgaagatgagatgtaaaagcactgctgggcccttgcaaagggagagatcagagaaaataggagaacgaacaccagctcatgccaatctcagtctcatgagctacagagaaaaagagccaaaaaagtttatcctggctcagccaccttctggctttgtagctacaggcaagttatttaacttttctgaatgttggtttttccatctggaaaaaggagacaggaaaagctgccactggaggctaccttaagggtcaatgagtgaaatggggttgagtgcttaatgaactgttaaaacatgacacagatgggtgaggtgacatctgactgctcttcacagcagtccttgcatggtgagcagatgcaatcagtgtgctcgttcattcacttgttcatcaaacaccaacagtacccacttgtgccaggccttgtgctgggcaccgtaggggctatggaaggagtaagacacagtcatgctctcaaggaactcgctgtccagcagagtgataggacatgaatacatacttctagcaaaggctgagtagcattaggcaggtggccagatgaggtcagagctctggccctagtgccctgtagtaagttgcgagggagtaggaaatgaagacaaaacagcaagagcacaggtccagcacaagaaggtgaaggacatggaaagaggagcagagcatgataaagctacaaaagtagggggcaagtcatgaggtccgggtcactggggagccctggacaggctctgaatgggagatagactagactgacaaagcagctctttctggagacctcctgtggagggtcccctcttctacccttgggagacgaggtgtcattcacttcacgatacacatggggaaaggaagttggacaggggaaggcacttgtctaaggtcactcagtggtcatgccagtgcaaagcacccaaagcctggtccaggtcctgccacctcctgcgtgggctccatcttctcggctcagttcaagcctttattatcagagtccctctgtgtgccaggctctgtgctgaatgtccgtgtcggccacaaattgcactaacggtgcttactgccacttcctctccgaccttacctccaaagacccagccgggcctaaccctcacacacagccagaggaatccttcccaaacacagttaatcacatcgctcatccgtttaaaactggcttactagagccaacacaggataaaatccacaatcagtcccaaacccatctttctctgccgtctctagaccacattcactgagcaccaaggcctgcacgcttcgcagccagccctcctgctctcccccttgccctccagccacactggccctcaacccccaacactgggcccacctctgagccctgcatcaaacaccagcacccccttcgccgagctcattcttcatcattcctcagagctcagcttaagcatcaccttccttccctgcgacagggtcaggtcctttcctgtgcgctccgcagcaccctgcctgtccctcggagtcctcgcgagaggaactagataactgtgatccccgcgcacagcacggtgtctgcctaggacacagtgagcgcttcaacgcgctgaactaaacgaatgaaggggaacaccaactcagctgtcacccccgcccccaagtgtcactggctagaagatcttcccccggttcgccggcagcaccggtgggtcttgtcacctctgcgccccgcagccctccggaggctgcagttgctgtctgctgacaggcgtcccctcaggagaacgggagctcctccagcgcagggccctgctcagcacccctggtcccgggggcccccacggaggccgccgcgctcagtgaaactttgccgcgcgcagcagtggccggagacccgcgcggaccctctccccgcggggacccgccagggcgagtcgcccctcccccgcggcagacgacccgacctgggccaaggtcggccaagtgctcgccgcctgcccagcggcccttggacccacaggacccggacccgagtgcgcggaagcctccgagccgcggccaggtctcagaatgcgcggcggggcagcccggcccgtcaagcagcgaagccgaaactagaagcctgaggtctggcttggtcactgtttgctggggaactccgacgagcaactacccttcggggactcagtttcccccgggccaagtgagacggacagctgcggctcccgcgagaactcgcgcgggaacaggagctgcgggctccgcacagcgcccggcacgtagacccagtctactaacgggctggaaggtcgcgctcccgcctccgcgcctccctagaacctttctcacctcaagctcgggctcccggactctctcacctcacggcccctccttccaccttgggccgcccagcctcaaccgccct

SEQ ID NO: 5493 - DNA, 2307 bp, Homo sapiens
ctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggcgctttcagcaccgaatcctagccactagacaaccatgcagatgcggaaagctgctttctctcccttcttcgacctgaagcgacactttcctgtgctctaggaggacttgggtcttgtgagagtctccctttgctcctggagtcgtctcacaaggccgttcactccctgctttcttcaaaaaaagaacctgcaggcgacacaccaagggctccacgagggagtcctgagtactggagcgagttgcggccacgcggccgcagctcaccactggcctagagatgccctttgccaggcggcagcaactgacaagatggtcgcgggtcgccgggtccggagccgcccaccaggttgccaggaggaggcgggagcggggaggcgcccgaggtgagacgggggcaccctctgcatcataaaggacccagaccccggcaccctcaacatcataaggaatcagacggatgcggaaaccgaggcgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcgctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctcccagtctgtcagaatggccacttgcaggctgtaaccctttataaaaaaataaaatctcctttctaaattta

SEQ ID NO: 5494 - DNA, 1629 bp, Homo sapiens
aattagggaggggccgaccaacagaaagatgagacccatggagagagagcagcagaggagaacaaggggactccacagacctcccaccagtacaacggctccccgcttctccctctgctgcctggcagtgccctggcactgtcccacagagcagaaggaagacaggaccctgctgaagaggagaagagcctgggacggaggcattgggacccagccagcacttcctaaagagccactctgtaaacaggagtctgcagacacagcgtagtccctcctggaaaccatggcctccccggtagaaagcggtattcctcatagcaacatgatatgaactaacacacttcccaagaccctcagtgtagctgcacctccaacaccttcctgctggcccacgctatagcgcaggcagcgctgagccaggccgggccaggcactgacgcccagtcaatgtgttctgggcgcataagcaaactgagcaatgagaaagcccatctccaacagggctgctccccacaacagacctctcatctggagccaaggggagagaagaggaggaggaagaccacagatggacccaaagcactgcacactgggtggttctgggcccggacaggccagtaacaaaaagcagcagaaagaaggatactttccaacaaagcaaggagagttcaggaagaaagcacagattctaatctgtgtggccacaagagaacacatggtagaatcccttccagcaaagccgcctgctctcccctgactgctttccctttctgagatgagttttccttccctggccagggctgggaggccgtgctcctcctggcaggggctcaggccacacctcttggaagagcagctcagctgaccttgggcccacatgtcctggaaccaactctgaagccaacaccaggcagtcccaccctgagaagggaccaagcacagaggcggccactgcagccaactgcacagctggacccgggtagggctcctccctcgggacctccagatggctcctcacccttgaggtcccttctttttggtcagagctactctagtcgcacccactcagtcgtgaactggagcagcagccagagagagagtaagacaatggtgaatgagaagaggccaggtgacaggaacctgcaagctcatccatccacaaacatccactgagcacctgccacgggctgggccccgtgcattcaacaacaagtaagagagacatcctctgctttctcaaagctcccattctagtataaggactcggtcaagatccacagggacatgtttaaaagtgctaagtgcccaagagggaaaaaggaaaagaggagagaaagtgtggtgggggtaaggggtgggcgctggcgctgggactgaactgtaggttgagtagccagagaaggaaggagggagggagtatgtcctactgtggggagagggctccaggccaaggaaaaagtgcaaaggcctgaggcaggctcacgcttggcatattggaatagggaggccagtggggaccgagcagagggggcagagtggcagagatgaggtcaaagcagtcacatggacaagaatatatggggccatgtacatcctagtaagggctgggtgtttgctaagcattcagtg

SEQ ID NO: 5495 - DNA, 3026 bp, Homo sapiens
agtagggggcggagcccgccgcgtgcccggaagcgctcgattccccccgctgccttgatgtggcgcgtgcggagggctaggagcgcgcggctcaggggtgtctcgttggtcgctgggtccttttccccacccagagcctccccggccgccgccgcgagctgcgcgaggcagaacgagagcgagtccgtgagggttggcttcgcagccgccatcttggctcgggcctcagactccgccccgcttctcgccgctgatcccagggagcggaactggaagacagggaaatcgtcgggcaccgcctcgctgacgctgtttagcgccaccgcagtgatgcaagtcggaagttgtagttctcgaccccggaagtctgtccttgcacacgaggcgcggcagtaccttaatcgcagcgcatcctgggacgtgcgggcggtgcatgagggagatgtggtccgcgtcgagcttctcacgcctacctcgggaagcgctggaaactcttccagggccctccaggtgggccagggcctccgaacagcccagaagtccgaccacggagccttcgtgccgtgccccgcccccggcgtgcactcggcggggaccgccttttctcctctaggctcgcttcgctgccccccagcggtggtgcggcccggccttgggacggactccgagaaccccgagccgggccgaaagtgcggggtcctgaccgcgccgcagacggggagccctcgctcggtcagaggaagaagagggttaaacctaccgagaacgttcgctgccgcttcctagagtgacgggcttgtggaattttccgtttccggagctggaccccggtgtcccgagtgtcctccgctctggacgtgctcgtgagctcaggagctggcatctaggaaacggggagttcttcactcgcagcgcagtcggccgcgccagaagaggcgagggagaatccggacggggcggggcggcgggggagcgggacattcgcgtcccggggagcccccaggtcacccctggattgcgaggtggctccgcctgagcagcccttcctggtgtggtcggggcagctgcccgcccggaaaatggtcaggctctagccctggggaggaagaagcctttgccaagagcaaccgtctacaagccccaaaacctgcgagtgccggaaatgtggactgaccacagcctgcctccccggcttcattcaccaccaaggcagcccctctggtgacaagccttaccgttgtccgggttatggcagaagcttccgatgtggctctgatctggttaagcaccactgggtacacaccggtgaaaagccgtactcctgccccgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagcacccctgcgtctgcctgcagtgtggcagggccctagcgcaaagctccaacctgggccagcaccagcggacgcactagggcggcagcctctgcaaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgaaccccgggaggcggaggctgcagtgagcgaagatcgtgccactgcactccagcctgggcgacagagagtgtctcaaaaaaataacaaatttaaaaattgtttttaacaaaggagccccagtctggaagaatcagaacactagatctgtgatcactgccttcaaagagcccagtcagctgagagggcttaggtttgttctttgaagttacaaagacagaacgtcgaccagctgaagggagagttttggaatggcgggagctatccagcgtggacccagctgcctgcagatctggcagtagctgacacagtcccttcacaggcctagggagtgatggggttaatcacacctagaacaacagctacctcttcccagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggc

SEQ ID NO: 5496 - DNA, 1786 bp, Homo sapiens
aaagggagagtgaggctttttattgtgtatgaattcacgtggtatcgacaactccacacaatattaaaacactgcgagaaagtgggtgcggcacacctggaattttaaaaaagtcagaaataaaaacaaccagacatcccaatgcagatggcatagaacctgctagaaccacaggcggcggctggaaacaggagacaggtctttacgaaggttagatgggcagcggttccgtggacagaggaggaggcgcggctggccggcatatggcttctgtgcagagggcctggcctcaggccgtggactttttaataagtgaggacacaccagtggggccgggcttggcacagctgtgccccctcctccctctgccctggcagcgggggctcggggattaaggcctcttttaaggaaaaacggggtggggtgtgtttgttcccagttaccaagatggcttgttggaaagggtggaggcaggcgggctctccctgcctggggtcctcccagggtctctggaacaggcttttgtcccttcctgccattcctgctatgcgtggtggggacgcccacaccccaaaccctgccggctcccagcccaaccacaggaggctgcagtctccgggagcctctggggctctcccgggccaacagcaggtttggcgggtagggctccccgaagccccagccctcccggacctgccgtagagagctgggtgccgggggtggggagcccggctgtggcctgtgggagctgcccgaggttgaggagtggaggtcactcccccgacacctgcacacacacccggagccctctagccttggcgaggtgggaaccctggcagtcaccagctcaggaagtgagccaagcagggatccccgcctcacgggcctgcacggaggacctgggcggccgtccaggaaccctctcggcacgggttcttagacgcctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgcagtcatctttcagaagcctccccccgaccccatgacatcttcgatttccacttgccgctgggaggagtggcccatcctgcgtctaaggcatctcccggcctcagacagccgtcctgggttgcacgggggtggaaaagcaaaaagatcgggttcgagcgacagggtaacgttttgagcggacgttttgatctccgggacaacgtctcacctcccagagtccttcagagtcactccaagatcatggaacaattttgtacacacagcagcacagggtagccccacccgccctgccgcggctccccagcctgcattttctgtttgaaaaacgtctatggtggatgccagagggtaggacaacctggaagagccaaggatggtcaaagcctctcccagccacgcggatgcctcatgcttaaaacacactgggcgcagtggctcacgcctgtaatcccagcaggttgggaggccgaggtgggtggatcacgaggtcaggagttcgagaccagcctggccaagatggtgaaaccccgtctctactaaaaatacaaaaaacaaaaaaattagcctggcatggtggtgggcacctgtaatcccagctactcaggaggctgaggcaggagaatcgcttgaacc

SEQ ID NO: 5497 - DNA, 421 bp, Homo sapiens
agaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctggacgggagggaggtctagggaggcctctgccgcgggcactgtgagtcctggccgatgatgacgagaccactgcgcaatctgagttctgggaaccaggtgatggagtatgttctgagaacagactgaggccg

SEQ ID NO: 5498 - DNA, 1552 bp, Homo sapiens
cccacctgagcggcgcatcctcagggcctgggcctggcctccttgcctgtgagatggcactgtgacggtgcccacctcgtggggtgtgtgagggccgagtgaaatcgtgcatttgcggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactcatggctgagactgaggggagccttttacagcagctctgaaagcaggaggtgttctcagacttgaccctgaagtaaacacatctctttcacctttttcttaagtgcttgctggcacataaccacttgctgaaattgtgtcattgatgctaaattaggaacacattatatggaaggaagggaaccacttctcagcacacatgcccaggcagactgtgtgggatagatttctgcttctcagataagccctgggctagagacacttgagatgtggtggtgatctctggagggaaagcaggaaggcttcaggtctcttttagactgaaagagaagggcctcatctgcagtttagtatactctgagggtctggaaatcctttaggcgaggtgctcttccatcaaaaagccagatgctaaggcagcaggtggagttacagccctatcaccccaggcagcagccagaaaaaatgggtcaggtaaactcacctactccaactaaaagagcacgggcagaatgcttcctcttagccagtggtttccaaacttgaatgtaaatcaaaatcacctgagggcttattaagccacattgctgatgcatttctgactcagtgggtctgggcccgccttcctagcaagcaaccaggtgatgctgataaactgctggtcagggactcatgttgaaaaccacagctccagatcacatagacatctgtaccaaagaagcgacgagggcacagacaaattccattataatagccatctttatttgtaaaaatccagatataaaatgtattctttcagtc

SEQ ID NO: 5499 - DNA, 2378 bp, Homo sapiens
aggctcagccttggaacatggtggggtgacatctacggagaagtctcacctggcactggaaaagcccatcctactgggccagggaccagtacttcctgcgcccccctacaaccagcagccaccctgggctggactcaccaaggtgacccaggaagtctctccaccgtgggctccaattatgtacaggatgatcaaggtggtggtggccacgaagcagaacacagacacgaacatcacccagccctggaccaggggccagggcaccagggaggaggccaccaggatccacaccaggcccccgaagatctgcgggggaggaggaggggtgagttttggcctagaggagagccccagcccaggaagggcccccgaccagcggtcacatggggtgactggagtgcaaaaacacaggaagcaggcaaagagaacagggcaggcattttcctctgcaaaaatgcatctttagtccccccagggccctgtgctggatctcaatcccaatccccggcacgcttgccctgattaactttttaaaacttttttttcttgagacagagtcttgctctgtcacccaggcgtgagtacagtggcgtgtggctcactgcaacctctgcctcctgggttcaagtgattctcatgcctcagcttcctgagtagctgggattacaggtgcatgccaccatgcccagctaatttttctatttttggtagagacggggtttcaccatgttggccaggctggtcttgaactcctgacctcaggtgatctgccctcctcagcctcccaaagggttgggattacaggcgtgagccactgcacctggcctgagtaactttttaaatatgggtttaatttttttatttaacaaacacttatatcagacctacattccaggcactatcctaagcactttacaaataataactcagtgattctcacagtaaccctctgagcaatgctgacctgtttgccagatgaggaaactgaggtaggtggaagttaagtaattcatcattctgagaaaggatttatgccatttggtattgtcatgagaagagctgctatttcttctgatattctagccctcctacttgctttgatattaaaatgtcctttcctttatgcaatggtagtgaccagcagatctttttggtctttatttggcaaaacaaattaaccacactgtcagtagtcccctgccctgcccttcctttctttctctctctctctttccttcatttcttcttccctccctccctctccttccttccttctttttctttctttctttcttctttctttctttcttttttctctttctttctttctctttctctctttctttctctctctttctctctctctctttcttttctctctctctctccctttctctttctctctctctctccctttctctttctctctctttctttctcttgctcattatttctttttctggattcaactgtttatattcccaagtccaggaagtgttctgatgatcagatttggagttggaatggagtaaccaaggacagccttgtctctttggatggctgaggatgggcatgaggaaagtacagtcccgtggttatccagaatacaccccagttgatgtcgccagggtcagtgagccccatacagtcaaagaggagcagacatgggggccagtagcacccctcagtagcccagccccgctcctcgccgtggatggacacatacaaacccgctccccaccgcggatgggtacgtacaaactccgttcctcactgtggacaggcgtgtacaaaccccagcggggactttctgcacttctctttcccttctcctcatctcccccagcgccacccccacccagtaagaatcagctcagcctcatccacatgttccccacttggatgaggactgggctcgaagcactccaggcctatgtggagattcctttgcagccaaaagtctccaaggtactacagaagtgtctggggggctgaggatggggctgccctcccaggcctatgtcccctgtggtttgaattcacatagcaccttgacccccccacctccctgcacctgctgcccacctgctgggtgagagataccgctgtcttcacaggtgttctctgagctgcttgactgagaagcaatcaggagagaattgcatttgggtagaaaaatcagtgcaatgaagactttggatttattaaaaccaagttgtccctaaggaatcagatgtgggcatctctgaccagaaagcgtcctctgctgatggatcttaggttgcctgaaggcacgtggcagggccggtgggatgcactgtgcatcttacaaaaatgggagcaaaatcaattaaataaaaatgcccagaccaccatgg

SEQ ID NO: 5500 - DNA, 352 bp, Homo sapiens
ttcaccagctccatgcagggacatcacagggctgccctccatgagcagaggaggagggctgcctggcagagcgtttcacactccaggttagccagaaagagcatcttcatttttgtttccacacaacacttctctgtgagcctgttggccaacaaagtggcggccgattgttggaggagccagccaaccatcttgtctaacttcagattcttcagggctagaatatgttcaccccagaggcttagatgaagcacatttgcggctactcgggcagatggtctctgcaacaggaagggaagctgtagctagaacatctgttaacacagtctcaacccaaagcctgctttgttag

SEQ ID NO: 5501 - DNA, 3470 bp, Homo sapiens
ggagaagcctggtttgagtgagtttttcctgaagcaaaagggaagagcttaatttcaaaaggaatatcttgaaagacgcatcaactcaccattagaaaacatgaaacgacagattatatcctaagattgtgtgaacctcttacctggaaacccgtacaattgctttatctaccaatcctaaactattatatcttgatctttactcaatcctaattacacacccacattgaaagacctatcttaattcagacttcaaaatcttacaaacgtccaagtccctcctttgaaatgctactaagactgcagtaagaatacatagcatgcagtgactgagaggaagagagatactaacacttgaagtaatccagtctatcaataggagatggactgctttgatttaaagcgatttacaaaaggatttggatacctcatctctcctgtttcgccaaggtcttgactcatcgctgcagatgactaaatcccattgagctaaatctcctgaggttttcctggagttggaagaatccatctattttgctagggaagcaaagagatgctggaccgtgacacgaatgtggccatttccactgtcaccaagctcccctaggtctccatcagcttcagtgacctgggctctttcacttctcagagatgctcatctgtgcatctcctgtcagttctcgctcttttttttgagatggaatctcactctgtcgcccaggctggaatgaagtggcacgatcttggctcactgcaatcttcacctcccaggttcaagtgattctcctgcctcagcctttcaagtagctgggattacaggcgtgcaccaccatgcctggctactttttgtaattttagtagagataaggtttcaccacgttggccaggctggtctcgaactcctgatcttaagtgatctgcccgccttggcttcccaaagtgctgggattacaggcataagccactgtacccgcctcctgtcagttctcttaaaatagccgagtgatctttccttcccattcatctgctatctgtctgctggctctttcttgccaataaagactcattttctcctatctagacttctctggcatgaggaatgagccaatttaatgcatgtcttaggtgggagtgtggtgagttgcggaaaggaggtttggggagctggattctctgtgaaaacgtgtagcaaggagaaaggtcactggggagattatcatctgcaaggcatgagaggctgttctattgtcattcacatgtcatcagcccagttattaatactttccttcctctacccccttgtcgttgttaaggagttccttggaaaaaacaagtactttccctcccctggttggtgtctctgtgtcttcaagatactgcctatttttttgaggtttcaacacaaacagatctagtcatggcaaaatggtgacattaattctgacttcccagcttcaacactcttcccctaagaggcagagaatcctagcacagtaaggggtcttaatgttctggtcaacccttcttgcccacactagtcatggaagtctttgttgaaatgcccccagtgaaaggaggttcatttccacccaaggtagctcattcaattttgccacaactgtgtgtgtgtgtgcgtgtgtgtaaatgtgtgggtgcatgtgtgtatgtgtgtgttggtccatgtgtgtgtggcttcctccacccattaattgtaattctagcagttggggccatgaagaaaaatgcaacaactcttctgggcaggaggcttttagatgactgagtactcttttgacatgtttctttatttctttaccatcgatctctttcctccaggattagcataatcagttcttgtttttttttttttgtttttttttttttatttctctgagagggactcttggtctatcagccaggctggagtgccgtggtgtgatctgggctcactgcaacctctgcctcccaggatcaagcgattctcctgcctcagcctcccaacccaagctggcagtttttccgctggaacaattttcttaagaagtcggtcacgcctgtaatcccagcactgtgggaggtggaggcaggcggatcacaaggtcaggagatcgagaccatcctagctaacacggtgaaaccccgtctctactaaaaatacaaaaaattagccggccgtgttggcgggcgcctgtagtcccagctactcgggaggctgaggcaggagaatggagtgaacccgggaggcggagcttgcagtgagccgagatcgcgccactgcactccagcctgggtgacagagcgagacgacgtctcaaaaaaaaaaaaaaaaaaaaaaagaaaaaagaaaaaaaaaaggtcagtgggtctttggtgaatttcactggatgtcactgtatttgataaaagccacatccacagatcttttcaaggtaatcagttcactctctttagcttctgtggaaatggctgaaggataccctagttctccctagaggctctttgacgtgattgacgtatacctttactctcttaaaagggccctttatttaactgaatacactggctttttgatctttctgaagttgatctattcaaccgttggtagatgttttggttatttccagttttgggctactataaagaaagctgctgtaaatgcttgtttacaagtctttgtgtgggcacatactttcatttctcttaggtaaatatttaggagtgcaattgctgggtagtaggggaaagaccttatgggaaactgttaaattttttccaaaattgttttaccactttacattcctaccagcaatgtatgccgcttctgattgttcaatattttaaattttagcaattttagtggctctatagtgatatctcttaatgattttaatttgcatttccctgatgatgacaacacattgggtatttgtcatgtgcttattgactattaacacaaatgtatttgtaaagtgtctattcaagttgttttgcccatgtttttaatgggttgtctttttattattaaattgaagggattctttatacattctggatacaggttctgttttagatttaggtattgcaaatagttttgcccagtctgtggctcaccctttcattttcttaacagtgttttttaatgagaaattttttattttgatgaagtgtagctaatcaatattttcttttatagttagtgatttctggatcctgtctaataaatatttgtctgctaggtcttgaagatattctcctatgcttttcctagaagttttatagtattaatttttacatttaggcctataatccaccatgaatttacttttatatgcaatgtgagatatgcttccaggtatgttttattctgtacgtatatgtaactgttccatctccaattacttaatgacttacactttcccattcagttgctttggtgtctcacttgtaaataaattgaccatatgaattta

SEQ ID NO: 5502 - DNA, 621 bp, Homo sapiens
tctgcaggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagc

SEQ ID NO: 5503 - DNA, 3690 bp, Homo sapiens
ctctttcccctcttgcccctctccagcttttctggtccaaccctcttctgcgcctaacactggcacctccttttcttccggctgatgaataattgtccgcaaaccagcctctctggggcactgaggggcgggaaggttagaaggagccagggctagagtcctggaaggtggcagtcaggtcgcagggccacagcagtcactctgcgactctctcttccggtgtttctccagcgccaagcgggagaagacggagcctgggagctgggactggaggagcgggaagcgcagtatcgggaccacggctctgggaccaggaaaaacgcagactctccagagtcaatgtctacttcagccagctcaagggcgcgacaacctggcgccgagcatctcaggccgccgcggggaccccccctaagggactcgggaacacctgcctaccctagaagaggcggagaataaccccgtagggagttaagcggcctctgcctacagcgttcctcccgcctccacggcgccgagccctgattgacgttcagccaggccaatcatagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtacctattgtgcggagtctcggaacgcctgcctggaagaagagttccggcggctccccgaacgcttggagaaagcgcttggatgcagttgcaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgac

SEQ ID NO: 5504 - DNA, 1686 bp, Homo sapiens
tttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacgaaaggttcacgcgctgcgtctgagctgcacgtctgccccggagacccgcgtggaaaaagctctgggctggaatctccgggcttccctgcttgggcagaattctggacctgttgcccagacgacacgtgcacattcagatgacccatgctaaggaccaaagggatgccaccggcccaatgtactgccttcatcccccaccatcctcaagggacccttgctgatcaagcccgggagactaccctttttgacctctctttggtgatcctgaccaccgtagaaatttgcagtcatgacatttcattgccctacatactgcaaaatgtcaaagtgctgagctgtggtaaattgctctggggtggaaggcgctgttactgacaacacgaagcagctagcgggtcaggaggggaaatggagcttgcagaaactaatttagccacatttaaaatttagcccctggtaaggttcccagtatgactgacgaaggtgcagggctcctgtctgtggaacctggctggttagtcttctctggttgcagccctagaatcaggatcaagggtgctgtttagagcggtttctgtagcatgtagcctttcagataagggaagtgatgcttggtcaatccacaaagttgtcttcagtttttccaactgcaaccattgttctttgagtatgttactgatgcttctaacaactggaaccactaatatgtaaaagaagaaaggcactagaaataagaaagtctaactagcttatttctcaaaggcttagtttagactactttgtttctcaagggtgggacctcatttctttcaggtccagagggccatggatatatatttatttctgtgggtgaaatttcaataatgttctgtcttagaacattacaaatatgtgccacttgttttaaaaaggggaaaggtgcaaatgcctcttgaggtcttaatgatgtcttaaactttgcactgagagactttgataatattatatactcctcatgcaaacaatgatataggtactattatatccctatcatatagatgagcccactgaggcttggagaatttaagtaatttgtctaaagccatacacacagggatggagctgagaatggattacagatttgttactccagactcatagtctggacatgtctttcccttcaattctccattgttgattagctcacgttatagttgattagatggatggctttttatttattttcaaaatttcacagaatgttacaaattggctcagttattggggaaaaaagccctaatcttgtctttagaaaactgttatattggttatctgaaaatctcttgctgatagtccagacctaaatcataatcctcactttgctccttgacttaatgtatcttcagcattaaagccatttatctgtagaaaa

SEQ ID NO: 5505 - DNA, 945 bp, Homo sapiens
agctctcgccattgtttctgcccacaacagataccgcccctgcaaggaccgggaagaagaaaaggaggcccaagtcctcggacgcgctgcttttaaatgcctccttcaccccgcccgtgcatcccgctcctaaggggtcatctcctcgcccttccccgaagtttggtggaaactaaaaaccacattcagagggtgtgaagctgagtctggtgcagagagagaaacccggctctgcgtccgatcgccacgatccggcgagggagccagctcctcctccccgctgcacccgctccccatgccgcaagtcgccctcacctccatctcggcgtctgcgggaccagcgctggccgcagacgcaaccgcctgcgccgcgacgccttcggggccgcctttgttgctgctgttgctcccgccgctggcgatcgaggctgcgggcttggaaggcgcgctctcgggaggcgggggtggcggaggctcggccgcggacgacatgatgttccgtctgcgtcacccgctgctgccagaggcccgagtccggcggggatggacggggaggcctaggcctggatgctacgtcgcaataaactggtggaggagcgagactcccacccgagcgctcccctgcgccgcgcctccgcgacgggcctgagccgggcccaggagctgcacactcccaaacgttctgctcttccgcggggctctaggttccaccggcgcttacctcacggcgggaatcacgtcgacgagggtgggcggggccagacgggtcactgaggtcaaggaaggccggctgatttagagaagggcggagggttgggggaagggaaaaggaaaacgaaagagagactgaggctgggaaaacgcttcgccgcctcctcctcttcctctggaagataacatctatctcgccagcatccaggacgacgacctacgccaccgactttc

SEQ ID NO: 5506 - DNA, 2213 bp, Homo sapiens
actggcacagcagaccatgagctccagggcacactcaaatcccccacctccgtgagactactggataaggttccaggaagcgagagagtccacggttaaaattggattaactcaacttcaaatatagttgaaatgattccggcaaatggagggtgatcagtcagcaccaagcggcgaggacaggccactgggaggaagaagcctcctgaaggtgcaggccttagtcaaggagctgaccaggaaagtggaagagatgaccggaaaagaccagtttcggcacctctgacctacctgtaccaagcatgtcgttggccacatgtggaccccaccggcctgaacctcctgacaggagcctgccttaggccaccagccattcgcaggactgggaggccgtgcactgggctggcttcagcactggggcctggctcctttcctgatttgctgaggagctgcaggaaatccccccacacccctatcccatctcagtttcctctgtcagtcatgcagtggatctgcgagggggcctcagtgcatcctgggaccccacccttcttgtccttccctgagtcaccctcattctgtctggaatcctctgtggctgcttttccacaaactacactcactggcagagtgacccctggggctttggacctctgggtattatcaacatggtaatgagccggcaggcctatcatggacacctggggggcgatcatgcttgtccacagttaggttttctaatgtatttctctgtccctggctgtgacagcctgtggaactcagaatggaagacagtaaggggcctggacgctttgttcccaccttgaccggaggcaacaatcttcctcttgcatgccaatgtcattgtataccttgcttctggcgctgctgaccccaagtggcccagaacattcctttgggtctcctcagtgaatcaaacatgtccctattccagtacatttctattaaaatctgctgagccccacaaagaaccaggcactgctaggagcttcctgtaggtgtgtaaacttccatgcactcaagccgcttgcccccaggcactgtgttggattcagcctgcagccactcatcctcactcaaccctcctgctctacccaccaatgccttccatgggtttgcctaaaattaaacattagtaaatgttgaatggatccaactggagagaaagatgttcctttgccttaagcatctatgctccatatgttttgtttccaagcagtttcattcagaaggatgtgaaagggactctgttccacagctgcactggttcatggtggtggaataatcacaagatgaaacaatcgtatcattgcttttccagcaaagtcaggcactgtgctcacaatacactacattcatggaagcctctttgttataggaatttgctttgctctaggggcgttcttttaattttacggttggaggattgagttctcaattaagggatcagcaacaaatagatattaggtatgatcaattagctatctgggaagtatgaatgttctttcagttacctagcactaattaaacaagtgtcttgccttgtgagggggagaggctcataaagacaccctcttttctctcaagggctatctgtcttggagccttggagatgagacttgtacacagactgctccctaaagagcagaatgaggccagtccctcggagaggtaggtggagagagggcgtccatggaggattagtttaggctcagctccacgccctcgaggagcccacaaaggaagtggcattgaagccaggtcttagatgataggtaggactgtaggatgcagagaagcagctgcatataacatcatagcttcaaaggattcagagcaggattgttggagacaggaggagaaattcaccagttcataatcaccatgggagatttgcaatagatctctttcaggaattaaaagatcaaggaattaagtaaacacacatgaaaaagtaagtatatacaagttttgaataataagcttcatataatatatatctaatatttatcatctgtctctccatttatctgtcaatacacccccaaaggaaaatattcattctttttgaatatccatgagaaactgacaaaaaattaaaatgatgctggccacattcttggacaaataggcaaaagaaaacaatctttttgttactgaaacaccaggggtttggtctaggtcctactgct

SEQ ID NO: 5507 - DNA, 2330 bp, Homo sapiens
aagtataactccaacttccaggctcaggaccctcatccctcacctcctcctgccaagatcaccccaagcagaaaccaggatcataacaaactctacctcacggggctgacccgaagggatgatgcatagcagaacacatggctcagctggccagccggcaggtcttagcaggtcatagtggcggaatgaccagcccacaagtcttagcaggtcgcaatggtggatgcaggatgtttctgcctgaccagcctccattctcacttccgaacagtttctgcctggatatgacaaatgtcgacctggagctgttggggccatctgggcagaaaggctgtccgggaatgaagtcaaagagatggaaaaagagaaaaagaggccggcgtctggggtcatggtttgagcccccgaatccaactgtacctgaagccctgtctgtttcagaaacagaaggcaataaattcagcctttgccttaagcccgtcaagccagtctggggtgcctcttttttttaatcaaccaaacaaatactggttaataaaactccctgctcaaaagctcctggcggctccttcatgcctgcagggagaggccagcaccctgggctctgggccccacttgccttcctttttgtcctgaactctggccctcatccctcccagacaggtatcacccaagactgctgtttcccaaacacaccatgaagactcgacctacagtttctacccaaactctcctccactccccacttgagcagtgcctgctcactagagcttgcctcctcctggaagcctccccacacttcctccaccactctgagtgtcagtggcatctacctccagcttcccatcactctgcttatttccccagagtgaaattcacttttttttttctttttcctcttcaaaaaaactttgtctcactgtatcatttaagaaatgaacatcctggattgacttgggatttgacaaattcaaacttggttttaacacaccatgtgcatttcctgagccccaggcgtaccagcagacacagggctgaaagacccagggcctacccgcaggggcttagaggctgaaccaaaccgtttcccatttggctcaagacaatggatgcaaaaatgaccatttttaaaattttaaattcaaatttattttacttggggataatcatcactgacactcactgagccattgctaggtcattgtctatgggcaggtccatgcataatgttatttaatcctcactctgggaaatgttatcctcacttacagaggaggtcactgaagctcagagaagtaaagggagctgcccagggggttacagcaactgtagggagctgaccctatattctagcccttgttatcctccctggcctttctcaactgtgtgcgaatacactggggccagcttcgaagtctttttaacattcactgtgtaaactcggcaccaagctagcttcccctggttgctcacaggcaggtggctgtccacacccacttctgtgtgggggcctctggcgtcacatttcacacccctgttctgtaggcatcgggtttcagatttgctgtatttgcttccgctgccactaccggtagatcagaagctggggaggtgtttcaacacatgattgttttgaatatggtgacttccccatctatccctgccatgggtaacatcccagcagcctcttgatagcagaacagaggccattgagcctggccaatgagcttgctgctggggctacctttcacccacatgcaggcttacttgcctgcacccccggcatggcccaagaaccagttctctgagttcagccaggacttccaagaacctagcacagccaggtcagctccactgtgtatgagtcctgaacccgaccctaggcccctgctccctcagttgccatttgccaggctacctcctccattgctcctaaaatctagctcatctgccacctcctccaggaagcctttggggaactcctccagataaaaactccagtgtccctcctctgggctcccacaggcctcagagctcacccccttctcagccctgagtgccatgtgtagtcatttcctcttttctagtcccttctcccacagagcactgtgaacatccccaagacagaaacgatgtgttgctcaccacagcctgggccctacagctggcctgtcacagggctggtgacgaccgaatgaaaggaaatgcctaatgttttctgagcacttgctacatgccgggcacagagccagggatgcccacatggagagggcctgcctcacagtgaagacagtaggaaggaaagcagaggtaagagttgaaaagtccaa

SEQ ID NO: 5508 - DNA, 11781 bp, Homo sapiens
agtggcaacttggtcgggtctgcttccgcgctgtggaggttttgttttttactctttgcagtaaatcttgctgctgctcactctttgggtccgcactgcttttgtgagctgtaacactcacggagaaggtctgcaggttcatttctgagccagcgagaccaccagcccgccaggaggaagacgctgccgaacatcagaaggaacaaactccaaacacgccgcctttaagaactgtaacacctggagggtccgcggcttcatgaagtcgcagagaccaagaacccaccaattccggacacaaatgcatcattgcactccagcctgggtgacagagtgaaaccctgtctcaaaaataagcttccattgacgaccagctttggctgttccaactcaccacagcctctgaaagacccatgctctctttggattgcttggtacctgcagcacgtttccatgcctgggaggtaaggaccacaagtctcagaagagtaggaagtgcccagcatcacacaggaagcaagttacagaaccaagggctctgttcataaactgttcaacatcttttatcacataagggctcataggtccaactaactgaaagcctcaatttgtgggaagaagagaagcgaggctggggacacagcacaaacggtgtttacgccactgaagttcttttgaaatggaaaggctctgcatgaagaagcgaacagttatgccactgcctcgccaattccagtgaggagctcatcttcaatgtagtgttcaacgtaggtggcaaaactgtaatttttcccttttttgaaactattttttcttcttttatttttgaaattctcatctaagcgacagtttcttgtactatagtgactcctgctgggagaggtaagttgaagtagctgaaggtctcttacagatatatcaactcccggccagtaaaaaagatgtcctaaacgcaggagatggagttaaactgttcccctaccttggacgcaatggcttctttcatcactaagaacaaacccctaggttttacaattgagactgagaaactagtacagtacttgtacaatttttgatctacagcatcacgacgtgaagctgcaacaattagatgtaaagggtccattcatgaggaataacatcactttgaccctttgtgttagctcctactgctaatctttccataagcgtgaacttactttcaatttgaagaagatgaaaaagtcttttgcaaaaccccaatactgttttctgatctatgtacctgaatggagaaacgtagtcttacctcgtttttttccactacaagccaagctacttgtaatccttccaaacctttaaaggggacctcccttgttagcatctcccagagaacctggaacaaaaagaaaatggaatttttatttttgtactttatattttttggtacatattactgagaccttatctaacatgtaattgtatctaattaccagacacaaccaaccccaactgtagaaacttgggcaaaacaattaagcacacaacttcttctatatattaaatactttttacgttcttttttataaagaaaaaacctggtttagaaattaggacatctagagccagacttaaaattttatgaaaccaatgggcctgactgatttaatgtcatctcataaattatcagaatttttatgttctcacaaattagattgtatattttgttagttaaaactcgttctaccttcaatttctgatacatttgtctaggaaataataactgggaattcaacaatattttaaaaggttcaataatggtctcatcaaaaataactgagccccaaatccaaatcactggctaacctacctaccccacaatggtagatacttgcaaaattgtaatatttagattttacaagttacattttagattttggagaaatctcccgcaaaatgagtcggtctaagggatctattttcatctacctacaatataatctattataccatactctaagatgtaataaacactttctatacatataagctgactatgtgaaagtgagcttatgtgtgtgttcatctttgtgcagttcttgagatcagtatgattattaaatctgagtggaatgcccaaagaaagcaaattgatgctaggaatactgctgattttgggttctcttgaaacactgagtaatggagatttgtatactatgttacttttccctgtttatacaaatggagttcaaaaatgtgagtctaccaatactctgtaaagtgcaaaaacaattctagttttatcagtaatagtcctaataataaaaaccaccaccgcttattgagtacttattatattccagatgcccttttcatatattaccatgattaatagcaatcctactggatacatcttacccttattttataggtgaggtaactatttaaaaagttaaaaaaaaaaaacttgcccaaagacagtcagttatccagtgacagagccagactatgaacctgctggctcaccccaaaggtcaggctcttgactccttttaatgtgagtgaagggaaagtgacagtacttgagagaatgcgacaggccctgtcttaggtatggcgccctgggagaagcaggaagagaaccagtggcttcgactcagatttcccttgttttaaaaacaaaagctcatttctaataggaacgtagatggagcacacatactctctagtcaagcaaatcatagaaacctttcactccatatccactatttcctcagccagtgctcagtctcatttcaaccataacacagtaaatgaattctggctaatacgaagataattagcaggaaaatcagggaaattggcagatgctgctcaagcaggagaaaaaaaattcactgaagcctctttgggcttttaatcaagtgtgtaaggtactcctttagaggagctactgaataattctatttgagtcacacaagtgattaggaaaaggtaaggggcatcccacaaggggacaattctagtgaacaccacacgtaaaggaagggtgacagaacaggtatgcaatcaccctgacctacacagggagggaggctgggcagcaagagggctgagcaggaaatggagcccctcatttggctgcaattaccactccacagggggctagggctggggaggggaaaagatacgaagggcaagtaaattaatggatgtggcattcctaaggagaatgggaacagggagttagcctccaataaatcaaacgctccagacccccaaacgcacagatgagcagtgcctcttctgagtttggcctgcaggtatgataaacacgccgtgtacatgtgtgcacacatgcacagactgaattttgtgaagtaaattgcaaatccaagagtttggggggacaacaccagaaaaacatttacgtcattcttgattccaaaatattctgctggaaaatgtccaaaatctaataaaatttaagttatatttctctgagagctctaaccgtgaaaaataaagaaaaaaataagccaattccatttgactccctctgtgtctctgaagagctactacagctgagggagttacttgatggatgtaaaagtgtctgaggtggggtcattagctgctatgtcctgaagcccaaatgaggtctttagtttaattccagtatcagcacatctcatgatttccttttattaattccctggatttggggatgtatcaaaaagcaggtggtataagataggacatcagctttttttttccacactaaacaaaaataacatttggcatacaaaagtaactttactgaggaagtcacttggaggtctaaaaatatattaaatgatgcctaaaaataccagttatgaggattcaggccaaatattattgtgatctttcaccttaaaaatattttccgactcattttatattgagacgtcctcacatttaaactgtgctcacaaggaaaatttatgttttcagtttacagaatagaaacttggaaaagactacgtactttttctgccctttcttttccaaacaatagaaagccattacctgagcccagcttgttctggaacagtgctcacagacaagccaggcagccatgctgtctcttaagccactatgttttcaaggctggttttggctgagaagcttctaagaaggtaatcctttctgcattgtcattagaatagctttttttttttttttttttttaaagagaggctaggccttgtgttctcagaaggcttattctttcagtgatttttgcttttctttttttgtggataacatactaaacactcttccaggttcagtcctccaagagttctcataagagggtagaaaaatctcatttctcataaaatggagggaaacaattgcctccctagcaaagtttaccagcttaagagcaaggatcataaaatccacttctggcattcacagcacatttattttaaggcagtacaaggttagtgagtcttgccatttgttaagaagcaacaaaggtttatcaacctggggagggctggtggttttgggagtagtaggggctaaattcttacagcagtctaaaaaattagaaaaacaaaaagcaaaaatatattgcagttttttgggtggattttaaaaaaaaaaccttttttttaatggtcttattcatctgtatgtgactgctgtgtgtagagggggtttcaatgaacagaacagactcccaatgaacaatgggatatttaatgcaaataaatgctcctactgacaaaggagtcttggctactcacctatttttgaaaagacataaaaaattcaaaataaccacattttgaattaaaataggtatcattttccaagtttatggaccacaaacttctaaaactaacatggtcccaaccttaacaactatcctcacctgctcttttctataacatctactttgaacacataatgctttcttcattaaaaaaatacctgtggttgtttaaataaaaagtcgctggaaagcatacctcgtattttttctctcattaatggtgtttatttagaacaaacagaatgagaagaggtcagaattaaatattaggttggtgcaaaagtaattgcagtttttgccattacttttaaatggcaaaacttcaattacttttgcatcaacctatacagtcctgagttcttgtttataattaaattagcatctgtacacttttctgaatggaattctgctgacacaacattctgtgaggcaaaccagcattccaagcaaacctctgtcttcaagactcacacagcagaagctgttttaaaatagactcactcactgaaatggcatttctgtttccaccaggtaagggaaggctctagcatgaatgcagaattgatattccacatcacatgatggggtggacaggttctgcagagcaacatccagtgtgtaaatacagagcaacactggaaatgctcagtggctggtggtcgagtttgtttcagtaagtgaaattactccataggatggtttgttaagcatttgttaaatccctccaaaaccaaaccaaactaagcaaaggtagggtcagcacacaagtagagagaaaagctaatccacaaagagacgtgttcaagcccttctactgaaatgtggtgcatagtttcttaagtgaaaagatttttaataaaaaacactgaaaatgtgcagctccagaaaggttgactcaaactatgtttaagaaatggggtcaatgtggaatgtatgaagagattttaaaatgatacaggaaaaaaatcctaagctctccaaacagaagtcactcttaacatcttttatagtttatgtgtgaaaaggaatttgtgcttggctactggtactaagattgtacttcatctcaggaaaagcagaggggggcatttcacaccaaagccctggcaactgtaaggctttgaaagaaggcagcataaagtttgttttcatatatgaaataatgttgaggctaaaagttcaatgtatgtatagttgtgtcttaaggtcaaaaatttttgagataaggaaattcaaacacttggggagaattttaaaagtaaaagcactgtatgtgtgtggactcataagtgcaaaaatgaacctcaaaagtcttctagttcatataaatgtgacaaacaatttaaaagctgtaacagtctacaataactataaccaacatacatatatacctaacaccaacaaacatgtttatatacatttatatacacatgcacattaaaggagtgggagcagtgggctcctggtgagccactctgaacggtcaagccacgttcctaaaccacgctgctcatcttcccaagccctcttgttccagggaggtgcccgcaacgatggcctgctgcagaatacagagtggctttttcatgtttgatgggttgtaagaaacaaaaagccaactatggcatctatgaagactatgcaacagagactgtaagtggccctcaaagccaaaaatatatattatctggtcctttctagaaaaagtttgcttgttcctatttcaacaggacaaaacgagaggccgttcccaacaagcaggctaagaaaaatttaaattactctcaggtggtgtgtgcctcagtaaataaacgtttggttataaatgaaggaatgcactttcacaagagaaaacaatcttacaaagagtcttaaattgctacaaataccccattttcagaatatcccacagatgaatgtatgatggttagaatgtagtaacatttgacataggagaccagttttataagctagtctcctctgaaacttatgagaaatatttgatcactgtaatagcttatagtcttcattcttaagaaaccagaatcaagggatatcaggtattgattttttttctttttttggatatcaggtattaagcctgatgttactcttgccttctgacctttaaaattctagccttcggtcaaaaacatatttcattcttgaaatgattttttcaatagctaacaaaattaatctttattaatttggtatacataggatgtgttatgatttacaaaaagctagtcactgaaacaagtccaaaacctgtgaagccagcattaaatacctagagaccgaataaagaaaacaaaacaaaacaaaacaggtctgacaacgtgaatctcctcttgtgtcattggctaccacctgcagtaagaaaacacagaagttcaggacgaagagacaggctgatttggacctaaaacaggctgcttctttacccattactatgaaaatgcccttttaggaagtaatagtataaacagcagggcagtataatagtataaatagcagggcagtatgagatgtaaagacagggaattccaaaactattttggactttttaaagaatacgtaacattttagggaaaagtttatcctcaacaaaaggcaacaaatgaattccttcctccagcaaagaactctcccactccacttccttctctctgataatgcaggtataacctattcctcaggaaatggcccatctccaaattcctcctccaggagcttctgctccttaacggattcattcctgtggtctcttccttgagcactccaccccctcattagtctattctctatgtggctctgctgtgattcttatgtaatgccttagagtcacgcttcagatagtcactgctactctaagactggcagcagacatggacaaggtcatctggtaagtgctaagtacattttcttttggacttttagaaaccgatgaatcagtttaatagttgagactcaaaagtttcctggtaattaactcgcttggcagatctattggtgattttatactgtttaagcaatccattacaatgaagtcctgttccaaatgatccacatttccattgaaattacagagagagtccacagtcacattaccaccctgcaaaaaatcattctcacaggcaaagcggagcccaacactatctcggattccatttaatttgtttcttggaagtggtgttggtttcttctcaacacaggacaaaataactccgatgattaaaaatgattaaacattttggcaactaggaagcgttctccaatggtgctgctttaggcattccaccagcagtacagtctcaaataaaaataaaaccatgttaaactgtatctctcttcttttgagtgtttgctttttgtatttcccttagtaaacaagaaatgagaaatgaactcaccacaccataggaatatgtgtcacaagtttctgacacagggagactctggataacttctggagccatccatgggaaagttccaaccaaggacatgtgtgttgtatggttatggaaccgagaggcaccaaagtcacagatctgagaaaacaggaatcagtgtcaactttctacttattggctaattaagggattatcagttacaaaaatctacatctgaaattaacaatttttttaagtaaaagaaatagtcctaccttcaatactccatcagcagctataacaactaaaaaaagaaaaaaggataaattatgacaatcatctaatttgtttgagctgtcttctactgaaaaaaaccataaacttctatttctgtcttcaatatgggattatgaaaggtgaaatcaatgtatttacagcattgaggattttgcaaaagggggctgacattaaaacaaaaacttaattccattaggtactgattaaaaaggcttctgagacacttgttttatccaaatgcagtactgtccagtaagaaaggcacaaattagtagtagttaggagaaccaaatttttacctgggttctgcccatgtactgccaatgtgatactgaggtagtcattagctttactacttcatattatatatatggtttcctcccaactgagtgatttttgttaaaggtggagagaatattcattcattcacttgttcatacattcattcatttaataaatatttgctgaggctactgtgggtaacgccatgtataatgctgtggaacaggactgtaagcaagtctgccactgtctttgctctcagggggtttatattcttatcagagagacaattaaataaacatctacaacaaactgggatagattccatgatgagagaaacaatactatagagccaaagaacaatgatatctgtgtcgagggcggtcagatgaagtttcctgtaagaaatgatgcttatgctaaaacctgaaaaacacaggagttaaccaggaagaggagagctgagggaggaaagtagtttcctaggcagaagagagagcctatgcaaaaactcaggagcagacaaaaaatgtatggcaattttggaaggtaggtgccaggtcaagaagagaaagagaaagccaatgaacaattttatgtggagggatgaaatgagcaaaggtgcagaggggagactatgtcagagaagaatagacctggaggcaagggcatcacttggcactcaaggttttgtggtccaggagacagatgaggacatctgtactaaggcagtggcaaaggacaggagaaaagttgaccgagtcaaaaaatatttaggatgtaggatcacctaggcttaatgaatggctggatattgggggagaaggaagcgaactcaaggataaaatcagataaagaagcaatacagattaatggttagaataggagctctggctttaaactgtaactactatttatctcatttctggcttgggcaaacagtattgccactcagtaaaagaaatgcagggatgatttttcggggttagggagaaaatgaaaagattaatttggacataatatattttagtgtcttaaaaaatatctatgtggatgtgtctaatcagcagatagaaaaatagttttgaagttgagatctgtttttgagtgttaatatgtaaatagggcttttatgggagtgcaagactcagagcataagaggagatgagtccaaggataaagttctgaagaactgtttcagatgtttcttttgtaaaccgtgcagtgccttgaacatgatagatgatcaatacttactagttactgatgattttaccaaggagggaaaatgatctttgtatgatctaatatttgaaaatagcctcagggtaaacctggtactataagtaataagctacaaacttttacaaatagaaatgtaaatattattaattttatattcagctttctcattataagattaacaagtgctcactagaaaaactgccattataaaaatacataacatagaaagtgaaactctggttacctttccaagggaaaaagaattgctataagttaggtctatattctttcaatatcagtgtatgtgtgttcctatttagtaactataatacatataactgtaactttttaaaatggggacactctccattgttatatagtcttcataatgatagcagggaaaaatccataatttagttaatcattcctcttttgtagaagatttaagatatactgaagtcaaataacatagttaaattgaaattctgagcatgaactgaaaatttacaaattcataaaactctgatcttttctactacagcctagattatttcctaatgacttcctgttagctgaccatatatcaaaagtgcttagttccaggaagcttaagtctaagaagaaccaaagaatacatgataacctagaagaggaaaggacaatcagacagggttaaattggtggtccaacctggactactgataagtggcaggtgctgataacttccctccccgcccccatcccttcaccccctgctaaacacacacacactcacacacacaaacctcacagtcctgaggcacgtgcaagggtacctgatcgattcattccctggttctcttccactacttgtcatcaccacccattctaaggatcacactattagcatatactcgttttaattaaagatctcctaaaaatagatagttcgcttcctccttactgagaaggagcatttagaaagcatgtaaataattaattgattggagggtattcagaaaagtggcaaactctgatgtttactttagctagtgctataatgctactgcctttctcagataactctgaagtgatgtaacagaagaagcattctgttaccactcctacttgaaggtaatgtctaatcctgcaagttattttaaaatgctcaccctccaaattataagatacagggccataaataagctttagaaagtacagaagaagagaaagaagaaaaagagagcctttactttccaaacttccaatcatgtggctcatttctgggcactactccaggtaatacaggcatgactggcatcaacaattcacaccacgcaattcagatgcaacaagaacaaaattcaaaattgatagtgcacaaagccacctaaaaatagaagactaaaaatatatgactgcatactttgacacagcagtatctcttttagaaaatgattctagggaaataattagggatgtcttgaaaaatttggctgaaatattaagcccaacatttcttatcagagaaaaaatgtaaacaattcaaatgtccacattctgggctatatttatacagtgaaatactatgcagcttctttaaataatattgagatttttgttatttattgacagtagaaaggcttccatggtatcagcagtgagtccaatagtaggttacaaaagatatgtaaaagaatgatgctcatttctacatgcaagtgtatgtaatttgtaataaaataggtaaaataaaaacataactacattaccgtt

SEQ ID NO: 5509 - DNA, 14567 bp, Homo sapiens
ctgaggattagtctaaattcaagtatttattccaattagcactttcattgtttgaaattttatcttttattaaaaaaaaaaaaacaggttcatagacttttgagcattcttgcaggcattggataatttgcattaaaacaaataaaatgtggctgggaaagcagactgcaatttattttgacccacattctttataagggataatttgtgactgaagaccttatttgctggataagtgaatgtacatacagggaaaattgttagtactgtggcgtcaattgcactgcggactttagttttagtgaaaatgatcgtgactaccatttcagttactggtttaggaatataatttcctattactatgtaaatttgctttgagaaacattcatgccttgtaagagaggcttaaaaatatccagtagtaatacctttgactttctgttaacacttcgtttatttttatttatctgctatccctgatgcccaaattttttgttggccaagacataacatctatttccctatttcctttagaaattctgatttattctaatgacttttttgcttgagaatgagaggaacaaaagaatctaagctttacggtacagaaaagtgaatcactttcaaattactattaagttttcccctccatcttattcttacgtgatttcatttctttttcaaagtacactcattacacagtatagtcatttaacagaccttattgatattttagttttttggaaactgataaaggaattatggtctgttgtatgatagttttgagttaacatgggtatttctttggtaagacagatccagttgtttttcttatgcccatgtatgcaagtaaagacaccaaacattctttaaatgctgcttttaaactttgaaagtacaatttgaagttgtaactatacatctaattagacttaagtaaaaccctgatttttttcctggaaagaacaaaatctacaaataaaatttgagttgtttgtatttcttaattaggtgttacaagctacaaagttgtcataaagaatgctaagaatggggatagaaatgattctgagaaaacaaaccctcgcaaaaacataagattaaaacttgggttccatgtcaaaatcctttcctttaattgcaaattatattttgaattttaaagtggccacctcctcctctgtccttttcactaattaaaaatatatttgcagaggtaccctctaatatttggtttatagggattggcatttttttttttttaaattaggtacaaattatgagtgtaaggaatttggtttcctgctctcctgtctttccatcttttttgttccccaagctaattgatttggctttatttatgagcctgttacagtaaagtgtgtgttgggaaatatattgaggtatagagctattctttgtaggtaccctggtgagaccgatacaaatatgcccctccccataatggaatactaatttttatttgatcactcatttatagcagttgcttaaatgtatgtatttatatgaaggtattttaatttttaagagcaaaaaagttctaataagttgccagatttctaataaatgcaggtttatttggtgaaaagataaggaaaatgagttatgattctgtagtttttttaaaatgagttcagcataattgtttttcaggtttttttagttactggggttattctgcataagaaagcccaatgctttctgatagtaggagataatttttctctcttttgactttgaaatctgacttaggagatgaattctttttaaaaaggtcagcatgcaaaaaaataaattatatattttaaattctaaaagagaagggacataaaatttcactcctagcataaagccatataatattattcttgaaactcattacatcatttgcctcctgcccatttgaatataatcatacctacgttttattaattgtgcatttgtaaaaccaaacccttccagtaaatacttgctataaggctattgcttgtcaattatcaaggcttctaaatatgttaaaacttgtcattttgatttttcaaagataattttattatactgagctaccaatattcttaaagaaaactaaccaaagttaatattagtgtagtccattattatgtggacaattattatgtggaatctcttaagtgagcaactaagaaaaagccttatagaaagactacactggatttataagtgtgtttatgtttctctaagaatgggagcttctgttaacttaggggtggagttgttctgaggaaaccagtagattggatgactgactggagaatccagaataacaaatccattagccagacatgtttacttttatattagaagtttgttgattaggtcttaattttcaaacgcaaacaccaagctttaaaaatattgcatatacaatgtattggtcagcaatttaataatatttaatttgaagttaattattgttaatccttctagaaaagttttttttctttaaataaaagtacatatatatacttttttatttagaggttaccagaagctctggttttgttttgttttgttttgtttttttgtttttttaatcattttcagatgttatccagaaatctgcaagtgtacttttcctgttttaactccttccttttatcacctgactatcagggaagcgaggttgaggctgccctgacctgacatgtcatgatgtcgacttgctaggtggggttcgctggggacgataaccagtggaattgttggtaagaacttttttttcctatttttttttttatcagtagtggggcattaagtgtgggagaatgcccatatcctataagtgggcaattatgtcagccttgtagaaaaataggactttaatattaaattattttgttcttaataggaacatataataacacttcacttacttttaaattggtagcagatcagcaggaaaggcctgcaagtatgaagtaatgaaatactcagggtatattttaagtgagcaaaatagacaccttataatcttaaaaagtctcttggagagacaataaatttgctttaactgtcatttcagtctagtattatattttctatattttgttggatagattaacatataatgcatcttaaagagatatttattgcacactaattttagtgaaaacaagaagacattgatagaatggagggcttaaacaccaaagatactatttttaaaaatcttccaaagtaatcttaacactgtaaaatgaaactttaaaaagttttagcagtttgacaataatggcctcaatttagagatatgttgagacaatgactttgggtcaagaggaaattacatagctgaaatattaagaccttgaacatagcagaaacataaacctatgaacaacttgtgttttgtgtgaaagctagggtagctgataggattagcagatattggtagaattaagagtcaatatttaaattattgctaaagatgggcaaaagggacttctctagcctcttcgataatgtaggtagacttgtacttagtgaatcccattataatgttaggtactatgttctaagactatttctataattggactgaaggctcctgcaaacataaattgctgatatggatatagtaacataagaaataccaaaatagggacatttgcaagaccttttccatttaatcatcagtttaataaaaatcatgcttttggtacagtgttcatgtaccataactgtattggaatatttgtacgatgttaaatatttttaataaaatttaacatgttcaaaatgttgtgttggtgattttgggtggggtgtgatgggtttgattgtgcaaaacagatttagtagttatgtgatttaggcttttgtagttaaatggagtttctgtcttcaaatttagtactagatactgtacctgttctaaggaaggtagtgaaggagtaggatagtaaaaatgaaaaggctgaactccccagagatttattaaattgccaggaagcttgactgaggttagaactagatctacaggtggcagataggaatattggctgtggcataacaggctgccaatagatacagtggtttttcaaagggttgcttaagctttagctgtaccaaaagccccgaatttatttagtttagttttagaaataacaagattttgttaggtattttcctgtggagtatattatattcacctagggagatatcttctgtctatagctatgaaaagaaattaaatttctatttccttgtaattgaaagttgtgaccaaaatcaagaccatgtgtagacatttcctctagctcataagcaagagtagtgttttattcagctgtttacttaaaattccaaatggtgacttttaggcctagatgtctatttgttaagaggcaggaggggctctgtgtggtggtggttcttgctggtaatcctagcactttgggaggcccaggtgggaggattgcttgagccccggagttcaagatcagcctgggcaacatagggagaccccatctctacaaaaaatcagaaacttagctgagcatggtggcacacacctgtagtcccagccaccgtggaggctgaggtgggagtattgtttgggcctgggaaaatactgcgttattgcagatctcaatactgtttaatagaatttggaaacattcctgtacgcgtgttcttgggagattattctgtacttcagttaggaatcctttaagtctgtaaacttcagtttcagcctaggtttttaagtagattaagcaaagttaatacttttcttttcttttcttttctttttgagacagagtctccctgtgtcgcccaggctggagtgcagtggcgcgatcttggctcagtgcaagctccgcctcccgggttcacgccattctcctgcctcagcctcccgagtagctgggactacaggcgcccgccaccacacctggctaattttgtttttgtatttttagtagagacagggtttcactgtgttagccaggatggtcttgatctcctgacctcgtgatctgcctgcctcagcctcccaaagtgctgggattacaggcgtgagccgccacacccagccattaatacgttttaaaaggccactatttttatcagctaaatcacttttgaaaattttgtgtgttatgtgttatactcaaaatattatcaaaacattctgttttcatttgaacctattgattagaatggtgcttatttatttggctgttgttcaagtacctgaattggcttggtcagaaggacttgggtgttctagctagctgtcgtataactaaatatagagttggtatggaaaacgatttgatctaaatacaaccaacaataaatatttttattgaaacttccttttaattgatgagtagtaatatggatgtcttcattagttgtaatgtcatttctattttactttcctaaatgtgaaagaaaagatgaaagaccatttcttggacatatcaaatgatttttaaggaatttctggtgattatttaaattttctagttaagctgtctaggtcagaattcatcattcaaaaatgctgctcaaacttgaagtgggtaggaatttctggggattttgattaagatgcagattctgactcattaaatctgagatgggcaagagtctgcatttctgacaagctcataggtgatgccagtgttcctgactacactttcagtagcagagttacagattatcccacattttgggggattttgtgtttttaataagattgagccaggctgtggtattttatctgcaacttactacaattttacgtgtaattcaattttatccttaacttcttctctccagattggagttcttattctttgaagtcaaaagccactttatttctgtgaatacttccttttcactgttttgtaccttccctggctttctattacgtctttgaagtggctactggaaggtaatgaagtatgctggatgcatatgtattaaccatggttttgtgtcgtgttaatcatccttaaaaaaaaaaatccttccaaattatccccagttgttatctttctgtttgtgtgtgtgtgtgttttagaagtgaggcattaggctgggtgcggtggctcatgcctataatcccagcatttgacaaaattaattcatatttagtctaatatattccaaaatccaagacttaatagggtaggaagcactgctgtgggccttaaaagttggttgctagattattattcctcttcctcgtcatcctgcccaatccctcatactaccctatttgtcctacgcagttgtcataatcatcacacagacacccacatgcctactatgtcatggtgtcaagtttaaattcttgaagtttgagaactttcatatacttccttggcatcttatgtttcctttaaaccttttattaatttcccaatctgtctgcaattctgcctaagacttttctgtcatccttaggaaggtgatgctgatttttttccccatactttggtccacctttctttaacccattactttctagcaattattttggcagttatttcattttcctaagacaaagattggaatgtgttgtcactgatgaaataatagaaatatatggttgagtcatgtacaaaataacttacaggccccaaccagtggccctcttcagggggtatttggaattatttaagtgacagacaacaaatttggactgaatcttaatatctagattctgtgggtaacaaaatctgtaaatagaaaataataaaatggttaggattagtccatatgagagtttgcgttcagaggtttggagggcaaaactgacgatttcctgctcttgactattatagagcagtctcttgcttcacagttgtcaaaatcccacttcatgaacgatcacagaccaaatggcagaaaacaacccagttgttttcccagttgtttctattcctaaaaattgcataggtgggtacatatcgtattctgttgtgttttctgaaagcaaaggtactgtcatgttattgtggtctatgtgcatatcgctgtagttatccatgctataggtaaaactgttgaaaagaattatttaattgtggtgataaactgccttagacggagtctgttagacgtgccttcttatggtgtttatgccttagctgtctcttcctgaggaaatgtatgaataagaaaggcttcttgatattttgaccttagacttgatatctaatgcaacacccttcctcccccatttataggaatagtactcattcattgagtactattatatgccagacacacgacgctaggtggtttgtattatctttatatccacaataaccttgatttaggtagtagtatccctgttttactgtgagaaaactgaggcccagaaaggttaagtgataattgtatggctagtttgtgataactatagatactacaactaaaaatttacctttctggttcttttttttcattcttacctttctctagcaatacatatttagctctttagagctagttacaatatattttttatgttagacttactgtgtggggagttttgaatttaaaaagctattctgaaagttaaatatcattagatacattgtcaaaccctgaagctgaaattccagccattcagggagcccctcagggagatcactgcttttcccttgcaaaaataaaaatagtgtataaaatactatttaaatatatactcttatctaattctaatagctagtatttgttaagtgcttagtaagtgccaagtgctgttcaaattgctttttaggctcacacctgtataatcccagcactttctgaggccaaggtgagaggactgccatcttgaaattttttttttaaagtactttttactgaaaaaaaattgtttatgaaacaatttaaatgatattgtttaagccaaaacagttacttatatttcatttctcttttatttttataaatagagcatcaattcccttaatcacaaaggtcaagaaaggttatctcatgttacattaggacatacttaggacttcgtagtatttcccttctgtgtgaaattttatccagaagacttgaattacttaatcgtaaagtgaatagcaaacgtgaatctaaaacatggtttcagtttttcagaatcaggcctgctttgtccctaaatgctttcttatttccccagagcccttattggatttaagccccatatcatatctcacatacctgagacagacataccacagtgaaccctgcatgtccttgtaagttcttttccgtgcctagaagttgcagaagaccaaggaaccttggaagtgacttactcttttgcttcataaagttgctttaaaacagcctttatatatatatatataaatttgtttcataaagcaaggagaaatggtgtaaataatacaagtgtggctattgacatatgaaaatgtccatttattttgaaagtgactacccccacagattatataactgtagaatcgaatacaaattttctcacttttcttccttgctttggcatttttttaaaagttacttgaaagttcagtttagattgaaaaataagggcctgattaatagcgctgtatcatggtattagagtacatatgttagtattttcatgaaagaggaagagggtaataactgatttacctatgattaaaagatagtggtgacattttcctttgaaagtttgggctagaaatttataacctttggccaatgaaactacagtagcttcagtcactgcttccatgccacatctctacctaaagggaagatggaatccgccttctcttttttttttttttttttttttctgagactgaatctcactctgtcgcccgggctagagtgcagtggcataatcttggctcactgcaacttccacctttcaggttcaagcagttctcctgcctcagcttcctgagtagctgggactacaggtgcctgccaccacacctggctgatttttgtctttttggtagagatggggtttcactgcgttggtcacgctggtctcgaacttttgacctcaggtcatccacccgtctcagcctcccaaagttctgggagtacaggcgtgagccaccatgcccagcctgaatcccccttctcaaaagtaacttccattcactttgtccctggcagtctgctggtgaccatgatttctaaggctcactcatgggaccaaaggcaagaagaaagggaggagggtggtaaccagataaactttgcaacccctttgataggactttttgggtgagaatttttatgaaaagtaatatatacttctactatagatctgcctctagtttcaacctctagttttagcactgattttttccccttaatttcttcaaagaaagtgggaagaatgtccacagatgttaggagaagacaattatgtaggaaaaatattttctcaaattaaaatttaaaacaaaagtttgcagggaatggagtggggttcagcattagggaggtaggagatgataaaaatacatattaagtaatttgtaccctgatatgctttgtatgtagattgcttacaactaacatgaaatgagcatttcattccttaagcatgctgttgggggaaaatgggagccaggctggatgcacaaatttacaccagatgctctgtatccaggtagcagaaatgactaacagcactggtatccatcagtcccagagcaaaagcgtctccagaggaggacatctgtaaatcccaaatctgatctccttcatcatcattaggcaacagataggataagacttcatgaagagaattttggtggctttagattgttgagaaagtatatataggaaaaaactggaaattatgtccaagattttttgtctaactccttatcctgatattgttaacatttcacaactaaaataattttaacagacaattagtttttaaaaatgtattttcatgacctgagactacagaaattgccattttcttaggacgtagtttacatttgactctgcttactgtgtccatataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccaggctggagtgcagtggtgtgactttggctcactgcaacctctgcctcccgggttcaagcgagtctcctgcctcagcctcccaagtagctgagtctacaggcgtgagccaccatccccggccaagcagtatctttttgctttgaaagtgacttacatgtacatttgttttccttgtgaatgtttctttttaactgcaaactaagaaacattgagcccagcattcatatatttgcaaactctgtcttacttaatttctcagtttttttcctcagaaaaaatgaaattccttttcttttttaaatttattttttctttatttttctttataaagtgaagagtaggtagcatgaattcctcttgccctttgctatttcagtctggcatcagtagcaattgttgctatgtccagttttcattcatggatttttctgggattgaagatgagttcaatgttgattatttaattgggcagtataagtaaattcattggctctccttccagtttagtgaatactaaatatcatccatgatattttatacttcttacacttctggaatctaacctgaaaatagaagttgtaagtcagggacggtggtatgtgcctctagtctcagctagttgggaggctgaggcttgagcccaggccttcaaggctgtagtgcacaatgactgtacttgtgaatagccactgcactccagcctgggcaacatagcaagactcccaccccttaagaaaaaagaagagagaaaaaaatagaagttgtggagagggaggaggatgcttgaatactttgaccgtacttggcataatagacattttgagggtttttttgttttcttaaaattcctctggatcagttttcattgtttctagtaattatatttatcgttaatgaattcatattctgctctagcccctaaagatagtttgatatgctaacttttgttttgcctttctagctgctaagatagataatggttattgcaaaatgcacgtttttaaatggtctccagtgtggattgcttctgagctgctgatggattgaatacattgagaaggaatgtgtcatttggaatccaggaccagtcagcaaggataactgcctgattttatggtcagaatgctctaactcttatggcatactgatgactttttcttccattttccaaaaaagcaagttttgtcagtctcagtgtttctctgatctagctactcacaattccattcccaaagtagtgacctagttctgtcacttgggtttcaaagggagttgaagtgtcactgagtgagtacagcaaacctgtttaatgatttataggaagcaaataaaaagaattttgtttgctaacctagaagtatatcagattttggtttcaatttataattttgcaaaatataaagacatttcctggctaactccatccagatgaattattcagtattttttctcctatcttaatgaagttaatttgaatgctaatttcctataaccaagaaaacagttgaattaaataacccttatcttttaaacttaaagcttatactactaataatcatttaacattcacttccttttttctgacttaattggtaggtaaataaaatacttcaaatttgattggcaaattggaaaatcacttagaacaatctgctagtattttttattccctttgttttttcctttacacatttgtactgcaaaataaatcaaggacaaagactcacactgaattgatcaacttgtgtttggtcttcatgggaattacatcttttttcccctcaacatttattaaaggaacatacagaatttcagactatagcaaactaatacctttagcttgactaagagttgattttcgttaaggaacagaacttgtaatttatttcgacatactttaatgtatgactcatccctgttaaagttgtgagactcaaaactacgcccaaatcacttaattttatgtccttatttcgtgactgatgctgaaatggaagccaaccactgcagaaatttgggggaaaatgagatctgaagaatacaaggggaagtaggaattcatttctagcatttccaaacctgcttaatcgtgtctgctccaccacagtcagaggaaaagactgagttcatggaaattaccagctaagccttacatctgtctttaatgtttttaggaagtatactgaaaaggtaagtgagatgtctgttttgaagaaagactcttactgggtaccttaaaacccgttgtttcctattagtaaagatgggcagcttctttattcctagcttcaaaaagccttgcccctgtttggtgtgtttctcagtattgtggagaaggtagtttctgagcaaggtggtgcttttcctctgcttctcagcagctaagacagaaattgcaccgaagtgtacaaagggccaatttttgttgtcctgttgtgctcaaatccttttttttaaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttac

SEQ ID NO: 5510 - DNA, 2672 bp, Homo sapiens
aatcaacactccactcagacaatgcccagacctccagaaaccatgtgtcaagctcggattgccttagacaggtgcaatttaagaacagctttcatcctcttttctctcatattgtcacactatgtgttctgacttctggctcctttcctcacaagaagctcacccagctggaactcttatgggaccttggcaccagagaccacaaattcctctttgaagttttctaacagcaacaatggtatttctgacttggctttcttgtatttctctcacgttaacaaaattggttcagcatctaccatgggctacatgctgagctacagagtttcgctctgtcgcccaggctggagtgcagtggcgcgcgatctcggttcactgcaagctccacctcccgggttcacgccattctcctgcctcagcctcctgagtagctgggactacaggcgcccgccaccacacccaggaatccaacttgctgtttgctatcacatgtgctatacatgctgttgatgaaactgctaaaggggctgaatgtgactgacgtctttggaaggatgagacttagcgtgcctgtacagttgtgtccaaatgctgtcctcatctcccaatgaaaaggtattgtaaataaagagaaagatcagaggcttattttaaacactaaatatgagctaggagctgtcctagacactatgtaaaagttttatttagttctcactgtaatgttggccttatgttagcatcccatttttcagactgaggaaattatggctcagagaggttaagagacttattgaaggtcacacagctccacaaactttggtgtagattgaacgtgtacatgggtctatgtgactttgaatcttgcattctttacattattggaatatttcacagaaggaaaatgacatattaacatggcaataagatttctggttccagtctggttactggtcttccaagagtgttataggatgtatagcctgagctctgaagctttgttctgaagcatgctatcaatatgaacaaattggtatggaaggaagccacaaattatatactaaaatctagttcatcagaggaaaatatagttaaatacatttacattcccagaactgttaatattgaagaataaaacacacagtgggaaagagacgaagagaaaatacgcctgtttttatgacttgttgatatctacagggtttttccttaagcctcacaacaatttacagcattgccagcagcattcagtacattcagaacaggataatttcacccgcagctgaactagggccatgcctgggacagacagagaatggccttccagcagacatgccaagaagcaagccagggtcagtgagtgaagaggagggcaggcccatttgaagcaacacagtttatgtaagtgtgatctaactgctttcactggaaatgggtcagactccagttgagagaaccaggggcctgaatgaccccagcaaaatcactgtggcaattctttcaatcacctctgagaatatggccctgtgacgacataatgacgtttggattaattccagtcggctgtgttttcccctcctttcttgcctccccgtagttgatttgccaaattttttttgtttgcttaaatacgcggaactaaacaggatacattatatgacagtctgtgataaatttaccactgggaatagggaaaaagtatgggataaagaaataggtatttttcgcctctcacagctgtgattcagttctgactcaaaaggaagtgtgccacctactgaatcacagaaaccacttcctgtggctgtttggtttattctggaggagcatcaggccaagtgctgccctgccctgaccctgactggctcttcagagccaaggcattcacagcttgaggtggtttggcctcagactcttgagaacattgcatattaaattacaagtgtttcgtttcctagcaaggagtctttagcaacatgaaaacgaacgtgtgttatttgcaaaccaagtatatcattactgaacctgaatatccttactttttcataaggtacgtattccggatgaccactcttaagatctgaatgtacactggttctgtttttcctgaggggaacttgggcagtctgcagggtggcatttaccagctgagggacttcaagagcaccctttaatcagtgtggcagcactcaacttgtattcactcactcagagtatttttgagcatgtacttattgccatgtgctgtgctaggtaggggtagagggtacagtggtgaacaagaccccacagctcctgacctcatggctcatgtgttctacaccataagggaatcaagctgtgtctcccggggcaggggccttcctctgttcaccatgcagccccagcatctagcacctggcgttgcataaaggaggctctaaatcaagcttgtccaacccaaggcccacgggccacatgtggcccaggatggctttgaatgcagccaaacacaaatttgtaaactttcttaaaacattataagatttgtgtgtatgtgttttagtccatcagctattgttagtgttcatgtattttatgtgtggcccaagacaattcttctatgtggcccaaggaaaccaaagattgaacactcctgctctaaatacttgtttgttgaatagatacatgaaaag

SEQ ID NO: 5511 - DNA, 2672 bp, Homo sapiens; identical to SEQ ID NO: 5510

SEQ ID NO: 5512 - DNA, 1001 bp, Homo sapiens
aagcagaatttgatatgtctgccatacctagaaaacgtggtagaccaagaaaaatcaatccatctgaagatgtaggatctaaggctgttaaggaagagagaagccccaagaagaaagaggctcccagcattaaaaggagatctacaagaaataccccagctaaaagtgaaaatgttgatgttggaaaaccagctttaggaaaatccattttagtgccaaacgaggaactttcgatggtgatgagctctaagaaaaaacttacaaaaaagactgaaagtcaaagtcaaaaacgttcattgcactcagtatcagaagaacgcacagatgaaatgacacataaagaaacaaatgagcaggaagaaagattgctcgccacagcttccttcactaaatcatcccgcagcaccaggactcagtctagcaaggccatcttgttgccggacctttctgaaccaaacaatgagcctttattttctccagcggcagaagttccaagaaagcaaaagctaaaaaaatagaggttcctgcacagctgaaagaattagtttcggatttatcttctcagtttgtcatctcacctcctgctttaaggagcagacaaaaaaacacatccaataagaacaagcttgaagatgaactgaaagatgatgcacaatcagtagaaactgtgggaaagccaaaagcgaaaggaatcaggacgtcaaaaacaaaacaagcaaaaacacagaaaaagaaagtgcttggtcacctcctgccgtagaaattcggctgatttcccccttggctagcccagttgacggagtcaagagcaaaccaagaaaaactacagaagtgacaggaacaggtcttggaaggaacagaaagaaactgtcttcctatccaaagcaaattttacgcagaaaaatgctgtaatttcttgggaagtttttaatgtacacctatttgtaaagtcatcagaatagtgtggattattaaatatctagtttggaagaaaataattt

SEQ ID NO: 5513 - DNA, 1833 bp, Homo sapiens
cagcttaaaataaatttattgtgcaatacaaaatgtaggcatactggaaaataaaggtacattattaaatatacaaagcaaatgaaagctaaacaacacaaatgttttcatccaaacactaagataaaatgcacaacatttatgctaaaaacatgccaaaaaaagaaagaaaaaagaaaatcaaatatgctacattgtaaatgcttgaatatcaagaatcaataatggcataaaacaaacccaataatagtgggtactatcaagaactttgtttaaaaaggtgttaagaatactgaaagaatcaaaatatgtccttaaaactggcaaagttttttcttttttaagtttgagggcctattcgcagtatcttatctcttcttccgtttatacttttctataaaaatttctgctcattcttaacattttctaaacacagtagcttagataacagtacttcatttttaagtatgcatttaaagcattaccaacacaaaaatagtaagtgacacaaattaacaacctaattttgaaatctatacagctatgtatacgatatgaaaactaaatcttcatttaataaagtaaaaccaacttcggaatgaaatggtaaaatgtaacaatttagatcataggggaaaccacaatgccttttttccaattaaggcattcggttgcccaaactacaaatggccctggtgcaactaacataaatatgcaacacaaatatgcagtaaggccttgagaagcatccagttaggatatgcatctgaacattcaaagaacattcaagtaagcataaaatccttgggaaaatcctctacaacttaaaatataattatttaaatatataaatttaatacttaagttagcccaaaaggctttttggccagcacctctagaagggaatttcttttcttaatatcacagttcccaaacttaagacattatgatcaagattttctatctttatttgcactagtatctaaaatactcagtgaaatcttttttgctacactatatttacttttacagactttccattaccacatacatacaccatcatgctaagaaaccaccaagtttttcttctaatcccccactaaaattaacaggtttcaacaaacttgaaattataggggaactatggggaaaaccagagaagtatatggaagaaggaagaagtgtgaataggtcctacagaattttacaatcactttgccaagacaactataaatactatgaataattacttgaaatcaggttgtgtagaatctatagttctcttaaaaacaagttttgattctcaatattgcatttttataccaaataaaaggatttagatctaacgtattttagtagcatacttactacctgcagactaaattcatttctcaagtactctaaaaaacttcaaatagaacaaactttatgagatgctataacttatcacaaaagaaatattagcatttataaaattaagataataaaatgtaaaagctaaaaaccaaaatttgccattcatatttaaatataacatagaaaaagttatgtggataatatgaaaataaaattgtttaggtgaacaattcacttgaagacactcactgtttctccttctgagtaactaaccattatagctttttattgatgaaacatcattatctcacatctgaaattctttggctggaatgttttagtaacataagacactcctgtatataacaactctgacagaacagaggagttgcaaaataaaaaaagtaggagtcatattttaaagcatttgataaatttttaaataaattttttaaaatgtaaagccaatctatcacc

SEQ ID NO: 5514 - DNA, 3568 bp, Homo sapiens
ctttgagtatctttttaatgacttaaacaccagcacggagactcgccatgtaaacggcctcatttctgtgctctgtgctttgggagggacagggacaccatttcccacctcggctgagttaaaacctgtcttgtaaattaataaataatttcctaacacggcaaaaaaaaaaaaaaatccaaacgagacctagtttccatccagggacaggatatttctggacacccccggtcactgctcctcctaagggcctggccgtggctactgcagggaggatgcagtgagaatggcttccctgctgctgtttgctgctgtctacgctggccaagaacctgctcccgtctgcctgggctgatggagtctcgctcttgacaaaaatcttgctggggcaggtcctctggcagccccagcaccttaccctgagtcacgggaacctgagactttgtccaaacctcggctggaaggctggtcttggcactcgacgtcttagctagtggatttatcgcattaagactgtacttgggcctttttcatgatgacttgggtctcaatccttggagcagctgaaagaacagctcgggccacctgtggatgcacccacaatgaaatcagaggccactgcaaggcagagtggcctgcagttttaactcgggcactatggcaatgcagacccaaaccaattgtgccagttctttgctgggtggcaaagtgttttcaggctttgtggtcactcctgatttctgtttggaagcacagttctctctctaaggagaatggaaacttggaaaggcctgtaaaatcggaaagcctgtaaaaggccgtagagtggagatgtataaaaatgtacggtcacccatgttttaggggttgacaccgtggacttttatctcgctcaccaaattcctcacacatacagctcactccctgtgccctcggccatctcaggcaccacaaaatcctcactgcttgaaattcacttatggagtccaacaaacaactttcttaaaaaaaaaaaaaaaggcagtaaaatctcagaatttctgtgcaacgcttgcaacctgcccacttattaaataaacagaacaccaaaccaaccgaaagctatgcaagtggcaggctgccctgggcagagccctgcctgtctgccagggactacggtggcacgggagcagggcgcgatcatgctggaagaaatgagaggtggtctcattccctgaatctcaaactctcatctcaggagcccccagtcctaacactgtattcagcggctggagttatctggccaggtaaagggacgagggaaggcagacagtcctcaacttcttcctgtgtttctagcagggaaggaacgcaatggcttcagtccctccgcctctaggtaacaaggcaaaggcctccctaacccaggcagacaggatgtggggaaggtcttgtgtcttttcctaactcagaatgagtgagcgggctcccggagaaagactgtcctcttagcacatgaccccgcaggcttctagcaccaaaggctcgctaacacctccgaccctgtctgcaggtagaggggatgggaggcagaacccttctcctgattggtgcctgaaggaggcaagaacgagcatctgctatgccgcagccggatttcccccatctcagcaggagaggggagaggtgagggtgcaggcgttctgggcaggtcagtgcagttcgatgaacgcctccagatcttccgggatgaagcccttgtaagggatcttgttcttatccagggcccgggccgcaaggcactgcagggtcacgtagttgaagggctgcatggtacccctggccagcagcttctcgtccagcagctcgtaggccgtcttcttgaaggcattggtggcgtccatgtgggcccctgcttcgatcagggcattcatgatggccgggcagttgttctgggctgctatgtgtagcggggtgttgttgtcaaaatccctgctgtccgggtcggccccgcagtcgagcagcactttgaccacgtgcagggaggggaatctgcccacgggatagcggcccacgtttgtggtgtccttgtccacagccatgtgcagaggggtgaagccgttcttgcccctgggcgcgcacttgagcaggcggtagacggtctggtgcttcaggtgctcctggctgggggtgcactccactttctccagcaggtagagcaggtggaggatgatggccagcgccttggtgaactgggctgagtctccgggctccctgggcagctgcagggcccgttccacttcccggacccctttggtgagaacccccatgaggtctgcaaagccgatctgggtgcccaggctgcctttggcggcccggtcctgaagcacgtaggagaagagttccgcgaaggagaggaagctgctggcggtcatggggctcagaggctccaggttgctctgttgcatgtccagggcgtacttccacaagcggatgcagcgctcgaaattgcccgagtcggcgtacacggcacccctgtaacggatgtaataggaagtgtccgggtgcgagggaccgaggatgcgctcccggatcaacagggcctgcatgcgcatctcatccgggtcggtgatcagcgcctccagctcctcggtggtgttgacctccctggaatagtcataggccaggaccagctgtgggggctccggtttgggcaggtactcgcccccctggtgacgcagctccatggcccgcctccagtgtttaagggccccaagcagatctcgtttcttatccacatacgtagctcccagcaattccaaggcttccacggcagcttcccggctggtgggacagcagctttcgtaagattccccgttcagtggttcctctggggaggagctgcagcacggagccccctgaggctgcgcacacccctggctggtggaggggtcttcttggggcagcccaggctgagcctctccccctgcgacctgctcctggccgggctgctcctggatgaggtactccacgatgttggtgtggcccgtcacgctggccgcgagcagcggggtcatgccgtagccgtcacgttccatgcgggccttgcaccccagcagcagctgcaggatctccaggctgccggactcggcgcagtcatgcagggccgtgttgcccttggcgctgcgccggttcacctgggcgccctgctccagcaggtagcgggcgatctcacggtggcccttgtagcacgagatcatgaggcacgtgtggccgtgccggttggccacctccaggtcggcctggtgctcgccgaccaggtggccgtagcgggcggcgatgagtagcggcgttcccccgccggccacctcgcccgtcagctcgtccagttcctcccggctccggccgctgagcagcttctggagcagctgcagcttgccatcacgggcggcgttgtacacggcggtgcggaggtccatggttcgggcctccgccaggccatgggccggccgccgggggacggggagacggaggatcagagcccggacgggcgggaggcaaccttcaccgtccccctcgccgccatctt

SEQ ID NO: 5515 - DNA, 2734 bp, Homo sapiens
aggagcagcacagccttgcccaggcccagtccacagagccagcagcttgggttgagatgaatgatgtgttcacaaatgaggggatttcccttctggactaaactgaaggagaggcttgttgctttccagaggtgtgtggctcttaagttgacatcagcttttccccttgtgggtggttctttagctctcctgtcacaccattcgggtgtcctaatgtagggacaagagcaagcctgctgctcaggccccctggcgaggcttcacctcactgtggaagggggcgtcctgcagctggttagtcttaggcctggtggctgatcacttgtggggtcagtctccagcacccagcgctcccacaagccttgccaaggaaggcctgcttttcagccacaaacttcaggaaactcatccccccgctccccaaagtgttgttgctggccctgggcttgtgtggctcctgaggattgggaatttcaaataattgcaatacctgagttagaattccttctaatggcatcgttttaagctggaccataaagcagaggggaattacaagtgtgtcccatgcctgaccttcataattggtgtgggggacaggggagtcacagccactgatatttaggtgatgtctcttaggacttcagtgcctcagctgcctgaactgtaaatgttttctgaatttcacatatttttttttgcatgccttaggaagaagcacataggtaaaaccagcagtttccagtaatatagggggtttttgagcaaggcccctggagcagcggagagacaagatggagcacatgtagtctgtgtgcctggtcacacagaggcctgcatgcaagtagcaaagcagctctcaagggcttgtcagtaaaatatattagaaaaaaaaaaaaaacaatttgaagccaaatgaacaaaactccagataccattgataagaaattttgcatcaagaagggcttctgaaaagacccacgtgctccagtcccagctccaaaagccactgatgacaagggccccactgtggaacctaagtctgggagccccctgacttctggctggccagaggctgcggtccgtcaagggcttgcctcgcttcagaatcagtaacatagatcttaagtgcaattgattaataagcagtgagttactgtagcttcctttagctctaccgaactctttttaaaaactcaaacttgagcagccttagaaaaggggttggggggtgggaaccacaggccatttctctaagtgggctgctgtgaagttttaaatgaaagctctagctttaggagcttgagccatttcctgactgcactggcctggcagtctggctgctgcagaagagtttttaaagaggggtcggagcccgcccgtgagagcgggtcttctcaccatgtggggctgtactacgtggtggtctttgtttctcttcacagaaatgctctctcaccaacttgccccactgtcccaactcctctcctcttagagaaaaaactgtgattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaa

SEQ ID NO: 5516 - DNA, 421 bp, Homo sapiens
cctcatccacacctttggtcttgatggctgtttcaatgttcaaagcatcccgctcagcatcaaagttagtgtaggctttgacagacccatatgcacttgggggtgtagagtgatcaccctccaagctgagcttgcacaggatttcgtgaacagtagacattttgaaggaagctgggccgtgcgccgagagctgagagcgtccccaaatgctgaacacaggtgaagctcttgagtccgcacttgatgagcagcagatattttacagaaagatccacatcaccctctagtggtcaaaggggcgaattcatccgatgcccgctgagctctgcctcggcctgcctgggtggggagtggcccgccccgcagcgaggcagcagggaggcatcccaagtatcagagcggaattaagaaaaaagcagca

SEQ ID NO: 5517 - DNA, 1822 bp, Homo sapiens
gttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgagaacactctgaatgacccctggaggccgagggggcaggcttcgggcgtgaactgaactccagacccctctttgtgttgggcagtgtcatcttgcttacaaactgtaagacacatttttttgtgtgtttgtttttgttgttgttcttttgcagcactcacgcctctgacagtcttttgggaaagagtaacacccacatacagaatttgtcacatccagagtagcactgttccttaatactggcataatgcttccaggaagtttttcttttttatatttaaaatgttacttttctgtatgatgtgcatgcaagtttaccgtaacttttcttaaactttttagtgccgtttctagtatattcctgtaaatgtcagttactgaaaatgagtccaatgtaagtagtttagcttgtttattgcaatgctggcctcaacacaacagaataaaaatggtagaaagtactctttgatgtttctggtaatcatggaccc

SEQ ID NO: 5518 - DNA, 3939 bp, Homo sapiens
agaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaa

SEQ ID NO: 5519 - DNA, 4979 bp, Homo sapiens
agctcttgcatgaggcacctacaggcagaggattaattaggttttcagtttcagtttcccagaaaggaggtgtctctgtggtgacgagcagggcttcatccagtgcctctgtccccaccgaggggactatgggagacatggagggtgtgtgagcaacaggtgagactggagccagctgaaaactgggagaccgacccagccaacaaacaatgtcggtctctgtcttggcacctgcaggaaacaagctcctacttccagaaaaagtgctcctgggactccaggataccaggcatctgggtaagctacaatgcttaaccacttaacacaatcaggaagcaacagccatgcattcgggaaaggaacttcagtgttgtgtggctcagtctccagacctaactttccctttggtacagacgcggtggtacatgcctgtaatcccaacacttaggcaggaggatcactcgagcccagaagatcaagactagtgtgagcaacaaaatccttccctggcaccggttccaggaggacctcgttcttaggcagcatctgtgtctctgttttgtaagacacacagagtatccttaacccactgcagatatttccctgggtccatggtcaatcaacaccacctttcagtctccagcctcttaaccagcccagggctgagtgttgtttatagtattaatatgtttctggctgggctcagtggctcatgcctgtaatcccggcactatgggaggctgaggcaggcggatcacttgaggtcaggagttcaagaccagcctggccaacatagtaaaaccccgtctctactaaaaatacaaaaatgagccgggtgtggtggcgtgtgtctataatcccagctactcgggaggctgaggcaggagaattgcttgaacctgggaggtggaggctacagtgagctgagatcatgccactgcactccagcctgggcaagaaagtgagactccatctcaaaacaaagaaacaaacaaagtattaatatgttccccttgatcagtggggtggttcacccttgtaatcccagcactttgggaggcagaggctggcggatcgcttgagtccaggagttcgagaccagcctgggtgaactagcaaaaccctgcctgtactaaaaatacaaaaattaactgggcttggtggtgcgagcctgtaatcccagtggaggctgagacaggagaatccttttgtaatgcctgaccttgtttttttactaaccctattttaaccttgtttttactaaccctatttttaaattttccctttttgtctccttaattacctagccttgtttcccatatgagtagactctcccttagctgggaaagcctgacgaacgccatctggccccttgatttacaagacattaagggctacttacccaacccccttcctcaaagagttaacctgcgtaagcagatcctcagcatttcaaaggagcccaattagctgataaggtactggaacaaacaatgtacgaagttcccaggattttgctcaaaagcataacaacataaagccttgagtctgtgtctggcatagcatccatatctaactcttatgaaggatttagagcccggcacctggttccgttgctttttttgtaaccatttgtcttttaaattgtttatttctctgtaaccatttgttttttgattcttgcatgtttttacttctgtagaattattgcatttgagctccgctccccttccgaaccaaggtataaaagtaaatcaagccccttcctcggggccgagagaattttggaaagtcaagccttctcttggctgccggcttaaataaaggactcttaattcgtctcgaagtgtggcgttttctctaactcgcttgggtataacactttgagcctgcgaggcagagtttgcagtgagccgagatcacgccactgcactccagcctcggcaacaagagtgaaactccgtttcaaaaaacaaaaacaaaacaaaacaaaagaaccctcacaatcttcctgcacccaactgatgaaatcaccattgcaaaagttatatcagtgagaacattagaacagtaagctaagctaacccaaaccccaccttacttttcccttaattattcctgggctactgggtcgagctaactttggaagacatttaggctatggtttaaataacaggccttgccaaaaactcaaccacttatttttttgagacggagtcttgctctgtcgcccaggctggagtgcagtggtgtgatctgggctcactgcaatctctgcctctgggttcaagcaattctcctgcctcaacctcctgagtagctgggattacaggcgcatgccactgagtagctgggattacaggcgcatgccaccaagcctggctaatttttgtatttttagtagagacagggtttcaccatgttggtcagactggtctcgaactcctgaccttgtgatccacccacctcagcctcccaaagtgctgggattacaggcttgagccaccgtgcccagcctgctttttttttttttttttccttgagacagagtctcattctgtcacccaggctggagtgcagaggcaccatttctgctcactgaaacctccacttctggggctcaagcaattctcctctctcagcctcaggagtagctgggattacaggcgcctgccaccaagcctggctaattgttttgtatttttagtagagatggggtttcacccatgttggccaggctggtctccaactcctgacctcaagtgatccgtccaccttggcctcccaaagtgctggggtgacactgtgcctggtctcaaccaccctttttttttttttcctctgtcacccaagctggagtgcagtggcatgatcttggctcactgcaacttccgccttctgagttcaagcaattctcctgcctcagtgtccggagtagctgagacgacaggtgtgcaccaccaccccctgctaatgttttgtatttttagtagagatggggtttcaccatgttggccaggctggtttcgaactcctgacctccacccgccttggcctcccaaagtgctgggattacaggagtgagccatcactcctggcatagaaagtttttctcatccattgtcctcctcctcttctttcttcatcttcctcttccacttttttccaggcaactttagcaggaccctttgcaccgtcaaactttcctttcaacttacagtcagcaacctcttcctcatatttcttcttcagctttgccgccttagtgacgtcaacctgcttttcactgtcacttcagctattccacatctcacccagagctttttttttttttttttttttttttgccacatctccaatagagatgccagggtttgcggatttgatcttggggtggaattctgaacagaacatgaagaatccagacagttggttgggtgtgatggctcatgcttgtaatgccagcactttgggaagccaaggcaggtggatcacctgaggtcaggagtttgaggccagcttggccaacatggtgaaaccccatctctactaaaaatacaaaaattagccagacgtggtggtacgcgcctgtggtcccagctaatctggaggctgaggcaggagaatagcttgaacctgggaggcggggcttgcagtgagccgagattgcgccactgcactccagcctgggcaacagagcgagactccgtctcaaaaaaataaataaataaataaataaattttaaaaaataaaataaataaattaaataaaataaaaaataagagtccagacggtggccttttggggacattaggctctttcttcttgcttcccctttagctgctctataatccttcatttcccgatcctagtgtactttatccgcctttgccatttcatcaaatttggacttctctttcactgacactgtcttccaactctcagaatatttcttggaaaattctgcaaaattgacagggacctctgggtttttcttcttcttcttcctttttttttttttgagatggagtttcactctgtcgcccaggctggagtgcagtggcacgatctccgctcactgcaactttctcctcccaggttcaagcgattctcctgcctcaggctcccgagtagctgggactataggcgcctgccaccatgcccagataatttttgtatttttagtagagacggggtttcaccatgttggccaggatggtctcaatttattgacctcatgatccgcctgccttggcctcccaaagtgctgggattacaggcgtgagtcactgtgccaggccggtttttcttcttatgttcttctctgtacatctgcacaaaaaaactataagcagacattttgccctttggtttcttggggtcaccattagccatcctgactgtattgtttgctagtctgggcagcgcaggacacttgttcgctatttttctaaacttttcccccaatgggtgtaaaaaagcatattattattattattattattattattattattgagacgagtttcgctcttgttgcctaagctggagtgcaatggcgcgatctcagctcattgcaacctccacctcccgggttccagtgattctcctgcctcagcccccttagtagctgggattccagacgcgcaccaccacgcctggatagttttttgtacttttagtagaaacggggtttcaccatgttaggctggtctcaaactcctgacctcagatgatccgcccgcctcggcctcccaaagtgctgggattacaggtgtgaaccactgtgcccggcttaaaagcatattattatagtaaatactttttttccctttctttctttcattttaaacactggggtctccttatgttgtccaggctagattcaaactcctggactcaagcgatcctcccacctcagcctccctgttaccctgttgccatgacagccctgataaaataactgggaaagttctct

SEQ ID NO: 5520 - DNA, 464 bp, Homo sapiens
tgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagt

SEQ ID NO: 5521 - DNA, 4114 bp, Homo sapiens
gtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcata

SEQ ID NO: 5522 - DNA, 907 bp, Homo sapiens
gatcccagctgccatttctgacctgctcagaaccagcttcatgatgggctcaaagacccaggaccaggtgctcttgtgacttctctgacttcagtccttctggagtcagatcacccagcttctctgatgagtgactggtcatttttaaagcatgcctgcagcagtcttcaagaggtttctgcctgggcatcacaatcagcacacatttgctcatacacataccaggtgatgaggactcaaccactgcagacaggcagagccatgcaaataaagccatccagcaaggtcaccttttcctcagatgccccagtttcaggatgatagaatttgcatattaagtgttaataggcctggcaataaccagcttttgcttcccttcctcaatgagggacatgccagaaacagacttgcacacaggctctgctcatatgggaaacaggcctgacacacagggtctgctcatatgggaaaatgatttcagtcacagtccttagctccaaattctgtacttggaacctagattataatctagctcctaatcaaactagattctgctccagttcagtttactaaggcattccctctaagctgcctcagtgaaaccagtgagagccactggattacaattctaagtgcagctgtgcctaagaaggagagagtcccacaggagaggagaccggagggcataaggcaggggatgatacaaaatcctggacagtcatcacatcagtaacacagcttcagaaagtggtgggcttggaggaggggagagaaagaaacaaaatgtcccaataatttaatggcagagctagaagagagcatttacagctattttgggactctccaacagaacacttttcctggatgcacagacattcataatactggtaactctcatcaacagctc

SEQ ID NO: 5523 - DNA, 8719 bp, Homo sapiens
atctctgtttaattgaagagcctctaccattgcaagaagagctgtttaaaacaaaacaaaatggatactatttgaaaattcttagctggattaaatcaagatttctctattctgtgcaacccagaagtaaactggggttgatacacacacattttcatccataaccttggtttaaagtgcttcctatttgctggaatagttttcaatgcttttactgatttcttctgaaaaatatttgaactcataaaatgtattcataaaatacttttatctattttgtatagagggaatccaatgtaaaattttgtcccataaatttgaaaactgctggtgaagtacaaaaggcatggatgttggaatgaaggctggagccaaatcctggctcgcccccttactagtcacatagcaaatcctggctcacccctcactagtcacgtatcaaatcctggccgaccccttactagtcccatatgaaatcctggctgaccccttactagtcacatattgaatcctggctgaccccttactagtcacacatcgaatcctggctcacccctcactaggcacatatccttgggcctgtcacttaccctctttgagcctccaagtcccgtccactaaacggagcttaacttagcaggaatttcatccgatgagataatgtatccaggacacagtaaatacacagttaccttttccttcccaccccaccaacatgtacagatagcactgaattgcccaggccctctcatgacctaagataccacatgcaggccacacagcagctggactgtgcagccagggcccagggctaccccaactgacctccactcccctcagcaccctcctctggcctccgagctagccagctgctgatccaaagctctggatcctttagggctgtgcaaagatgtgacaggcatgggtatgaggctgtgggggactctgtgtgtaaactgatgtttctttgtatagcatttgatattcggtgtgggtatgaggttgtggggggctctgtgtgtaaactgatgtttctttatacagcatttgatattgggtgtaggtatgaggctgtgggggactctgtgtaaacagatgttttctttatatagcatttgatatgtattccatttgccttctaaagccctccagtggctgctccagttggtccactgcagtgcttgattttgtgaagaaccctgtggaatgtggtctctggcagctgagaagtgccttccttttccatcagcgcaaggcaaacacatgaagggagctggggtttcttgccaccatttcacctgagacccctgaaagctgcagcccacactgcaaatacttttcttggccctggaagtagagggaagtttgttgagaagctgttcttaatttctcacttgttgaaaaattacccaaaacaggaggcaagacaattgtgcaaattccatttgatgactgagcagaagctcccagaaccctcggatgaagtgagcagcattcccaggaggcgggacgttggacgctatttttattttaacatctcatattgccccaggttctctgagtcaacaccctcaaaggggacagacagaaacagaaaggaacttttgggctgattataaggattcagctggccttgggaaaagtctaaacatctttgaaacacaattggaaagtaatccaaacagcctgtgagctcaggcttcccagttagaactgcctgtcccaagttaatcttgcttagttttttggggggcatcatacctaaagaagaagaagaagaaaaaaggcaagaataagtaaaaggaaaaaaaagaaaaagaaaggcaggcaagaatttttgtccctgtcgggagaagagtctggtctgtggacaccagacacctaagcaagtttcttggaagggaggctttggcaaccctcgcaattcgcattcacaggagacatgccctattttccacaacaggcagcctcgccaccagccccaggagggaggaagctctcttctcagtgtctgcaggtttatccctaaatgctacggaagcagcagctgccaggggaaggggatactgctcagtcttttaaaactctcgtgtaagcttgatattacagtcatgacctaaaaaggcaaagaccagatatgcggagctcgctgcggatgtagcctgcacacggccgcaggatttgtcaccactcatccatgtttaaaaaagccagtccaggcaagacagccacaggctcccgcccacaagtgatcacgaacacacttcacactgccttatggcagagcaagtgcatatagcccggtcttgtgtgaccttcacagccaatattcattataatcccctctcaccaatattgaaaatggatgctcaggggatcagtgactcgcctggtgtcaaagtgccaggtccaaatcaagacctgcagatcaagtcttctgtggatgcttccaatcccaggctgctttcatttctgatggacacgtccttcatgtcccacagatccatggatcgccggcatcttccctcctgttcacataggtgagaaggaaggagctggcaggcaatgcccttccaggtgggctacagggaaggttcttttctcattaggttgatcccttggcttccctagtaaagtggggagctgttgaaaagaaagaatggaaacgaggtaatgatcctggagcctaatggaagggccgcagccagttttcccctgttgaaaggacacaggacttcccgaagagttttcatggcaaaaacgtccaaccagctactaaggaaacaggatggactcatgcgtgcaggagagaaatcactaaaggacacaagacttcccaaagagttttcatggcaaaacgtccatccagctactaaggaaacaggatggactcatgcgtgcaggagagaaatcacttggccgtcactggaagagcaggctgtgatgggaacggtaaggacagagaagggaaggttcacaggatagaaattcacagggcaagtagggttccaagtcagaagcaaaacactttacacaacattacagacaggctccactgcaactgggcaggtcaggactgggctcagtcggccacattctgctcccacgcgttgcttccttagactgtcagggaagggagaagggcagccaccaggagcggccagggtcacggacttgctacttctttcctagagtctgttctgttttctgtcagcagtaaggaaatacattctagcaaatgacatccagtaatgctttaattaactgcagtattttgtgctccaacatgcaggcagaaatcacttccagatggagaaaatgaaagctatttacacaaagaagcaatccctttattttaaggaaatttatatctcccaaaggtgtagaacttcgagggtccaagaggctattctgatgaatactaaaacaggactgggaatttttatttaatatataaaatgtcatcgtacccttcatgtaggccagcatttcaggtgtccatgtttctaaggcttttgcttaaattgcccattggagctctattttatttttaggaatctgacttggagtagacgagaagtgtgagacacttgctgtcaccctcaagcaggcaggttgttctgagtgctcttcctagcgaaggaatcccatttccagcaggttattccgagtgctcttcctagcgaaggaatcccatttccagcaggttattccgagtgctcttcctagggaaggaatctcatttccagcaggttattccgagtgctcttcctagggaaggaatcccatttccagcaggttattccgagtgctcttcctagcgaaggaatcccatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagggaaggaatctcatttccagcaggttattccgagtgctcttcctagcgaaggaatcccatttccagcaggttattccgagtgctcttcctagcgaaggaatcccatttccagcaggttattccgagtgctcttcctagcgaaggaaccccatttccagcaggttattccgagtgctcttcctagggaaggaaccccatttccagcaggttattccgagtgctcttcctagggaaggaaccccatttccagcaggttattccgagtgctcttcctaggtaaggaatcccatttccagcaggttattccgagtgctcttcctaggtaaggaatcccatttccagcaggttattctgagtgctcttcctagccaaggaatcccatttccagcaggttattctgagtgctcttcctagccaaggaatcccatttccagcaggttattctgagtgctcttcctagggaaggaaccccatttccagcaggttattccgagtgctcttcctagagaaggaaccccatttccagctgtgcacatgcagcatttcccctggcattctttcaacagggaaccaggtctcctcatccgatggcaattcaggaagggttggtgtcataccctgcatcgagcagcagcctcggacctgcccccacgctctgcgtgccctgtactggtcatgctggtctcagcttgtctgctctcagtcctgtctgatctgcacagaggagccaccctagacataagaaatcaggcaccccttctcgggggtgggcagagccctgggtactggctctttgttcttcgagagaggaaggagtggcggtagttagcttcaatccctgagctgggtttggagatcagaacaccttgtccattgcggctcctgtttcattgttaagagtccacacaggatgttctctggcctggacaccgctaagccagctttcagacaagtcccctcagtaagagcagagtgaactctttattgattatacaaattaccactatttattttaaacccaaagtgacttcaaagttgttttttggtttttaaaggggctacagaaaatggactgaggggaaggaatgggcacaatatctaggtctagctgaatcacagagctgttagctgctgctttcatccacaggtactccttttaccttattattttttagagagtcttgctccgtcacccaggcaggagtgcaatggcatgatctcggctcactgcagcctctgcctcctgggttcaagcgatcctcctgcttcagcctcctgagtagctgggattacaggcgcccaccaccacgcctggctaattttgtatttttagtaaagacagggtttcaccatgtcggccaggctggtctcgaactcctgacctcacatgatccacctgcctcggcctcccaaagtgctgggattaccagtgtgagccaccatgcccggcctattttttaatagagatggggtctcactctgttgcccaggcttgtcttgaagtcctgggctcaagcaatcttcccacctcagcctctcaaagcactggcattacaggtgtgatgccacagtacccggcctagggtgcccctttgatacgttatttttgaagtgatgttaataaataaagcttctgcttgggggttggtcatcaaaacaagaagaatcctcatcagtatggagagagcccaatcctgggcatggtccccaccaccaccaaaagtcttttttttttaactgagtctcactctgtctcccaggctggagtgcagtggcgggacctcggctcactgcaacctccgcctcccggattcaactgattcccctgcctcagcctcccaagtagctgggattacaggcacccgccacctgcctgctttttttttttttttttttgtatttttagtagagatgggattttgccatgttggccaggctggtctcaaactcgtgacctcatgtgatccgcccacctcggcctcccaaagtgctgggattacaggcgtgagccaccgcgcctgacccaacacaagtttaaaatgaaagctgttatcagtagagaatcttcaccacgttggcaccagctcaagtgtagtgtcggcgcacttttagcttagagtcagaaaaatagacatgtatgaaaatgcgtggcaggagcccttccataaagcaaatctctctgttgcagtggttcttaacaaggtgtaaacgttataactacctatggaacttttaaacctgtatgccaggccccatccaaacttactgactcaaaatctccgggcatctgtttttttgtttgttttgagatagagtctcactctgtcgccaggctggagtgcagtggcgtgatctcggctcactgcaatctttgcctcccgggttcaagcgattctcctgcctcagcctcccaagtagctgggaggtgtgcacgccaccacaccccggtaatttttgtattttttgtagagatggggtttcaccatattggcaaggatggtctcaatttcctgcgcttgtgatccgcccgcctcagcctccccaagtgctgggattccaggcgtgagccacggcgcccggccggcatctgtagattttaaaaggccccagtggttctgatgcacacccccagaagagaaacacagcgtctctacacagtactgagtccccatcaaggagacatttaacagaaactcctactgacatccattggttccttggggattactgacaatgtaacaaatcaagacagcaacttccctggctgtgaccaccaactgtggaaaacagcagcttgatagctcaatgctgtgatggagccgtccggaaaacgactcctcaacaatgaaccaaaaagagaagtggtgatctgtacacaaacgccaggagtgacaagaaccaggtgcaggagtccactggctttcccagctctcctgggttgaggacagacggctgaactggctgtgctatttggagatgggccccaccgccccttttcaactgtacggctcaggctgcttaaccatagcaactccatgggctggggtgggggcatctacagggcttcctgggggctctcccgactgccgccccccgcccttgtcttatttggaatcttttcctaatagacctcaactgaaggccgcatctccttctcgcaacacttcttttctcctccgcattctcaaatttgagacgcttgatgcgtgagagtcaaaccagctagcaaggacagcctggaagccgatgaagaaatgacactcaggatcagagctggacggcatcggggagaaagcctggcagagagggcaggggcacagagcagtggttatgttgggaaacaaggtggggatgaggaaatcaggtttccaggcagatttccaaaccttattcctactgtacggctgttacaagttttatggattttaaggaaatttcctctatcctgaaaactttttgagaaggggtcttgctctgtcacccaggctggagtgcagtggtgaaatcttggctcactgcagcctccacctcccgggtttaagtgattctcctgcctcagcctccccagtagctgggattacaggcactcgccatgacacccggctaattttttttatttttagttgagacagggtttcgccatgttgggcaggctggtctcgaattcctgacctcaggtgatccacctgcctcagcctcccaaagtgctgtgattacaggcatgagccaccacacccagccaattttttgtatttttggttttgccaggttgcccagactggtctcaaactcctgagctcaagcaatctgcccacctcagcctccctagcagttgggactacaggtgcatgccaccacaccttgcaaatttttatttttgtagacatctgtatgttgcccaggctggtctcaaactcctggactcaagtgatcctcctgccttggtctcccaaagtgttgcgactacaggcatgagccgccgtgcctggcaagatatcattcttcagcaaaagcaggcagcaacagcagcggtttgcctgtagctgtggtcatggttaactgaggcctggtttcaagggaaccgagtgaatcagggttaacggcttgatatgctgccattctctggatgcaggatgacatgagaggtcgggagcagtctcttcggcaagccctgctgcagagagcccgcggtggacaggaagggcggggggggcgggcaggctgcgtgccaggccaggctctcagcctggtctttaaggtccatattctgttcctgaggcatccagaaccccagactccttctcataacacaggaacacatcactgggatgctgcacatcacctttgctatttcagatgacgctggaaagtgctgtggacctgaaggtgagtgggcagaaaggggtttgagagtatggacttcctgggcgttcccatggcttcatctgatgagaaaacctaggaaacgtcttccaagtgaacttcctggtttcccttccctagaaaccaggagcagggtgggagtaaagaaatggaggaaggggctgggctcggtggctcacgcctgtaatccgatactcaggaggctgaggcaggagaattgcttgaacctgggaggcgga

SEQ ID NO: 5524 - DNA, 911 bp, Homo sapiens
agtggagggacaaatgcaacttggctagtcacatcgcatgctttagcatgtttcaatttaaccctgaaatggctgtaagggagggaaacctaccaggattaacacaggagaagttaatcctcagactctcctcaagctctggctggcatttgaaccccgctgctttcacagcagctcttttccctgagtcaggtgcctaaagccaaccccttgggggctctgtccttcagggaccagagcggcagccccctcctcccccgacttctgcccgccgtctcaccttctctccacggagctctcctttgtggccttgggtcccgagggagaggaagatcctgaacctctgtccttgcctctccgaggtcccctggtctggcagggggctgtgagtgtctgggctggagaaagacggataggaagagtagggtggcctttgaacaggaattgattgcaaaactggtttcggttaagtgctgcaggagagaaaaagcaaagctctagggctcttccaggaaatcatgggctccagctgtcactttcagtttcctttttgccagtttctctaattggatgaacaaggaggtgaaagagcagaatccaagtcaggaggcctgagtctctcgtctctgtcctggctgtgttataggatggacctatatggggtatgaaaatagctcctgtggcttagagctatggtgaggagcccatgagcaagcgatggggcgcctgttgaatagtggattcacagtagctgtcatcactgattgttctgaaactgctttcctccacagcatcttacgtgacgctgatgtgggtaacaaccctatgaggtgcacagcattaaagggctaataactctgaatgcagaatcctctgaaaatggaaactttattttattattattattatta

SEQ ID NO: 5525 - DNA, 1450 bp, Homo sapiens
ggagtctccgaggtggcgttgggtgggggcgctactagctcccgttctctcagcgtctctagagggaagggcgccggtgggagcaggagagtctgcaccgggcaggcctccttaggtgccgggttgcgcgcagggccctgtgcttgtctcgcctccggttggctcaggcctcggagcatgagtgcgccggcaactgctgggcccgggacagtgaagcagaggaggaggtgggggaggcgagcccaggtcggggaagggcagcacctgaatcacccttggggcccagacccccaagagtctccggggagccgaggcctggcgaggcagtcccgggattcgccccctccccgctggcccgagggcgcaccacgtgctgggcagagacttcggcgaggccgagtggaccctgcagcgctgcttgggaaagggcaccttggactacctggtgggggcgttgtgcttcgttaccgaccgccgggacgccaacccacggtgcccacccgtgcgtcattccgctgtggatcagccctttggcggcccccctccaaagtctacaaggtcacacggatgtctgcaggcagagctgcttccggctccctgagacccagccatggaaggcatagaaaggcatgtgacaagaaactcatggcttttaatcctggcaggacaaggaaaaccccgtcaaagatttgcataaattttgctgctctcctgctggggggggggggggggcagttcgtcacatttaataaaattctctccctcccttctcccgactgcattatctcatatttatttatttgagacagtctggctctgtcgcccaggctggagtgcagtggcgcgatcttggcttagtggcgcgatgacggctcactgcaacctccacctcctgggttcaagcagttctgcctcagcctcccaagtagctgggattacaggccagctgggattacgccgccacacctggctaattgtatttttagtagagacagggtttcaccatgttggccaggctggtctcaaactcctgacctccagtgatccacctgcctcagcctcccaaagtgctgggattacaggcatgagccgtcatgcccggctttctttttgttcttcaagaaagggaaggaaaataacattgtctttgagccagttgcgtgtcgaggaaataagggtacccccccaccacaccccaaccccctcagtgccctggggtttgaagcaaatgctcagagggcctggtaggcggatgggcgtctccggatgatgcagaaagcaataagcaccagggcgaggaggccaagaaggatcaggccgatgatgagaggcagcaagatggaccggtcactggggcaggagaaacctggcggaaggatagggcaggtaggtatttgcagtgacgtgctggttgggataaaggtgggaggagggaatggggggatgctgg

SEQ ID NO: 5526 - DNA, 1907 bp, Homo sapiens
gtcaatctcttaaggtgcctaattcataaacttaatcacaggtatgtatgcataggaaaaaacagtatgtataaggtttgttattatctgtggttttagacatccactgggggtctggttttagatatccactgtatcccctgtggataagggggtaactgctgtatcttttagtagaagcaagagcagccccatgtgggggctaacactggacactggtcagtttcagctcctcatgcaaagtgagggtatccttgtggctccagccctggggccccctgcggtcacctttgggcatcccctgatgcaggttggtcaggacctgcccagcttgcaccagcaggttctgcgtctccatctgacctggcagaccttgcactcttccacccactgtggaggactaagtgtcttgaacttccagaacacagccagggccccatacttggcctggggagaagttgggaggcctaagcagtggttgggggccacagcaaggcattgcacacagtggtttttatttctttcagggatttattaaggcattgagcacagtgtaatttctagccaagtgaaatgaatccaaggaaatatatcaggacctgagggatgtttttttaaagttactggaaaggatgatgagctgagagcacgtgtacagccacgcctgtgcgcagcgcccactctgtgcaataaacatgttctgcccatgttcctcagtcaggaggttcaggctcccggagagcacctgagggttccatcactttggtgcccaacaagcacatgccccccaacctggtgccaagaggcaggaatgacccccataccacatagctgcaggaaagcatccacggatggagggactcagctggcctggccgcagtgtggagcacagaggtatgaggcaagcaagggcagatctgagagcctgtaatgctaggcaggtgcagctggtgcgaggcgggctcccaccaggtgtaaggaaggtgggagccacagcctcttcctgggcccagaagcagccggcgccaggagatgcaggcccagggaatctgtctaaggcagctgggtctgcaccagccttctttccactcacaactcactgctcctgggagagcaggaggggcacacctttaaagagaaactgataagggaggaaaggcaggaggagatgaggccagccccactgatgacaccttgggccaggcctcacagctgcaggcatcagccggaaactccaggctgctcatggtcactggcggtgctgaactgtctctccactttcttttggtccttgatcttgagtccaatgtccactctcttctcaaagaagttcaccagcacggactccgtcaggatggaggccaggatctgctcaaaggagatgcaccagtcggtgtcgacggtgccgccgatgcgcgctgtggggctgcaggcctccccgcccaccagcaccgtgtcgtctgcaaggtcttcacattgcagggagcccgtgctgaccaccgagtaggaggacatggacatgtcgtctttggtttcatcgtcagacagcagctgggagggtgagccctgtccctcgccgctgcccccctccaccaccacctggctctcctgtggggcttttccgaggtgtgtgtctccgcctgctttggcttgggggtctcctgcagctgggggctgaagctccctggctgcgtcctgatgcagttcgggtgctggtggctcgtcctcctcagtggcacagtccctgggcttcctgcctgtgcgggctgagaacttcttccccacctctccgatgcggagcaggaggctggccacggtggcgatggcgtggtacaggtcctgctccatggggtcttcactgaacatgttgtaaagcgtcttgcacagctcaatgaactgctcctttt

SEQ ID NO: 5527 - DNA, 2161 bp, Homo sapiens
agtctgtgagtagggcctgatggaagccggaattcagggatagggacttggctctaagcccttgagagccccccacccccaccttctgggtttctggtggtttctttttaaaatcaggatttaggcagctccacgtgcggagtaggggcggggcagccacaccttctcacccacacagtggtggtacttcagcagggggctggtgcagatgaagacctgcgtgctgcggagaaggacgcggttaccgccgggagccaggagcccgcccaggactccgcccgcccccctctctccttactccggtaggtcgttcatctcccgcacagcgtccaaggctcccgggatgggctccaggtccaggaaaaagcccggggcttcgtacacactggccactttatcctgaaagacaagagttctgggtcccggcttcccgttcccgcgaggacccgcagggaggctcctgggggctccgggcccgagctcagaggggcggagggggcgtcggtcaggggcacgcgcccaaaggctcctccccagggtgcgctgcccgcgggttccagggtgagagctctgcgcccttcacagagaagggggagacccccggaacggagcgagcgggccctgcccgggtggggaccctgcgccccctaccgccaggtcgggccgcagggcgcggtactgctcgcgggccaggaagccgcggcgttgctccagcggcacgtgcggctcctcagggaagcggcggcggaagccccgcaggaggccggcctcgaagtcggccaggacgccgtccatgtccaccagcacgcgcacgctccgcgccatcgccgccgggccggagctgcgagctctcggggtctggggggcgcgggctcggccggaagcggagggagcgctgcttccggagtccgccgggctgatttgcatagagtgtccgggccgccccgcccaggtcgtaaaccagtgccgacggccctgcggttgcgcgaggccatcctagggttcgggtgcagggacggctttggggggcacttttctgaccctgcgcttcttcgggacccagcctttgtccccatcagccgcctcccactttacggcagacgtacccccgttcaccccacgttactagtaggggaccgaccttccgggggcccaacaaagggatgctctgaaatactgggaagcatctaacgaggagtcaagggtcctaaacccgtggggctagctccacattttttttctttttttctttttttttttttttattttgagacggagtctggctctgtcgcccaggctgcggcgcagtggcggcgcgatctcggctcactgcagcctccgcttcccgggttcaaccgattctcttgcttcagcctcccgagtagctgggattacaggcacccgccaccacgcctggctaatttttgtagttttagtagagacggggtttcgccatgttggtcaggctggtttcaaactcctgacctcaagtgatctgcctgccttggcctcccaaagtgttgggattataggcttgagccaccgcacctggccaaagtcttattaccgcagtaccgtggtctcagtggattgctttcgtctgtgcagtggagcaggaacaatccctcgaggactacaaagtgaaatgaatctgttaactggtttgtgtaagtctagctcgttaagagactaattcacactagagttggcttgaaacatgggagcttcaagtgtggtttcccccggaaagatgattttgatcaagcacaggtaatcaggactgtcctcaggactttatgtggaactgacatcgcttacctactcccgtctagaaaatgctgaacagggccaggtgcggtggctcacgcctataatcccagcactttgggaggccgtggcgggcggatcatctgaggtcgggagttcaagaccagcctgaccaacatggagaaatcctgtcgctactaaaaatacaaaattagcgtggtggcacatgcttgtaatcccagctacccgggaggctgaggcaggagaatctcttgaatccaggaggcagaggttgcggtgagccgagatcatgccattgccctccagcctgggcagcaagaacaaaactccttctcaaaaaaaaaaaaaaaaaaaaagaacatgctgaactgtg

SEQ ID NO: 5528 - DNA, 5431 bp, Homo sapiens
aaaaacttcatttaatacaaatagttgcttaaacaagtatgaaaggctgaaagtcaaaatctgcctgagaaacttaacaaatctgcaagctggaaaccgcgtcttttccccactctctgccagacagaatcacccagtccactttcaggggcccagcagggaagctgatttaagagaagtcaacagcttttctgactacactgtggattccatcagtgcacaggcacctgcagggctgcagtaagcatctctgatgaggtggtcccgggcactcactcgcagtctccctcctggtttccttgtgggaaggggcttcatgatttcaagctcagttcccctcccactcccagaggtggagcgcatggtcatagaaggagcaggtggccaggaggctgaaggctgagtctgcttcttctgggttcacgccacagtcacgtgtggtggctgctgtagcctgcagccaggtgccattcttcctcatgccctctgtgagtggcttcattccactctggggtctggcatggccctccccatcgttatcctctctgcattcatgacagggtgttggcaactcgcttgcacccttcaggtctgccgtcttggttcctaggttgctaggaaaggaccacgagggggcccgctgcagagaacggaagagcagccaggaccagtcggctccatacaccagcgagtcgggcaatgtgtgagatgtcaggaccgtcgcctcctgcctctcctctggagtgagagatgggagaacccaggaaacacaacatcacccagagcctctccccaacctgtcacacctgacagggagactccaagaacagcccctcacaggtcagcaagtgtttcctgaggagccgttgtgtcatgcaaaggaaccagcaagacctgggcatatgttggagaagaaacagaccgtcatcttgcagtgcacacgcctgtgtgcctccaagagaagcatcaagcggggctacagaacctcacttgatggtgaagaatacggcaaaagccagagagggggaaagacctcagttaacacttaaaaccaaagaacaaaggagttttagccagctgggaaggaaggggatgtctgaggaacaggcagcatgtgtacagcagaggtgagaaagtccaaggctcgcacggggaaccacaaacaggcagccatggcactgtcagtgagtgacagtgggctggagcgtcccaagcatgcagggtccggcacgccctgtttcagagtctggattctggcttggaaaggagccactgacaaggttaagtgagcagtttctttatagaagttgctacggcaactggaaagaggccacaactgcctcccagagcacacagcaacagagggaatgacgaggcgtggccaaacccgaggcgatctggagtccaggaggcaaggccagggctggcaggggcagttgcagagagcaagtggaaggtgagccaggggctgcaaggctgggtggccacttgggctctgaaagggctgccatcgctacctctgaagtacagggattgatgccagcagtgaccggaatcagaaccagaatgagtgctgatggaagaagggctgagggcagaacaggaccgcactggattacaaaacgtgccgaggttgtatgggcctgggccggggaggcccaaccctgggcccagggcttcaactgggcagaggtggctccgaggaggagtgagatgctgaatgttcagagacagccacaggggccctcgagcagcatgtgtggggcgaccctcgggaggaagcccctggggaggccgttactgtcccttgggaggtagcgtcacagggcaggcaggacctccgctagtctttcatccagcaatcgctcaacacgtccactcgggccagcaggacctcttctacagcttaggaaaaggtaataaggcagagtctaagccctcagagagccacagcctgggaaaaagacagcgaatgagtggacggaagacactgttgcgaccccaagaatgggaggccctttctgattagccacaggccaacgtttcctccctctttttattttcaagacaggacctcactctgtcgcataggctggagtgcactgacctgggctctgtcttcctgcctcacctcctgagtagctgcgaccatcatgccccctagttttttctattttttgtggccacggagtctcactatgttgtccaggctagtcttgaactcccggctcaagcaatccgcccacccttcccagagtgctgtgactgcgagtgtcagccaccgcacccagacaatacaaattgttttaaaattaggccgggcgcggtggctcacacctgtaatcccagcactttgggaagccaaggcgggtggatcacaaggtcaagagatcgagaccatcctggtcaacatggtgaaaccccgtgtctattaaaaatacaaaaactagctgggtgtggtggcatgcacctgtagtaccagctactcgggaggctgaggcagcataattgcttgaacgtgggaggtggaggttgcatgagccaagatcgtgccactgcactccagcctgggtgaaagagcaagactctgtctcaaaaaaaaaaaattgtttaaattaaagatacaggctgggtgcagtggctcacgcctgtaattccagcactttgggaggccgaggcaggtggatcacatgagggcaggagtttgagagcagcctgggaaacatggtgaaaccccatctctactaaaagcacaaaaattagccaggcatgatggcgcatgcctgtagtcccagctacacaggagcctgaggcaggagaatcccctgaacctgtgaggtggaggttgcagtaagctgagatcaccccactgcactccagcctgggcgacagagcaagactctgtctcaaaaaaatacataaataaagttatgaaaaaggccagccgagcacagcggctcacgcctgtaatcctaacactttgggaggccgaggcgggttgatcacctgaggtcaggagttcaagaccagcctgaccaacatggtaaaacctcgtctctactaaaaaatacaaaaattagccaggcgtggtggcacacacctgtaatcccagctactccggaggctgcagcaggagagttgcttgaacccggaaggtgggagttgcagtgagctgagattgtgccattgtattccagcctgggagacagagcaagactccgtctcaaaaaagaaagaaaaagaaaaaaaggcctatacagagtacctgacaaaactggcctggaatgttgaactctcagacctgtcttagttcacctcttcaactttaagaactgaaggctggatgcagtggctcaagcctgtaatcccgacactgaggactgagttgaggcaggaggactgcttgtgtccaggtggtccgggctgcagtgagctctgactccaccactgcgctcccacctgggtgacaggacacaagaccctctctttaaaaaaaaaactaaaaactcaccatagccaaaaggtgaaaacaacccaaatgtccatcagaggatgaacagacagaatgtggtccatcattaccttcttaaaaagagaattctgacacatgctccaacaggggtgaaccttgaaaacgttaagctatgtaaagaagccggatataaaaagacacacgattctacttccatgaaatatctagaaaaggcaaatccccatagacagagtaaacggaggttatagaggctgggggagggatgtttggggtgatagaaaagttttgaaaataagtagcagtgatgattgcacagtattttgaatgtcttcttttattttttattttttttgagacggagtgtcactgtcgccaggctggagcgcagtggcgtgatctcggctcactgcaacctccgcctcccaggttcaaccgattctcctgactcagcctcccaagtagctgggactacaggcgcccgacctcaggtgatccgcccgcctcagcctcccaaagtgctgggattacaggcgtgagacactgcgcccggccttgaatgtctttaataccactaaattgtgggcggcaagccacccaggcaccgaggcaagagaccgaggacatgagctgttccagtaaaataaaatataaaacaagaatagttataccagatatagatcttagataatgattatatatgaatatcattaatcattagttggtagtaattactctttatcccaatattataataatcctcgctctacaatcataacctaggaaaaaccaggccatacagagataggagctgaggggacatagtgaggtgtgaccagaagacaagagtgcgagccttctgttatgcctggacagggccaccagagggctccttggtctagcggtgacgccagcatctgggaagacgcccgttgccaggcggaccatggtctagcggtagcgaaaaatgtgaaggaaaaacacccgctacttagcagacctggaaagggagtctccctttccccgggggagtttagagaaaactctgctcctccacctcttgtggagggcctgacatcagtcagacctgcccgcagttatccggaggcctaaccgtctccccgtgatgctgtgcttcagtggtcacgctccttgtccgccttcatgttccatcctgtacacctggctctgccttctagatagcagtagtcaattagtgaaagtactaaaagtctctggtatgcagaaataatagcgtaagctgtctttctctctctctcctctccctctctgcctcggctgccaagcagggaagggccccctgtccagtggacacgtgacccacgtgaccttacctatcattggagatgactcacactctttaccctgccccttttgctttgtatccaataaataacagtgcagccaaacattcggggccagctgtcttttcttttatctctgtcttgtgtctttatttctacactctctcgtcgccgcacacagggagaagcccactgaccctgtggggctggtccctgcactaaattgcacacttaaagtggctaaaatcatgcattttatgttacataaattttatcacaatttttacaaaagcagttaaaaggcaggagacccagtgtgtgcccaacagacaatgctggagtgtgtttaagaaactcaagcaaaggaaatgcaagtcaagggattaatgggcaagttctccttcaattatcaaggctacagagaaaagtatcaagtattcagaagtctaggaaacaccaccgagggcctctcctaagcgtctctcaggaggcaagctctatccaaacaggcggtggctgggaacagctgtcaccaggatggatgggagcacaacaaatagtcaattgcgagctgagacttaggaaaaaacaggtggggcaaggacagaaaaataat

SEQ ID NO: 5529 - DNA, 468 bp, Homo sapiens
ggctttccgcagtgaactcgggggcactatcctcggtacccagatgcccacctgtgtgccactcccctcccaaaccagcccctgagcccgagctctgttacctgcagcgaactcctcgatggtcatgagcgggaagcgaatgaggcccagggccttgcccagaaccttccgcctgttctctggcgtcacctgcagctgctgccgctgacactcggcctcggaccagcggacaacggcattgaacagccgcacctcacggatgcccagtgtgtcgcgctccaggacagccaccagcgtgtctgtggggtggaggaaggggctgcgtgaacacgacacccacatgcccaccctgcaggaggcagtgagactaacgtgaggaccagcagttaaagccgggctggcaactatggcccgtggcccaaatctggccctgtgagtgtgtttataaataaagctttatcaacacaa

SEQ ID NO: 5530 - DNA, 2128 bp, Homo sapiens
ttagatctccttgtatatagtaagagatgtattaatattaaccactcatattcatagtcggatacaatggaaagcgtgttatacccatgcccttgcaaatgtacaaacctgcacctatactcatgcatgaatatttatatcctgtgagcagaagaggacaggctgcctgagtgccagggaggtccaggtctagcctagctgggggagacttcccactctgccttcccagccccaggacccttaggagaactttcttgctgccctgtggtccccagggcaccagaaccctggatagccggctctgtggttttcctagagtgttaattgttgcccaggagcagggaatggggaatcgggagctccctccttcccaggagaaagggctgcagtggctggcctgggagccagggagagtcttcacgtcccagcagttctggtgcagaggcagctcagttggattattcgtcccggttcctaatgaaagtgaaagctgctggtacctgccagccctctcttggcacacagcgagctgaaaatgcagagactggagaacgttgccaccagagtcagcttgtcctggtgcagctcagatttggagctgagggttatcgatgcattggtctatcttattccaggatttcctaggcttcagttatctcccaactaggaaccacagctgctccttcctaacctggtccctccttgccaatctgtggcctgtgctatcagcagaacccctgtgccggacatagagctgcccaggtcagaaacccaaaccttccacagggacacagtcagatttgagttatgggagatcccacagccaggggtcagggcggatgcaggaaaccaggccaggaagctgtggctgtcatctaagcaagagacagacaatggtgacacagggaggcaagtatacccccaggcctggccacctctccagctctgctcctgacatgaggctcacccagaaggtccttggccatagggtacattggtgccagctgcgtcttcagacaggagaaaaccccagtatgtgtctcaagacagtgagatgtcaagagtcctgctctcttagccctgaattatacaaactggagatttcagccaagaaacaggcagggtctgccccacttacagctcatgtgtctgttttgccgaactaagaaagtgagggcttctctcaatttggatattcatatttctggtttatctgctagctttcctcccagaacttctgaaagcatactcggcttttgggaaacctaagatcacaataaaagtggcagacctctttatccctgtctcacaaataaatggaggcacagaatggggaagtggaggccgagggaacaaagccaactaagactgccagcccggttccctggccacagcactgagggtttgaggggtgcctccagtgagggctccccatccccgaccttggaacaccagctcatagtttctgccaggcctatttcatacgcactcttccaactttttcctgaattaaaaacaaacaaacaaacaaaaacctctgttatgaagtaatttcacacttacagaaaagttgcaagagcacaaacaatgcccgcccaaactcaccagttgcaccagttagcactttgctcatgtacacgtgcatgctcttccctctgtttgtatatgcatgcctgtgtatatgcacacatgtgtatatgtgtaattttcataagcatttgaaaatgggttcattatgcacctttactcctaaataattcagtatttatttccttagaacaaggacaaatttgcataaccacagtagggttgtcaaaatcagcaaatctaatattgatacactatacaatcctatgaccaatctcatctacaactttattcaaattttatagaggctgaggtggaaggatcacttgagtttgaaaccagcctgggcaacatagtgagaccccgtctctacaaaaagtaggaaaaaaaaaatagcgaggtgttgtggtacacgcccatagtcccagttactcggaaggctcaggcaggaggattgcttgagtccgggagttcaaggctgcagtgagttattattccaccactgcactccagcctgggtgactgagcgagaccctgtctc

SEQ ID NO: 5531 - DNA, 29147 bp, Homo sapiens
gttgacagactggagcgcagcggagacctcggcatctgcggtgctcgggattgtgtcccctacggtctcttaccgtgcctcccgatggcgggagctggaatttggtccccagaccccttgggaagacgcgcacaccctggcaaaccatgtgtacacccgcggtagaagcaggtgcgtgttttacagtagcttagctgcggagtccacccagcccctggcatccgcagctcggctcgctcaggctctagaccgaagctgcaggcgaaggaacgtgcttgggtcttgctctgtggcccagcagtgcgatcctagctcactgcagactcgacctcccgggctgaagcgatcttctcacctcagcctcccgagtagctgggaccacaggcgcacacccaatgcttggctaatttttaaattttaaaacagagacagggtcttgctatgttgcccaggctggtctggaactcctggcctcaagcaattctcctgcctcggcctcccaaagtgctgtgattacaggcatgcgccacggttcccagccatttctactttttctttgagaaggagttttactcttgttgcccaggctggagtgcaatggcgctatctcggcttgcccaggctggagtgcaatggcgctatctaggctcaccgcaaccttcgcctcccaggttcaagcgattctcctgcctcagcctcccaagtagctgggattacaggcatgagccaccatgcccgtctaattttgtatttttagtagagacggggtttctccatattaagtcaggctggtctcgaactcccgacctcaggtgatcctcccgcctcagcctcccaaagtgctgggattacaggcgtgagccacggcgcccggccctgccatttctacttatttacgttgttccaaattatcaaagatagcatcaactttcaaatcctaattttttttttcctgggaaaccttcctcctttagccttcagtctcctctctaaactgggttgggcctcagttcttctcataccgggtctccccttcctgctgtcctgggttgtatcttccgcttcctagatttaaggtctttatttttcagccaagatgggtcatcctcatggctggtggcattggactgtaaatactagttgccttcatccccacatttggaatatacctgcaatcatacaggatgcagaatactgtttgctaagcgtggggctggttgctggagataacaagcaaggcctaccaggtccctgctgtcattctggctctggatctacttgcttggctcccctgccagccctagtatatcgagccttcctttttattcaatagtgttttttattgctgacttttcagtcaagatttctttgtgttttctggcctacccttgctgtttttcacctgaaatgctttttggcttttagtgtgactcctgctgatctcatatgcatatgttattaattgattaattattaattgttaataattaaatattattaatatgcttacattattaccttgagttctggaactgcctcactgcactccatgtggtgaatactgtagaaattatataaggaaaaatatatccttagaaatgagtattttttaaattttgaaaatatttaatttaggcccagcccagttgctcacacctgtaatctcagcactttgggaggctgaggtgggcagattgctttaggccagaagttagaaaccagcatgggcaacatgctgaaactccatctctactaaaaatacaaaaattggccaggtctggtggtgcacacctgtagtcccagctactcaggaggctgaggcacaagaattccttgaacccaggaagcagaggttgcagtgagcaagatcatgccactgcacttcaacctgcgtgacagagtgagaccccgtctcaaaaagaaaaaaaaattgggctgggcacagtggcttgtgcctgtaatcccaacactttgggaggccaaggcgggaggatcacctgaggtcaggagttcgagaccagcctggccaacatggcaaaaccccgtctgtactaaaaatacaaaaattagctgggtgtggagtcggacgcctgtagtcccagctactcaggaggctgaggcacaagaatggcttgaactcaggaggcagaggttgcagtgagccaagatcacaccattgcactccagcctgtgtgacagagcaagactccatctaaaaaaaaaaaaaacaaacaaaacaaaaaatatattgatacacaaaatttttacatatttatggagttcatgtgatattttgcttttcttcatacatagaatgtacaataatcaagtcaggatatttaaggtatcaatcactttgagtatttaacatttctatgtgttgggaaaatttcaagtcctctcttctagctatggaaatttacagtactttgttaactacagtcaccctactctgctattgaacattacaagttatcccttcttcctaagtgtatgtttgtacccattacccaacttctcttcatccacctctcccacccacgtacacccttccaatctctggtatcattctactctctacctccatgagatcaacttttctagctcccacatgtaagtgaggacatgtgatatttgcctttctgtgtctggcttattcacttaacataatgacctccagttccatccatgctgtaaacatgatttcattttttatggcttaagtccactgtgtatatatatcatattttctttattcatttgtcccctgatcaacacttaggttgattccatatctttgctattgtaaacacggctctacagtaaacacggagatgcaggttatcttttttatatactgatttcttttcctttggataaattccaggtagtgggattgctggatcacatggtagttctttttttttttttttgagacggagttttgcttttgttgtctaggttggagtgcaatgccctggtctcggctcattgcagcctctgcctcccaggttcaagtgattttcctgcctcagcctcacaagtagctgggattacaggcaccctccatcacacccagctaaattttgtatttttagtagagaaggggttttgccatgttggctaggctattgtgaacttctgacctctggtgatcgaccagccttggcctcccaaagtgctgggattacaggtgtgagtcaccatgcccagcccacatggtagttctgtttttgtttttttcagacatctccatattgttttcagtagtggctgtactaacttacgttcccaccaacagtgtgtaggagttcccttctctttttttttctttttttttttggagaaggagtttcactcttgttgcccaggctggagtgcaatggcacaatcttggctcaccacaacttctgccaccagggttcaagcgattctcctgcctcagcctcccaagtagctgggattacaggcgcgtgccaccactcctgactaattttgcatttttagtagagatgaggtttctccatgttggtcaggctgatcttgaactcccgacctcaggtgatccacccacctcagcctcccaaaatgctgggattacaggcgtgagccactgcgcccagtcaagagttgccttctcttagcatccttgccaatacctgtcatgttttgtcttcttaataacagccattctaactaaggtacgataatatctcattgtgtgcttttttgtttttgagtcagtctcgctctgcagcctaggctggagtgcagtggcgcaacctcagctcactgcaacctccccctcctgggttcaaccgattctcctgcctcagcctcctgagtagctgggattacatacgtgcaccaccatgcccagctaatttttttgtttgtttgagatggagtctcgctctgttgcccaggctggagtgcagtggcgcgatcttggctcactgcaagctccgcttcccgggctaacgccattctcccgcctcagcctctggagtagctggcactacaggtgcccgccaccacgccggctaattttttgtatttttagaagagatggggtttcattgtgttagccaggatgatctcgatctcctgacctcatgatccacccacctcggcctcccaaagtgctgggattacaggcgtgagccaccgcgcccagccacccagctaatttttgtatttttagtagagatggagtttcaccatgttgggaaggctgatctcaaactcctgacctcaggtgatccgcccacctcggcctcctaagctgctgggattataggcgtgagccaccaggccggcttcattgtagttctgatttgcatttccctgatgattagtggtgttgagcattttttcatgtacctgttgaccatctgcatgttttattttgattctccttctattatgattattattattaattatcattattattgagacaggttctcactctgtcacacaggctggagtgcagtggtatgatcacagctcactgcagcctcaacctccctgggttcaggtgatcctcccacctcagccttcaagtcgttggaactagaagtgtgcaacaccatgcctggctaattttcgtttttgtagagatggggtctctccatgatacccaggctggtctggaactcctgggctcaagtgatcctcccacctcagcctcccaaagtgctaggattacaggtgtggaccaccatgcccagcctattattgtcattttgaaacagagtctcactctgtcacccaggttggggtgcagtggcaagatcaaagctcactgcagcctggaactcttgggctcaagtgatctatgctcccacttccacctcctgagtagctaagactacaggtgagtggctatttggattctccttttaaacagagtagcaacttgaaccaaaaatacttttgtttcttcagatcctatgttgtaaatcacttctctttgaactaagtatgcagaagacttaagaagatgaagctgaacaataaaaatattaactaaacagattgaaagaaacttttttttttttttttttagatggagtctcgctctgtcgccaggctggagtgcagtagtgggatcttggctcactgcaacctccaactccctggttcaagcgattctcttgcctcagcctcctgagtagctgggattacaggcacgcatcaccacacccagtttttgtatttttagcagagacagggtttcaccatgttggccaggatgctcttgatctcctgacctcgtgatccgcctgccttggcctcccaaagtgctggaattacagacatgagccactgcacactgtacccggcctgtggtttttttttttttttaagacagagtctcactctgtggccaaggctggagtgcagtggtacaatctcggctcactgcaacctctgcctcccgagttcaagcaattctcgtgcctcagcctcccaagtagctgaaaacagcacaacctgctaatttttgtatttttagtagagatggggttttgccatgttggccaggctggtctcaaactcctggcttcaagtgatccaccgtcctcggcctcccaaagtgctgggattacaggtatgagccatagcgccaggcctgaaacaaactttcaagtaagactaaaactgttccgtgtagctgatgagttgtttttcctgccactcattataaaaatacaaaaattggccgggcacagtggctaacacctgtaatcctaccactttgggaggctcagatagacagatcacttgagcccatgagttcaagaccagcctgggcaaaaccccatctgtacaaaaaatacaaaaattagctgggcatagtggcatatgcctgtagtcccagttactcaagaggctgagatgagaacgagaaacacctgagcccaggaggtcgaggctgcagtgagccgtgactgtgccactgcattccagcctaggctatagtgagaccctgtctcaagaaataacaagaacaacaaaatgctcttgctttcaaattattttattgcccatcaaattgtaaatgtttcttcaagactcttgatcagataattatgagaagtcacacaacatacaggagatgactgggcttcaatcgactttacttgtcaataacagagtacaactgaactttaagtgggagctgaatttctttctttcttttttgaaacagagttccactcttgttgcccaggctggagtgcaatggcacgatcttggctcactgcaacctccgcctcctggggtcaaacgattctcctgcctcagcctcccgagtagctgtgattacaggcatgtgccaccatgcctggctaattttgtatttctttttttttagtagagacagggtttctccatgttcgtcaggctggtctcaaactcctgacctcaggtgatctgcccaccttggcctaccaaagtgctgggattacaggtgtgagccactgcgcctggctcttttttttttttaatagtgtcttgctgttactcagactgaagtggcgccatcatagctcactatagcctcaaactcctgggctcaagctatcctccttcttcaccctcccccaccatgctcggctaatttttaaaatttttagtagaaatgaggtcttgctgttttccaggctcgtctcaaactcccaatctcatgcaatcctcctgcctcagcctcccaaagtgctgggattacaggtgtgagccactgtacccagctgagagcttaagtttcttgcataaaactcagctgtatgctgaagtgtttagaagtgaaatgtaatgatgtctgcaacttactttgaaatacattaataaaatggataaatgaatggatagagggatggataggcagattgacatgtgtaaaacaaatagagaaaaatgttatttgtagaatctaggtgatgctaaaggccacacagccagtggggactgagccaagctaggaatccaggtccaccaattcaggagaggctatgtggtgaagtaaagataacaccccgttcccagtttttgtatctgtttttgttttgagacagagtcctgctttgtagcccaggctggagtgcaatggagccatctcagcttactgcaacctctgtctcccaggctcaagtgatcctcttgccttagcctcctgagtagctgggactacaggcatgtgccaccacgcctggctaattttttggtagagatggggtttcactatattgcccagctggtctcaaactcctgacctcaagtgattaaccagcctcagcctcccacagtgctgggatcacaggtgtgagccaccgtgcccggcaccagttcccattaattatcttggaacccaaggattcaaagaagcagtcttttcaaagagatatttgagtcactgaccaccagtcctggaatgcagaaatgcttagtcccacctacctcttttgttcattccttcaaaagtttcctcttcaaaagtagggctagcagatctaaatgggccagaaagaactctcttaactgttgttttttgttttgttttgttttttgagactggagtctcactttgtcgcccaggctggagtgcagtggcgcgatctcagctcactgcaagctccgcctcccgggttcatgccattctcctgcctcagcctccccagtagctgggactacagacgcccgccaccatgcccggataattttttgtatttttagtagagatggggtttcactgtgtgagccaggatggtcttgatctcctgacctcgtgatccacccacctcagcctcccaaagtgctgggattacaggcgtgagccaccacaccaggcctttttttttttttttttttgagatagagtcttgctctgttgcccaggctggagtgcagtggcgctatgttggctcactgcaacctccacctcctgggttcaagccattcttctgcctcagcctcccaagaagctgggattacaggtgcacgccaccaggcctggctaattttttttttttttttttgagacggagtctcgctctgtcacccaggctggagtgcagtggcgcagtctcggctcactgcaagctccgcctcccgggttcacgccattctcctgcctcagcctcccaagtagctgggactacaggcacctgccaccactcctggctaatttttttgtatttttagtacagacggggtttcaccatgttagccaggatggtctcgatcttctgacctcgtgatctgcccgcctcggcttcccaaagtgctgggattacaggtgtgagccaacgtgcctggccgtttttttttttttttttggtatttttagtagagatggggtttcaccatattggccaggctggtcttgaactcttgaccttaagtgatccaccctcctcagcctcccaaactgctaggattacaggcgtgagccaccgcgcctggccttcataactgttgacatacaagcattacagtaaaaattagactggaaagactatgccttgatttcaactttaatcacaattaatttattctttctttaaaaaaaaaatgtaatcccagaactttgggaggccaagtcgggtggatcacctgaggtcaggaattggagaccagcctggccaacatggtgaaacctgtctctagtaaaaatgcaattagccaggcatggtcgtgggtgcctgtaatcccagctactcaagaggctggggcaggagaatcgcttgaacctaggaggcggaggttgcagtgagccaagatcatgccattgcactctagcctgggcaacaagagcgaaactccatctcaaaaaaaaaaagaggctgggtgcagtggctcacgcctgtaatcccagcactttgggaggccgaggcgggaggatcacgaagtcaggagatcgagaccatcctggctaacacggtgaaacccccgtctctactaaaaatacaaaatattagttgggcgtggtggcgggtgcttgtaattccagctactcgggagactgaagcaggagaatggtgtgaacccaggaggtggagcttgcagtgagcgtagcttgggccactgcactccagcccaggcaatagagacagactctgtctcaaaaaaaaaaaaaaaaaaaagaatcctccggcattatatctccagctactgtggcccaagaatatatctttatcaaaaaatacaaaatccagggaacatgcaaatatctgaagaagaaaaaaacactgcaatcactaatgcatacagtgaagagttggcccagttccagagtccgctatgtttgatagtttgtgcacttgcagaatgagagtggggggggagttccccacctgaggccactgtcctctctatggccacctctaggtcttcaagaccaaggaacacctacactccaggtgtctccttgccagatgtttcacctgcattggtaaaaggcagaatcctcggcaggggtcggtggctcacgcttgtaatcccagcactttgagacgccgaggcgggtggatcacgaggtcaggaattcaagaccagcctggccaagatggtggaaccccgtctctactaacagcacaaaaattagctgggcctggtggcgcatgcctgtaatcccagctaatgggaaggctgaggcagagaatggcttgaacccaggaggcagaggttgcagtgagccgagatcacgccactgcactccagcctgggcgacagagcatgactccatctcaaaaaaaagaaaagaatcctgggatgagctccgccccccccaccagccgagggacaggcctgaggtatcccctctattctggggggtccagagtgggtgcaggctcctttaataggcactggaatgtaggggaccccatctcagaggagtaggagagatacaggccaaaaagcagagagctacaagggagagaacaatcatgaaggaaaagccagttaggtgaatggttttcagtgaaggatgggacgtgaacacggggccctgtgtgctggagcttcagaaaatggggtcaacccccaggcaccttttcagattcctgcctcctccccacagccctctgtgcccctacctctgctttttacctaaggcagaactttgttttcctcaaacgcccacttcctttccttatcccccaaatacacaaaccttgcctcttcctctccagggaaacgctgaccagtttgtgtgaacgccatcacccacactcttgaaatatatctggaaagtgccggaagtgaactgggggatccttgcctcccaaaacagggatgggctctgaacgccccaccacggcctgctgccacgcgcgcctctcgctgcaggagcggtggatccaccgatgggcttccagggcggtcttgcgcttgaagcctttcccacactccacgcaggggaagggccggctgtcggagtgaatgcgccggtgactgaggaggagggaagaataggtgaagcggcggccgcagtcaggacaggggtagggcttctcgccggtgtgtatgcgcctgtggatggccagcagggaggtgtaggcgaaacggaggctgcaatcggggcagctgtagggcttctcgcccgtgtgcttgcgctggtggatggccagcaggtaggggtaagtgaagcgactcttgcagtctgagcacgcgtaaggcttctccccggtgtgagcccgcctgtggatagccagggaacccctctggcggaagcggcgcccgcagtcggggcaggggtagggcttctcgccggtgtggatgaactgatgctggagcaggtacctgcgctgggagaaacgcgcctgacactggccgcaggagaagggccgctccccggagtggacccgctggtggctggccaggagggaagggtagctgaagttgcggccacagtctgggcaagagtggggcagtcttcgggtcagagtgtccttgagccagggattcatggggctctgcctagggttgcagaactctgggcaggcgacgctgggccaccactccttgacagccacttcatgcgccacctctttttgttttggacacttcttcagcctttccttctcctcattcccatccctggatcctgaaacagggaagatgataaaatcagaaactcatccctggatcctgagacaggaaagatgataaagtcaaaaccagcatattccgggaccatgtcctgccttggaaggcagcaggaatggttcagaatatggcgcccagggagcacggcttaatgataggggcctcatgaagccctgaaagccagcctggagtaaaagcaaatgccatggtctgcaggttaacacaagaaggccctgagcactggagataatgaaagaggagtcgggccgggtgccatggctcacacctgttatccaagcacttcaggaggctgaggtgggaggatcgcttgaggccagaaattcaagggacagtgagctgtgatcgggccactgcactccagcctgggcaactctctaataaaaaaaaaaaaaaatgctgggcgtggtggcccatgcctgtaatcccagcaccactctgggaggctggggtgggcagatcacctgaggtcaggagttcgagacctgcctggccaacatggggaaaccttgtctgtactaaattacaaaaattagccaggcgaggtggtgggcgcctgtaatcccagctacttgggaggctgaggcaggagaatccctggaactggggaggtggaggttgcagtgagccaacctcgtgccactgcactccagcatgggcgacacagcaagactcagtctcaaaaaaataaaaaaagaaaaaggagtgaacaatattgaacgcttaactctgtgtcaggctttgaggacacagtgatggtcccagtcctcatggcacttaccatcctgaacctgtttatgatccctttacaaaacagccattcaatgaccttctttggtaccagctcaaattcttttggcacctttcctctctgctcttaccatcaccaaaaagtctacacttgctggtggggcacagtgacttacgcctgtaatcccagcactttgggaggcagaggcaggtggatcacgagatcaggagttcaagaccagcctggccaagatggtgaaagcccgtctctactaaaaatacaaaaattagctgggcatgatggcgggtacctgtaatcccagctactcaggaggctgaggcaggagaattgcttgagcctgggaggcggaggttgcagtgagcctagaccatgccactgtactccagcctgggcaacagagcgagactgtctcaaaaaataagtctacacttggactgcctcactaggttccacgggaagaccttctgggaacaagcatttattctggtatcagggctgcaggaaaaacatttctcttcatttaaaaatctaattaatggtgttatttactacacgtggttcacatcattaatatccaagaggaacatctgtcttcattttatcccacaacaaaaatcaaattacaggtttcccctttcccttgacctcctaggaagctcaagctctattttgcattaaactgaggttttccagtatggttaatcggttccatagatcccaatttcgctgttccatcgggccattttgcagtgagatgaggacgtttctggggtagggtgcagggagacaggatgggactttggagggggcagcctgcgctgaggatgtgagtgagttgggggcgggggttggggcttctccacggctacttatccaaatgaagtacctgcttcctgtccttggcccctgctgaaagctgcagagctctcaccgtcgggatcctgggcctccgggctccacgcctccacttctccttccacccacgagataaaagcgggtttgggaactgaaaatcctgcgaaggagaaacaatgggctcggctgagcgcacgggaggggagaatgagactgctccctcggcgccccgcttccagcccactagcctctggggacaccgatcaccgcttcccaccgacggactgggggtcccggccggagggcccggcctcacccagcgcgcccaggtggccgaaggtctcccgcatcacgtcccggtacagggccctctgcgctggccgcaggcattcccactcctcgggagagaagtacacggccacgtccgcgaagctcacggcgcccggcctgctttccctcgtcctccggggcccggcctccccgggtacgtgggccgggcgcggcgccaggggcggccccatgggaaaccctttctgcctggcaaagggaggcttccggggaaggtggagatgctggcgctttcctgtctttcctcagacaagtccgtaagggactcctgcccttaaccaagatggaaccttcctggcgtcaacacccctcgcctttcctctctgcctttacacaccacgagggaaaccagcgggaagggtggccccgcaacaccactaaccgatagatggcgtacgttgattggacagtgccggaaggccaggagaagaaggaaggctgtgattgggcttttttttggagtggcctgtttgaaaggctgagggtgaaggagcgacagatctgaaaatagccggagctgaggggcctcagggtctaccctgactcgcttttcccggacggtctcctaggagagaggctgtggccagctgacgcgacttccttctgctactgaggtgagaagtcttagggcagatgcggatgtccagggcttcgaggtgagtaaaggtgaagcgcaaagccttaggcggcgtgcactgagtgggtaagggactgcagatcccagctttgagctctgagtactcctggcagtgccagcccgaggggcagcgggaacaggatcctacccaggatctaatttgacctttgccccgaggtcacagatgtcttcccttatagagatgcagaaggccaggcgcagagcccggattcaaagtcagctcctagccgggcgcgatggagcgcgccggtggtcccagctcctcgaggggctgaggcaggaagatcgcctgaactcgggaggtggaggctgctgtgagtcgagatcgcgcccccacactccaggctggcgacagagccaggcgcccatctctaaaaacaaacaaaagtcatcttctcgcttccgggttcggttaaggacttagggtagggccctgcacaaagtactattataatagatatgaatttatagtgttgtagttttttttttttttttttttttttgagatggagtcttgctctgtcgcccaggctggagtgcagtggcgcgatctcggctcactgcaagctccgcctcccgggttcacgccattctcctgcctcagcctcccgagtagctgggactacaggcgcccgccaccatgcccgcctaattttttgtatttttagtagagacagggcttcaccgtgttagccaggatggtctcgatctcctgacctcgtgatccgcccgcctcggcctcccaaagtgctgggattacaggcgtgagccaccgtgcccggatgtgttgtagtaatgtttaataccatctgagtcttgtctcaatcagaaaacgtgctcaaattacagctgatatgtgagtaataaaactgggaaacgaatcagataatctcttaagaccgtttttcagccctttccaaccgagtattcatagaaacagaagaggaacgttctagatgtataacaaaaagctgcccatccccacagtgaaaccactttgaagacatcactttaaaattcatgtgaattcggccgggtgtggaggctcacacctgtaatcccagcactttgggaggctgaggtgtgtggatcacttaaagtcaggagtttgagaccaggcaacatggtgaaaccccatctctactaaaacagaaaaattagccaggtgtggtagtgcacccctgtaattccagctacttggggggctgaggcatgagaatcacttgaacccgagagacggagcttgcagtgagccgcagtcgcgccactgcactccatactgggtgacagagtgagactccgtctcagaaaagaaaaaaaaaaatgtgaattcagttgggtgtagtggctcaggcctcaggcctgtaatcccagcactttgggaggtcaaggtgggaggatcacgaggccaggagttcgagaccagactaaacaacatagcaagacctcatctctaaaaaaataaataaataaaaaacaaaaacttgtgtgaatttgcattctattttataatataaccaaatgatctcggccttcacaccatcttcttggaaacctctgcaccatgagagcctagtggaggaagcgaatgcgcaggctgaagcgcaaaagaagaaagatgaggcagaggtccaagtaaaccacaagcttatgcacccatggaggctacaggagcagaaacatggaatccagaggctggggatgctggtacagttattgggctgcatgctactgtctagagcttgtttcagtgcatctagaacttcatctccatctggtcgccaagaccacctctgagactcaccttgctcataaccaaaactgcatgttggtcctttgctccggacctgtgatattctggactatttctgtgttcactggtggccgagtgtaacaaccatataataaatcacctcttctgctgtcttagctgaatatatataaccaaattcaaaagaatatatagtcaaaagcaagtttatcaagtgttatcctcttttacactactggtggagtgtgaattggtgcagccgcttttgaaaactggcagtacctactaaagctgaatagatgtcataccctatgacccagtgattccacttgtaggtgtatacccaacagatatgcatacatatgtttactcaaaggcatttactcaaatgttctccacacttcttataataggtaaaaactagaccagatgcggtggctcatgcctgtaatcccggcacttcgggaggccgaggtcagcggatcacctgaggtcaggaatttgaaactagcctggccaacatggcaaaaccccatctaaaaacacaaaaattatctgggcgaggtggcaggcgcctgtaggcccggctactcgggaggctgagacaggagaatcacttgaacccaggaggtggaggttgcagtgagccaagatcacaccactgcactctagcctgggtgacagagcaagactccatctcaaaaaaaaaaaaaaaaaaaaaaagattccgtttctatagtttttctttttaaaagactctgcatgtaggctaggctggtggctgaggcctgtaatatcagtactttgggaggctgaggctggatgatcacttgagcttaagaatttgagaccagcctgggcaatatagtgagacaccatctctacaaaagcaattttttttaataagccaggcatggtggtgtgcacttgtggtcccagctactcaggaggctgagatgggagaactgcttgagcccagaggtcaagggtgcaataagccattatcatcatgccactgcactccagcctgggcaacagagcaagaccctatctctaaaattaaaaaacatatgtataaaaacagacaaaatgtggccgggcacggtggcttatgcctgtaatcccagaactttgggaggccaaggggagtggatcatgaggtcagggattcaggaccagcctggccaagatggtgaaaccccatctctagtaaaaatacaaaaaattagcggggtatgatggcgggcgcctgtaatcccagctactcaggcagctgaggcagagaattgcttgaacccaggaggtagaggttgcagtgagccaagatcgcgccactgcactccagcctgagctagactccatctcaaaaacaaaacaaaacaaaacaacaacaacaaaaaaacagcaaacttaatccatgctatcaaaaatcagagccaggtacgataatagatgcttctaggatgctgataatattctctttttttcttttttttttttagatggaatctccctgtgtcacccagactggagtgcagcagtgcaatctcaggtcactgcaacctccacctcctgggttcaggagattctcgtgcctcagcctctggagtacctgggattacaggcaggtgccaccatgcctggctaagttttttgtatttttggtagagacggggtctcacatgttgcccaggctggtctcgaactcctggcctcctctgatccactggccttggcctcccaaaattctgggattacaggcatgagaattgcttgagcctgggaggcagaggttgcagtgagccgagattgtgccactgcactccagcctgggtaacagagtgagactctgtctcaaaaaaaaaaaaagttcacactccagtgatttgcatatcatagtaaaaagtaatctcttgggtctcatttttcattgtgtttagcgcagtaccataaaccttaaataacaccataggacccatacaaagtgccactagtgatgctggaagtgctcccaagaagcaaagaaaagtcatgacatttcaagaaaaagttgaattgcttggtatgtaccatagattgaggtctgcagctgcagttgcccaccatttccagataaattgatccagtataagaaccactgtagtggcctgtagtcccagctactcgggaggctgaggcaggagaatggcgtgaacccgggaggcggagcttgcagtgagccgagatggcgccactgcactccagcctgggccacagagcgagactctgtctcaaaaaaaaaaaaaaaaaaaaaaaaaaccactgtagctgggcgcggtggctcacgcctgtaatcccagcactttgggaggccgaggctggtggatcacctgaggttttccagtatggttcatcggttccatagatcccctgtaattccagttactggagagggtgaggcaggggaatcgcttgaactcaggaggcagaggctgcggtgagccgagatggcgccatgggactgggcaacaaaagtgaaactccatctaagaaaaaaaaaaaaaggcacaaaggacatttagtagtaaggaagagaagcaagcaccaggatttacaacaggaagggataagctaactccactgttttgtgcagatgcagtcaggtttattatcagtacgtcccttatctataaaggtgcttatccttgagccttgaagggaaaagagaaatactagcttgcagtcttctgggtgtacaacaaaaaaggcctgaacaacaataatctttttctggatggggtacatctgtgctttgtccctgaagtcaggaagtacctggccggtaaaggcctgcctttctccattggcctttaccatcttattttatttttatttattttgtttgtttacttatttatttatttttgagatggagtctcactctgtcactaggctggagtgcagtggtgcaatctcagctcactgcaacctccacctcccgggttcaagcgattctcctgcctcagcctcccgagtacctgggattagagacatgcaccaccaggcccagctaattttgtgcttttagtagagacagggtttcagcatgttggccacgatagtctcgatctcttgacctcgtgatacacccgcctcagcctcccaaagtgctgagattacaggcgtgagccaccgcaccaggcctttacttatttatttatttatttatttatttatttatttatttatttgagatggagtctcactctgttgcccaggctggagtgcagtggcacaatctcagctcactgcaacctctgcctctgggggttcaagcaattctcctgcctcagtctcccgagtagctgggactcaagcacacaccaccatgcccagctaatttttgtgtttttattcgagacgaggtttcaccatattggccaggctggtctcgaactcctgagctcgtgatacgcccgcttcggcctcccaaaatgctgggattacaggtgtgaaccgctgcacccagcccaccatctcattttattaaagggaaattaaagcacaaggaaatacagaccatgactgacaggttagagccactagatttctgtctgcagccacagatcttccttcccaggcatccactgcctgcagctagagagtctagtctgtgttcctcacaacaccattatcagatggggtccctcagatggtgagatgcacaagccactggcatgtcacttagactctgcccaatttggacaaattttatcaaactctggttgtgtttcatttgctggttcattataaggatattacaaaggatatagatgaagagatgtagtgggtgagatatgggggaaagggagcagagattccatgccctccctaggtatgcatgctacccctctaggaacctccacatgttcacctatctggaagcttttattttttttttttgagacggagtttcgctcttgttgcgaggctggagtgcaatggcataatctcggctcactgtaacctccacctcctgggttcaagcaattcttcggcctcagcctcccgtgtagctaggattacaggcgcacgccaccatgcctagctaatttttgtacttttagtatagacaggatttcaccatgttggccaggctggtcttgaactcctgacctcaggtgtgccaccctccttggcctcccaaactgctaggattacaggcgtgagccaccgtgcccggccgggactgccttttaaagttattttgatattggacaatgcccctggccacccagaaccccatgaattcaacacctttggtggtgaagtggcctacttacccccaaacacaacacttccaattcagcctatagatcaagttgtcataaagatctttaaggctcattacacatggtactctatggaaaggatggtcaaccctatggaagagaaccccatcatgaaagtctggaaggattacaccactgaagacaccatcgttgttatagaaaaagctgtgaaagccatcaaacctgaaacagattcctacaggagaaaactgtatccaatagtgcgactactagagaaaactatgcccagatactaggtgttacttcataggaaattatgacaagagccaatcaaggaaatcacgaaagagactgtgaatatggcaaaaaaaaaaaaaaaaaaaaaaaaaaaaaaaatttagggggtgaaggatttcaagacatggattttggagaaactgaagagctaatagacaccataccagaggaattagaatacaacttggtagagatgagtgcttctgaaccagtgccagatgataaggaagatggaaaggggcagtgccagaaaacaaattgacattagacaatctggcaggagggtttccgtcatttaagactgcttttgacttcttttatgacttagacccttctaagatatgggcactgaaactaaagcaaacagtagaagaaggattggtactgtatagaaatatgtctagagaaatgaaaaagcaaaaaaagtcattttttgatgtacttatgatgtattatgaaattatgatgtatttccagaaattatgatgtatttccataaagttgcaccagtgtgcctgcctcttctgctcccccttcgcccttctccacctcttctgcctctgccacccttgaaacagcaagaccaacccttcctcctcttcttcctcagactgctcaacatgaagatgatgatgatgaagagttttatgatgatccacttccacttaatgaatagtaaatatattttctcttccttatgattttcttaataacattttcttttctctagcttactttatgataagaatacactacataagccaggcgtggtggcatgcgcctgtagtcccggctactcaggaggctgaggcaggaagatcacttgagctgaggagtttcgggctgcagttgagctatgatcacgtcactgcactccaaccttcgtgacagagcaagacccatctctaaattaaaaaaagaaaaaaggtggggggagagagtacagtatatgatatatatgacatacaaaatatgtttttgtttttttctttttgagacagggtctggctctgtcacccaggctggagtgcagtggctaccatcctggcaacctctgcctcctgagctcaagccatcctcctacattagcctcccaagtagctgggaatacaggtacatgccaccatgcttggctaattttttaattttttgtagaagcggggtttcaccttgttgtccaggctggtctcgaactcctgagctcaagcagtcctctcgcctcagcctcccaaagtgctgggattacaggcgtaagcccaaaaaagtatatatgtatttaaatatttactatctgattttttttttttaggacaaggtctggctctgtcacccaggctggagtgcagtggtgagatctcggctcactgcaacctccacctcccaagctcaagcaatcctcctggctcagcctcagctgggattacaggcatgcgccatggcacccaaccccaaaacatgttttaattgactatttatgttattggtaaggcttccagtcaacagtagttaagttttggggagtcaaaagttagtggaggccgggcttggtggcacatgcctgtaatcccagctactcggcaggctgaggcacaggaattgcctgaacgcaggtgtaagagattgcagtcagccgagattgtgccacttcactccagccagggccaaacagcaaaactccatctcaaaaaaaaaaaaaaaaaaaggcagaatagatgttactagaggctagaaagggaagggtaggggcaagggtgggatagggaaaaatttgttaatggacataaaattattagctatattggaggaataagttctagtgttttatagcaccgtaggatgactatagttaacaataatatactatatattttcaaatagctagaagagaagatattgaatgttcctaacacaaagaaataataaatgttttaaatgatgggtatgttaattgccccgatttgatcactacacatcatatgtatagaaacatcaccacataccccatatttatgtatagttattatgtatgaattaagaagaataatggaccccaaagatttcacatcctaatctgcaaaacctttgattgtgttaccttatattagcaaataggacttcgcagatgtgattaaactaaggattttgagttaggaacactaacctgttgagtctaatgtaatcacaatggtccttataaaagggaggcaagagggtaaaagtctgagaaggatatgtgacaacaaaagcagaggtggagtgatgcagttgctggagaggggccactagccaaggaatgcaggcagcctctagaagctggaaaaggcaagaaacagattctccctagagcctctagaaaaggaatgcagccctgccaacaccttgattgtcccataagacctattttcagactttagacctgaagaactataagacgataaatttgtgttgttttcagccaccagtttctagtaatttcttacagtaacaaatgaacacagataacattgttgaggagcatttctgagtttgtcaactactctattgatgtgggagcactctcccagctctgaactcaagaaagtctaaaaagaagtaggactcagagacattatgctgaataaaagaagctttagacaaaaaaaaaaaaaaaaaaaaatacacactgtatgattccaattatatgaagttttataacagggaacactaattagaatagtagttgtctctggtggggtgggaatgggaattgactaggaaggggcataaggcaactttctttcttttcttttctttttttttttttgagacagaatctcactctgtcgccaggctggagtacagcggcagaatctcagctcactgcaatctttgactccctggttcaagcgcttctcctgcctgagcctccctagtagctgggattatgggcacatgccaccatgcccagctaatttttgtatttttagtagagacggggtttcaccatattggccaggatggtctcgaactcctgacctcgtgatctgcctgcctcagcctcccaaactactgggattacaggcatgagccactgtacccagccacatgaggcaactttctaggatgatggtaatgttatgtatttggataggggtttcagttacagatgtatacgtctttgtcaacactcagcaaatatacacttaaagtttgtgcattttatgtacttttaactcaaaaaatatataaaacaaacgtggagctctagttaatgatatgcatgttgaaatgtttacgggtgaagtgtactgatttcagcaattttttttacatgcacccaaaaacaaagtgtactggtagagtaactgatagttacatgataaagcagatacactaaatgttagtgatagaatctaggtggtgagtatatgggtattctctgtaaaagtccttcaactttactgtgtctttcaaaacttttaaaatgaatggtggctgggtgcagtggctcacacctgtactcctagcactttgggagtctgaggcaggtggatcgcctaaggtcaggagtttgagaccagcctggccaacattgtgaaactccatctctactaaaaatacaaaaattagctgggcatggtagctcatgcctgtaatcccagctactctgggaggctgaggcccgagaatcgcttgaacctgggaagtgaaggttgtagtgagccaagatcgcaccattgcactccagcctgggcaatggagtgagacttcatctcaaaagaaaaaaaaaagcaaaaccactattgagaatgaaaagacactccacagaatgggagaaaatatttgtaaatcatgtgtctaataagggattaatattcagaatttataaataactccggtaactcaacaaccactaaaaaataaaaacccaatttaaaagcaggcaaagaggctgggcacggtggctcacactgtcatcccagcactttgggaggccaagacaggcagatcacttgaggccagaaattcgagaccagcctagccaacagagatgatgaaactccatttctgctaaaaatacaaaaattagccggcattgtggcacagacctgtaatcccagctactcaggaggctaaggcatgaaaatcacttgagcctgggaggtggagggtgcagtgagccaaaatggcaccacagcattccaacctgggcaacagagcaagacaccactcaaaaaaagaattaaaaaaaaaaaagatgaaagcaggcataggatttatatagacatttctccaaagaagatatacagatgagctgggcgtggtgactcacgcctgtaatcccagcactttgggaggctgaggcaggtgaatcacctgagatcaggagttcaagaccagcctggccaacatggtgaaaccccatctctactaaaaatacaaaaaaaaaaaaaaattagccgggcgtggtggcgcacgcctgtaatcctagctacttgggaggctgaggcaggagaattgcttgaacctaggagacagaggttgcagtgagccgagatcttgccgttgcactccagcctgggcaacagagtaagactctatctcaaaaataataaatgaataaacacacaaacaaacaaataataaataattatcacttttttgcattttcccaatttctttactgattatttttgggatttggaaaaaacataaggccgggcgaggtggcccacacctgtaatcccagcactctaggaagccaaggcaggaggattgcttgagcccaggagttcgagaccagcctgggcaacatggagaaacctcatccctacaaagaatacaaaaaaattagttgggtgtggtggcacatgcctgtggtcccaactactcaggaggctgaagcaggaggatcacttgagctcagggaagtagaagctgcagtgagccatgatcacacaactgcactccagcctgggccacagagcaagactctttcttgctgggaaggaattctcacatgtacgcactagcagaagccacaagcggcaccaggaagactagaagaatgcggggcatgaaagctaagttacaagagagcttaagtaggaaaactaaggtatgtaagataaaaattgaagcactgatttgttaactaggtcatcagttatcttaaaggacagtcttagaataattgcatggcagctgactttacagtcacccagatatgtgatcctggacaagttatttatttttttttaaattttttgagatggagttttgctcttgttgcccaggctggagtgcaatggcgcaatctcggctcattgcaacctttgcctcccgggttcaagtgattctcctgcctcagcctcccaagtagttgagattacaggcatgtgccaccatgcctggctatgtttttgcatttagtagagacgggatttcaccatgttggtcagaccggtctcgaactcctgacctcaggtgatccacccgcctcggcctcccaaagtgctgggattataggcgtgcaccctgtgcccggtcgacaagctatttaatgtcactgtgcctctgtttcctcatctggtcaaggaaaacaatacctacagtcagatctggaatttgaggctgccctacttataggttaataaatgggtctgttattgtttcatggatgctgtcagaaaacagagacaaaagaccttactgttcagggcacaacaagcagcatgagcatgcctgcattggttcccttctgccccctgcaggggcaatgtgggatgtgcccagatggatgctagacacacagtgagttgcatcataggggaggaacaggaagctcctgctgtttttttcctttttaaagatgggatttggctgggagcggtggctcacgcctgtaatcccagcactttgggaggccaaggcaggcagatcacctgaggtcaggagttcgagaccagcctgaccaacatggtgaaaccctgtctctacaaaaatactaaaattagctgggcatggtggcaggtgagtgtaatcccagctacttgggaggctgaggcaggaaagttgcttgaacccaggaggtggaggttgcagtgagccaagatcacgccactgcactccagcctgggtgacaagagtgagactccttctctaaataaatacataaataaataagatggggtcttgctatgttggccagggtagtctcaaactcctggcctcaagcaatcctcctgccttggccaccaaaagttctgggattacagttgtgagccaccatgcccagccatctgctgttttatagtaagcagtaaggaagctgctctttgtcctggatgcagacattacctctccctcaaggtttgcttgctgccaacactcctgagaattgttctgggtaatgagtggcaagggctttgcttatttatttttatttattggttatacttacatttatggtttattaaagcaaaacgacacagatttaaaatcatcaaagggataaggtacatgggacaaaatccggatgcaaccgggcacaaactttcaggtgtctactcccagtggggtatcacagggacgtgcttttttctccctgcaatgatttttgacaacaggtgctgattgttcccaaacagagaagttcacccaagctttagggtgcagggtttttttgtttgtttgttttggttttttgtttgtttgtttgtttgtttagatagtcttacttttgttgcccaggctggagagcaatggtgcgatctcagcttactgcaacctccacctcccaggttcaagcaattctcctgcctcagcctcccaagtagctgggattacaggtgtgtgccaccacctggctaattttgtatttttagtagagacggggtttcaccacgttggccaggctggtctcaaactcctgaccacaggtgatccacccacctcgcgctcccaaagtgctgggattacagacgtgagccaccgcgcccggccatgtgtggggtttttattggggattagtcacataggcttggagtgtccatactactgatctctgctactcagaccccagagcaaaaaacaatgttcactataaatcacacttaggataaacttatttgttcagactggtacagcatgatggcatgctgtatgccaagacctctggcatacaaaaacactaatcaaataaaatattccacgggctcagaagttatttcccaggagcagaccaaatgccagttctaaagatgagctttctttggaatgtgcagggtttgaacaacctacacctcctgagttaacccattcctacacacacctgatcccatgagtccattgtacctggtaaactaaattttgtatctcttagaattaaaattagtttaggtccaatgtcaacaaatctctggaaactctagttacttccccttctctgatgctcacagtagcagtagtctacattcactgaacccacttgtttattctttggcccactgcagtattaatagacacttgactgagctttcatgatgtgccatgtactgagttaagcactttatatacattccaatctaatgtgcttgctaaatggctgcaggtacacttggaaaaggctagaagctctacagcatgtttttgtcagtgtagaactgacatcaagtccttcatcaagggaacccagcctccccagatctagagaaggggagactctagatctgtgaataggctcaagtctgagaatctgttgaaggcagggacttgcaatttttgccaactcaacaagatgtgaaggcaggacttgccgagatggatcggaagtcaacatgagtgggcacgctggtcaatttggagtcacagcagggagactcatggaggagtgtctgttaacacctactttatagagttcttgtgaacattggattggaatgtatataaagtgcctaacacagtacatggaacatcataaaagctcagtcaagtggctattaatattgcagtaggccaaagaataaacagaagtggattcaggccaggtgcagtggctcacacctgtaatcccagcagtttgggaagctgaggcaggcagatcacttgaggtcaggagtttgagaacagcctggccaacatggtgaaaccccgtctctactaaaaatacaaaaattagctgggtgtgatagcatacacctgcagtctcagctactcaggaggctgaggcacagaatcacttgaacctgggaggaggtggaggctgcagtgagcagagatcgtgccactgcactccagcctgggtgacagagtgaggctccagctcaaaaaaagaaagaaaagaaaaaagtggattcagtgaatgtaggctactgcttcaaggcatttagctgaaaataatagggatcaagagaaaagttcttttttattgttttaaaggcagatcttagcatgcttataggctggagtgtctttgggacaagaaagggaatctgaaaccataaaactaggagacgagaaagtaggaataatagagcaaagtccctgaggggcagaaggggatgaaacccaggcccagctgtgttgctgaacattgtatatccaggacttgctgagatggatcagaagtaaatatgagtgggcacactggtcaatttggagtaatggcagggagcagaatgttaaagaagctcctatttgaccccttgtattttcctagtgaaagcggaggtatttactggttaaaaatatatggaatgggcagggagcagtggctcacacctgaattcccagcactttgggaggctgaggcaggtggatcatgaagtcaggagatcgagaccatcctggctaacatggtgaaatcctgtctcaactaaaaataccaaagatcagccgggtgtggtggcaggcacctgtagtcccagctaccagggaggctgaggcaggagaatcacttgaacccaggaggaggaggttgcagtgagctgagatcacgccactgcattccagcctgggcgacaaagcaagactccatctcaa

SEQ ID NO: 5532 - DNA, 2120 bp, Homo sapiens
tgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaatatcagttcctgtcactcttccaccccttttctccctctcccctgcattgtggtctgggccttggtccactagcaactccccttaggtgttgcttaatctgcctcatggccaaagccaatcccattcctgtcccccgctacccaagggactcccagtctgtatgcacaaggcgggatgtgaagtctggatgtgcaagaaacccagctgtaagaaacagcttccctcggcttggcatggtggctcatgcctatattcccagcactttgagaggtcaaagtgggagaatcacttgagcccaggagttcaggactagcctgggcaacatagcaagatcccacctctacaaaaaaagaaaaaattcagagtctcaaatgtcccttcatctccttactctcgacctgtctccctagttctctgccgccttttcctctcccctggatctgacactcaattgtctgcatgcacttttcaactgaaagagactccaatgccatccttctgatgaaatttttgctttggatactactgcagaaaaaatgctatcttgtattctggtccatggtggggaagaccctgtcgtagaacctggcaactcaagtggagggaggggccagaacattgttcttatgctatttacagtgagacaacaggattgatgcagaactttctttttttttttttttttttgagacagagtttcattcttgttgcccagggctggagtgcagtggcatgatctcagctcactgcaacctccaccccccaggttcaagcagttcttcctcagcctccggagtagctgggattacaggcgtgcgccaccacgccccactaatttttgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacacctcttggaggcagagcccctcagccctatccaggccagcagtgtccacttgaaatctgaaagcagcctccctcaccaaaccagcaagatggaaaacctccctgggttggcaagtggccctgggaagtacatgccccatctctgtcaggatagcagtggagaggtttcgtgccagtgccagctccacccacccagatggtactcaagactccaagcctgtcaatggggtggaaactttctggcattttctgtcagaagggtgagttagcactgaaccatctcatgtgtcttttcactgagtaacagcccatatccattccatgaaatgagtgactgctttgttgaatcagatagtaacaaacatttatttgtagtctggttgtgtcatatcatggttgaattgcaaacaggttggatagaagagtcagcaaaaatcaacaaaagcattctgtaaaaaacttttctagaattacaataaatggcattgtatatt

SEQ ID NO: 5533 - DNA, 316 bp, Homo sapiens
gtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtg

SEQ ID NO: 5534 - DNA, 480 bp, Homo sapiens
gcggccgccaggttgcaggcaggctggagctcctgggtgccacaggggacctgcacacacaggctgaggaatggtgtagggtctaccacccggaagcagtccctcaagctggagtgggggccctcgaagaaggcccagcaggcggggagctgtcccgggcaggcctgctcctgctgaggcttctcagtggccctgcagtcaccacccacctgccaggccaggctgagctcctccaggctgcgggccatagagccatccggcaacatcagctcattgcctgcttcattgtcattggtgcccagaaggccagcggatatgccgtgctgccagaggcccagagtcaggctgcagaggccggtgggcacgtcacaggagacagacaccccgtcctcgctggccagctcaatcctggagacgtccttccttgtcgtggcaggatgcagcttgaggtccggacaactgtcccccggcagggaggag

SEQ ID NO: 5535 - DNA, 2604 bp, Homo sapiens
tttgccatctggacctgtcccctctcccagcactgcagccccgctggacaacgacacacccctcggctcctcagcctgggcagccctctcccttctccattccccaactttttcctccgccattcccaccctggagttctattcacccctcaagcctctgcctcggccacgtcttctgagaagctccactctgctcctattcaacaaagagagagagagagagagatctgctttgagacactaaattctttatcaagcccagatccaatcgtgcagcatgaggctctgcacatgggtgactacctggatacagacacttgatatcatgcattaaagactcttgactcttagaaacccctatggttactccacagggtaagcaccacccccgccacccttccctgcccactgaatgtggctaaaaggctagacaggcacacaaaggagctactgaggcctctgagaattgaccagtagcaggtagaagggggttgaagaccagaatttgaagtgccaccaaggttgcggtgagtttgccatgtccctgaccctggtatccccagcctggactaaatacaactcgatatccagaggcgagcaagagtgtgggagcatgcccggggcccacacaggccatggagtgctacatagtggacagatctgaagagtggacaaaggcttggaaaacggcaccaaaacccacagcagaatggtagggactgagaacctgaacccaagctggtggagtgcctgccacaaccaagctaccaacaactctccagaggactgaatcaggaaccacagcttcctaacgtaatattcagaatgttcaggaccaatccagaaccactcagcatacaaagaaggtgaatatcctcaactcgcatgggaaaagatgatcaacatcttatctgagctaacagagacattggaattagctgacagactccacagcagctattacaaaaaacactccaagaagtaaggaggggtattcttaacataaagggaatgatgagaagtctcaggaaagaaacagaaggtataaaggagaaccaaatggaaaacttcgaactaaacatacagtaactgaaattgtaaaaacccactagataggctcaacggcagaatgaagatgacaaaggaaagaggcagtgaacacggagagaaccctgggctgcacacccttcctgacaagcacattctggacctaggttccctctcagtgtgtatcaccagctgacctcgaaggatggcaccagcctacagacgggccgtccatctgtagaagggaagggattctttcttgtgagaatgaggaacatgaaacataaccgaaggggactagaaatgacgaaggcagagcagacgggcctccgctgggctgacgcttgtcagcagtaggctgagcatcaggttatgtgggaaaggaggtgggagaatttagggagttcgcaatatcggagccccaagtttttccgtggttcttcatcctctgtaaggagaaaggtgtcatgggcatgtagaaagcactccaggttaggtaagatgtttgtttttaaactgtacagggtaagaaactgctaagagaatagccatgtgtgaaagatgcagccgcactgcccagaaaggcatggcgcgtggtaagaaggacttcacaagagacagccccaaagagttgactcctactcggctctctatataaagctcaaacagccagagaccaagggaagggccgaagcagctccctcaatgtgcaaagccagaatgcaggcaagatcaagggcaacatcctggctcgtttccaggggctgtggcacgacccaccccctgcgacatttcctgtggatccttcctcgggtggtcgtccctttgagatgcacattgtcggctgccatcatctgcctggccctgcaggagcacagccatgggactaagataagtacagaaagtccaagccagatgggcagatggaagtgggctactcactggagctcaacaaagccttgcgaggtgcccgctgatgcaggtggcactcgtccacacagcctgcacaggctggagcagaggccaacgcacagagcagaacctggtcccctgcctgatgacaacttaggaccactgactcttcaaaacggatcccggttccaggaattccatgtcatgtccttaaaacaaggtcactggggctgggtgcggtggctcacgcctgtaatccagaactttgggaggccgaggcaggtggatcatttgaggtcaggagttcgagaccagtctggccaacatagtgaaaccccatctctactaaaaatacaaaaattagctgggcatgatggtgggtgcctgtaatcccagctactcgggaggctgaggcaggagaatcacttgaacctgggaggcggaggttgcagtgagccaatattgcaccactgcacttcagcataggtgacagagcaagactgtcacaaacaaacaaacaaggtcattgggtctctgcttaagtatcaaatataaagactctcttcccccaaagaacagtgagtgcttggccataaatcagccctgatcagctgaaaccaggcatgtgtggtagccccagcctcc

SEQ ID NO: 5536 - DNA, 15192 bp, Homo sapiens
gccacttccacatccagggagccaactagaaacatccccaaacctaaaagcaaaataacctgtccaaacagctttaaaggtccaggaagataaatgtcaagggagctaaaatagtcgacaggccccagaacatagaaaataaacttccctttcagaaagcagccttcacttggtttcgtaagcgtgtaccgctgaagtctgtactgtttgaaggtgaaaagaaacatctgagaagcacctgcctggattctcttcgctccctccggccatgacaacccttatcccgatttctacttcgcggcaccaaagaggaaagcagcattcaccagaacgctccaggctgaatccgttagctggactagggcactctatccggcccacgggaggacgccacaagcccgagttcgggttaagacggtgggagaggcagccgctgctgctgctgttttgcccttgacacgtcgctgggggatagcgcagaccccctctgtcacggaaaagcggcgtcctggagagactgtccagttctgggctgcgccgattcccctccaggccttgcccctaaacgtccccgccccgcgggggcagccctgcggggtctcagagccgcccgcgagcctggcgggctgttacgcggcctggagagaaggggagcgctcctcggggagggggggtcccacctgttttgtcgtcagggggcatcgaggggctacggtggggggatcccgaaatagtgggcgcctggccggctgcgatctggaccgaaggtaccaactgtcacaccgccacctaggctgtgggggtggagccgtgattggagtcggcccctgggtgggggtctccggaccccgggcgggctactgcccaaaggctccccgcctcccgatcgccccaatccgacaccaggcagccttccagcccgcacgcagtagctctgaaaaggtgcccactgacgcctcctccttcctccccgccccaacttagccggggagccccgccggcggcccgccccctccgagcccggatcccggccgccggacctccccgctgtgaccacccacgggagcagcagctctggaggactgcccgccagaaaaaaaaagcctctggcgacgcctgggagcgcgacggaggcgcaagagctctaaccgcgcgaggtgaaaactccgactgcgtcagagccgccccgccccgcctggggcccaccttccgccgcccctccgagctgcggcgaaaacccggagagcggctaggccggggtcggagcccgcgcatgcccagtagccccacgtggtgcaagtcgcctgaaggaaggttttcctctgctccccgagcgaagccccagcgcccaagttaggatggacagcggggagagctggccttcccgccccgatgcccgccgtccctggccggcccgcgccgcacctcggtggcctacaggcagcccgaggccgtgcctcccgcggggtcggggacttggcgagcgggggaaggggcgcggctacgggcccggcgtaccacgtgactgtccgcggcgctccgggcagccatcttccgcccggccatcgggccgcgggcgctcggaaccgacctgggagctggcgggaccgtcctcccccgccacgccctcccatcgggctttgggcgccggactctggccaccgctcggcacctgcctccgcctcgccttggggtataggagtcctgtaccgacccctggcttgcccagaggacaggttctcgcccgggccagaagcaaactgcggcgaaatcgagacaacagaactcaggtggcggagggtccccgcttttccccagaggcggaagttggcgagggagtcctcttccgttatccagcgagagcgctgctctggctgcctcccggttctaacctagtccctgcagaggagtgatgtaccggcagggacattggacagaggccgtgctcttccctgcagcgcataccccgcggcccctgctggtgggccgcttcgatggtgctgaggttcatagtgaatatttattgagcgcctgcctcgagtcccttgggtttcctgttgtctcgggacctgccgcgtcactatcaccctagaatttgttagaaatgcacgttttcggccccacctagacctacagaaccagaaactgcgggtggagtcctgcaatatgattaacaaagccctccgggtagttgtcatggacgcctctatatttcagctaagcagtccattttaataagctaggcagtgaaaatttccatagttttccccaaagcacagtgaggagtcagggattcaaaatgaggcaatctgccccaatgcaggcgttttattgcaccctccactcctggctcctctggttttttcgcccgtaagacacagtactgctcttctcaggaagattaggaaagtacatttgtcacatacgcttttcaagcacggctttaaaataacaactgaaattcagttcaactgcatgttttgagtatctactgggagcaaggctctgtgaagtatagtagccctactggttatgtttatcagtttgcacctaaaaggtgaaaggaaggcttgctttcttgtgatgtaaattttttcaaactaagggagtgccagaaaactgctggctgctttctctcccgtgttggtttctctccagtgctatccagaatatgctgtaagctctggacttcctgaaacaaaggtccaaagtcactctgtcacccaggctggagtgcagtggcaccatcacagctccctgcagccttgacttacagggctccagtgatcctccaccctcagcctcctgagtatctgagaccacaggtgcaagccaccatgcccaggatacatcttactaaggcatctaaagtacttactacttcgtactcatgggatccaatgatgctcacataatgtcatcaatagagtggaccagtgtgatgttttgtggaatgtcagaacaatcaagatcacttcagactattatggcagtgagcaagagaactaatggagcccgtggcaacactgggaagacatattgttggccctgttgggtaacagcaaatcacttctgatggaccttgcaaattggtatggaggaaaaggcattagccagttgtagcaaggaaaccaaaaggtataaacattcactgattgaaaaacaatgtcataaagtcatcccagtatctgtgaggagttggttccaggacccctgaggacaccaaaatcctcagatgctcaagtccctgataaaaaaataaaagcagtggtgccctcgggttcaaaaacctgaacggtggtcttcagttgttcccccaagctcctctatcagaggcccagacactccaagaggctgggaagaggcaagtggctttccctgactggcatcagactcctggatggctgtgtttctgcatactccaccatcaacaatcagaagggcactgctttcttcaagaaggggaccttgcaaagaactgtctcagatggactatctttgagttcatcttgttctgaatgtgagtctgagtctttgtttccagatgacacagtgctgtctgagtcctctgaatcacctgcctcagagctgcagcaaagtttctgctgcccagaaactgaatgggctgcttgtaatgcagattcttcctcctggacaagaagtgctgctgcttctagttcttccagttctaaccccaactgggcctttgtaagggagacttcctttaaggcttctgcaagagctgccaacgttttggatttgactttctgagtccacacacagtagtatgagatgtagagatcattcagtatgtatgctgggtcgttttcctgaaaaattttgtgaatatccaggagacactttaaaactgcacttttacttaattgcagtatctttatagtctccccgtaggccttcatcgccagtttgaaatggcgatagagcaggtaacacaatacccttcttccaaaagacaccatgatatcatgaacattagtccaagtctcaaaccagcatagtattggactcaagtttcgtgatattccatgcagattcaacgttcttgtctccttcagtgacacgggtttcttagcaatatgccagaaggatatcaatcgaactgtagtacacttgacgacaggctctgttgtctagcagataagatttattgacaaattcttgtagctgatatttctcttcttcagaaaaagacactaatgcagcatgattttcttgcttctgactcttttccaaaaaggccgtcattttttaatatttgtcagtccaccaaggattatacttcaaaatctgttcaactgcctcatcttcaaaaaagtcagctagataatgatcaggatcaaacttggccagctcggcggccaggtgcttttgttttcgttctgctgcagggatgaaatctggatccttaataacatcactcaattcatcctgtaactgctgaaacactcctgatcgtaagtttccaaacccatagtggcatgaggattcaaagcactttctgttacctcttcatagggtgtctgctcaatttcccaatcaaactcttcatcgtcaactacttcctcaggaatttcagaatcacctattgcttccacaagtggttttgctgtcccggattttcctggtgccagaagagcaacacatgttcagcccctcaaaatgctggccaggggtttctctgggcaggcgagtggtaaaaattcctttatctgcatcataggacccttgctcgcttccgtatccatattctacaattcttccaggaggggttaatctgagaaagtacggcttggcatagtagtctaggccgacccctcgaagtagacgttgaactcggaggccggggcatagggcacgcggatggcgatggtcaggaaatccggctcctggctgaggctgaacgccggggtcagcatcgcggcaccagacgcaggggccagcgcggctcgccctcgctgccgcggcggtcccaccaagcaactctctccaattttacctttttaaaataaaagatgtctgggccaggcgcagtggctcacgcttgtaatcccagcactttgggaagccgaggcgggtggatcctgacctgaggtcaggagttcaagatcagccccgccgacatgacgaaactccgtctctactaaaaatacaaacatcagccggacgtggtggtgggcgcctgtaatccccactactcgggaggctgaggcaggagaatcacttgaacccgggaggcagaggttgcaatgagccgagatcatgccactgtactccagcctgggtgacagagtgagactctgtctcaaaaaaaaaaaaaaaaaaaaaaaaaaaagtctgtcttccaggacacagaagcctcctatacacacattttggcacttgattatgttatgtcttttacagttctctgcatgtttcttgcaggtaagtcttgattcttcaattacatattaaatttctattgaggatatatatctagctttcatctttcagagtacctagcataggacttggcaccaagtagcccatagtaaacagttattcaaccataatgtatgattttcttttctacttttcactggtatgtttttgtttaaaaagggtaaaccaccagggatggaaatgtccttgctatgttatccttcttctctaattagcaaccacccttcacaatctgccacattacatttaaaaaggattttcaaattagacatttatgcctgggcattaaccagggactgatgaatcagtgccatcagcagaacactgccctgactggcagacatggcaccattgtcaagacttgtaatttactcctggcttttcaaatagtcagtgtgtaactccaggcaaggtttaattatctcctgttaaaatgggaataatatgacccacccccactttgcttcccatgggtatcatgagaattaattaattattgaataagaatatatgtctataaaatattttatagttcattagaggtaaacaaatgcaaacgtaagatattgttcaatgtattatgaatgttcattgttgctgtatttagtacaaagtacctgtattatatcaacagtggtagtacacaaaataatgaatacatgttgggtcagcacctcctccaattaccacttgcaaacaagtcctggatggccagaactaattggaaggttgagacaaaaattatatctcgcacactaaagaaggggagattgatacagcgcgctcacctaaatttcgtagtgccttcatgaactcttcaaaagcttcaaatctaggctaggctacaggaagaacagcagcaactgaagactggcaccttttctggaacctcagcagcaccttccttgtttcgtaagatttcgaagaagcatatcaaaattcttccacccattccttcacagtataataggagaaaacatctatcctccgttgacacctggaagaatgagattccaactcactccaggacatggccagaaaaattcaacaaaagatttgctaaatcctctgcactattatctagaccaggatttctcaacctcagctctgtggacatttgggccagataattctttgttaccagaggctgtcctgtacatcatcaggtgtttagcagcattcctggcctcaaccaaatggatgccagtagcacctcccccacccacttgtgacagccaaagatatctccagacattgccaaatgtcccctgttatggagaatcatcctcagttgagaatcactggtttaggcaatgatcaaagtggggcaactaaatcaaaaggcactgcaatcttaagttgatcaagcatccttctttgaaatcactcagcactttcatatattgcatttatatcttaggtattcatattctaacaattcagccaatgttttttgagttcgcaatggacaaggtacaagatcaagtaagtaattctgtgtatccataaaacagaaatggatatggtatgtcccagttctccacagtaggcatttatgttattcccatcccaatatttagccctgatcagggttgtcaaacattgcatgggacatacttatcctaaaaaattattcattatttatctgaaattgaaatttaactggatgtcctatgtgtgtgcatgtgtatgtttgtttgtttgtttctttttctaaatctgattaccctatcctaacagactcaaggttttttccctgttccacaaactttatgacttgacttcattaaaaataataaagaggaataactgcaaaggctttaaaaatgctgttagaatgagtagcacaactgaatttgaggatacattttctttgaaggatgtctattttcctactgaaaatagtggcaaactccttagaactcattcaaagcctgatgggattcattgcctgatttatttaaaaacacttctgatgctcacagactatttatcatttacacagcaaatgatgttcttctagtattcttgttgggtgagttagcattgtggaaggacatagaggagaatcagacacaaacttcttataacctcataaacaggaagaaagggagcagaagcatagactgactttactttcactcagcttaccttcctagttctccaggtgtggtcctcagaagaggaatatcatgtgacctgggaacttgctagaaatgcacatccttgggacccaccccggacctactgaatcagaaactctgagagtgggtcctagcaaccagtgttttcacaggccttccaggtgattcttccgcatgttcgagtttgagaacaactgctttagagccctggttcttgaccctggctacagggtaaaacacctggggagtttttaaaatactgatgcatggggtccattccaagggagtctgatataattactatggggtgcagcccaggcgtaaacattttttaaaaactcctcaaccagaataacggctctacagaaattttatcaaatgccaaagaaagagttccttattttgcaactatagtgctttctactctggccctaatcaactttcataaaggcagaatggacagacattacgtgttttaatttgaagactaccaaaaggccggccattaaactaggtatatgggctcgtcctcaaatccctaaatctactccttaggacctactatagccagtgtcatataatagaaaagtcacttattgtccaccagaccctgccctaatatttgataacctcttggggcctcattttcttgtgtctacactggggatgatattaactcttcacaggatttggggaattataaagaaagaccatgtagtaaaggcaggaagatcaataatcaataatcacatcagaacctgaagggacttcgtaccattgaagtgaggcagaggagagagaaatttagaaggacaaattcacaaatttcaatgtgtttctataataactacttaaattattttctctttgaattgcctcactgttgtgtgtgtatgtccccactcccacctgtcccattattttcctgttttcacttgtaccttggcaacccatctgtggttttggccaagctgttttaatggcattgaacctggtagtttttttaaaagagtgtggtagtagttatatatggctcgataactcctggggctacaacaaggttaatgcgacagtttttgttgtttaaaaaacatgcttgtctgacaagtcaatcattttaagccccttgttcacttcaggatggttgctaaaggcttctctgtgagctaaaagctctcgctgttaaggggctgcctgccctgactgtatgcattaaatggaacagttctctacatggtttcttactacagatgccttgggatatatggacactggcattacctgctgcaacaggtcctctcccagggtactgctgagacctaagggcttaaatgctcaccaaaccaagtgaccttggagggctggtcatggtgggcatctgggagctgggaaagagcattggagaacttcatagggaaacctagtaggcaaaaatgaaagaacccataagggccattggcatgagccatagctaaaggccactgggttagctctcaaagaaaactgcaagattgaagcataaattccttcatcatgaaccagaagtcatggagtggagccaggggcaagaaagagaaagatgaagaggtagaaccaccaggataaaggtgccaagaaaaacagtgagagcaacactcagggaaccagagacaggaacacagctgggaactaggaggagaaaccaccacagctggagcgcaaagtggccaggtcagaaaagcctcatggaatcctggttaactgaatgtttctattgactgaggccactgcttaagccctgtattcttttttatttcaatccccatggttagaaaaatagtcctaaaatgggttcataccctttcctatcctgcaagatcttaaacatcactatcttttcctgcagtagttaaaagcatgggctttggaatcagaaactgggcacaaatctgagccctgctacttattaactgtgtaacattggtcaaatgaataaacttcctggagcctcagtttccttgcctgtaaaatgtgagtaacaataccaacttattttcaggttgtgagcatttctccataataatccacataaaacacttaccagagcccttggcatactgtgtgagcatgtaataatgttagctgtcattccaagacaacatgttggaataatctactttttccatcactatatatctcattttccttctttttcttctccctcaaacctgtccccattccaacagatgttttggcctgtgttcctagcctccagtgacagcagaaagcctgttagatttcctgcctttgtttcccaaaatttgagccccaagaaactgggacaagatattttcctgagacaagatatctcaggaaggggaatgagtggagcttcttttcaccccacactagaaagccattctgtttagaaaaaggagacggaagggaaagaaaagggtgctataccagttttccagtatcaccgtcagggagaaagcaaggccggagagtatctgggcagatgtaactataagcagcctaataaaggttcccaagtccaaaccatgaatccaaacggcagagctgccagacatgaaaggccttgctgcccttccaccccacaatacttcacctctggaagccttgacaattccagggagtatttgcaaaaccctgcccccacccaaaatttttaaaatactgcatatgagtgagtaaaatgatgccgagatttttaaaaggacaagcttaccatcagataggtagaatgagtagtagtggcagcggtggtggtagtgatatagagataaaagagttaagtggagttactgaaatgtgtagttatatttctcacactctggtgtttgtggatttgtgggctgagattcttatcaaattccggaacttgcaatgtctcaaggtaattgtttaaaatattaattgttttactcacactgcaaatgttgatatagatgctggggtggaggtggggcaataggccagaataagcccaagaataccttggaatttgctgaatttctttctttttgcataatcttattcacacattaacataatatgaaccactctggctccatgagcagcacagaagagactttctgcaaatgtgattattagggcaaaagttaggagattttttgcccccagcttttctcctctcctaaaatctttttttttttttcatttctttgtcagtgtctttaatttttttagctgcatttaaaaggctttctattatttctgcatgagtaagagcatgtgtcatgtcagcctccttgtcagcttctgtttcactttcattaaatttgttgattgagtgtaaagaaggaggcactgtcatcatttccagatttcatagctgtaggttagatctctctcggagcaatgccatgattactgctgcaattttgtaatggagccctggagagacagggatgaaaccagggaaggctccttatccctttcgtgggtccagggaggcagaaagagaggggaggaggatgtttctgtttcacctctattcattcattcattcatttgcttcacaaatattgagcacctcctgagtgacagacactgatttgggtgctggaaagcataagcagccctggtgcctgtcctcacagagcctatggtctgctggtgagacggacttaatcagataaacacactaatgaatgtatagttgcaccaacagatcctcatttaattgagctggactaggacctaggcatcagtattttttttataagcttcataggtaactctgccaggcctgggaatcactgggctagaccatgcaagttctaatcatataggctctactcaagcattaagcattttgattttatctttcaagctgtggtgaaaacgttactgaagagaggtgatatagtaagatgctcacggtttttaaaattaagcttttttattttgaaataattatagactcatatgcagttgtaagaaataatacaggggaatcccatatatcctttatccagtttccccaatggtaacatcttgcaaaactatggtacaatatcacaaccaggatattgaccttggtgcagtcaagataaagcattttcaacaccacatgaatccctcctgttgtccttggatagccctccccactttactcctggtgaccactaatatgttctccatttctataatcttgtcttttcaacagttatataagtggaatcatatagtatagaacctcatgggattggctgttttctctcagcatcattttctggacattcattcaggttgtttcacgtgtcaatagtttgttcctttttagagggctgactagcggtgttccatgtataggggtgccatagtttgtttaaccattcacatgttgaaggacatctgggtctgctccaatgttcagagattttaaatagagctgctatacacatttgtgtataggtttttgtgtgaacatgaagtctttgtttctctgggatacatgcccaagtgtgcaattgctgagttatatgatagttgcatgtagaaactatcatgcataaagaaactgtcaaactatttccagagtatctgcaccattttacattctcaacagtaatgtaccagtgatccagtttctcctcattctcatcagaatttaatgttgccactgttttttatttcagccattctgataggtatgtggtaattgcttgttgtggtttgctttgagtttctctaatggccaacgatgctgaacatcttttcatgtgcttagttgccatctgtatattacctttggtgaagtgtctcttcatgtctttggcctattttctaattggattattagccttaatgttgagttttgagagtttacttttatattccaaatactagtcccttttgtcaaatatggggtttgcaatttttttcccactctccaatttgttttttatcctgtttacagggtctttcacagagcaaagttttttaattgtgatgcagtctaatttatcagcttttccttttatggaccatatttttggtgtcgagtctaagtcgtctttgctgagtcctacatcatgaagattttttcttactaaaatttgatagttttaaatgttctctatttaagtccgtgagttattttgagttaatttttgcataaggtataaatcttaggttgaggctcactttttaatcttaaggattgctcagcatcatttattgaaaaggctatcttccctccattgaatttcttttgtacctgtgtcaaaacatcagttgcatatatttgtgtgtatcaatttctgggtcttctgttctgttcagtggatctatgtgtctatttctctgccaataccatatagttttgactatagtagctgtataataagtcttgaaacccttgaaaccaggtaagactggtccctttcatattagccttccttttcaaaattgttttagctattctagttcctttgcttttctgtatacattgtagaatagtgttgtctatatctatttttaaaacttgctggaatttttttttaagagacagagtcttgcactgttggccaggttggagtacaggggtatgatcatagctcactacagcaccaaactcctgggctctagcaatcttcctgcctcagtctcccaagtaggtagaactacatgcaactgccactacaatcgtatttaaaagtaaagttaaaaaaattttttttgagagaagatctcactctgttgactagtctggtcttgaacacctagcctccagcaatcctcttgcctcccaaagcactggaattgcaagagtgagctaccaggcccaaccagtatgttatgtgtgcagttttttgtagatattatttattatgttgaggaaactcccctctattgccatttttctgatagtttttaagatcattcatgggtgttgaagtttgtcagagtctttctgtatccattgattgttatgatcaagaattttttctttagcctgttaatacgatgtattaaatagcttcattttcaactactgagccagcctgaaataaacctcgcttggtcatgatatattattacatatgctgctgaattctattttctcttttactggtcttttggctggagagagtaggcttttgttggggctttacttgtacgtgcacattgttatttctgggttgtcagcctccttctctccaagtctgggatatatgggacaaaaacataatccagggagcccaccaccttgttagactttgagtccctagatccctaggtggtctggcttctttttttcacctttgaaaatcttatgtttgttttatacataatgttgagagtttttcgttgttcttagtggcagaagtatagaaagatactccatcttctcaaaaatagaagttcagattatgttttgaaaggcactgtaggcaggccagggaaggcttgtaaaaggctactgcactggtccaggtgaggggagttagtctggtagaaggctgtttcttccaccattctcccctcacattccactgccccatttgcatggagctggggttctactaccccagtagggcagcaagagagaaggagcaggcaatatcttggagcattacaccatgataaagggacaccaataccctccagatgctagctgtttctttctagagcttttaaacattctccttcagcagaagaaataagtcactcctgaaagcatcctaacaatgtgcatttctccaaagtttccttaacacttcacatttaacatgactccaggtataagcaacattaaacaagtcatatcttatgttacaacttgagtgaaactttaatgatgctgaatttgctaatttgctctggtataatgtatttcctgtttataatcccttttggctaatagcactaatcaacagaaaacactgacagactgcacaatggcaacagtaattctggacagagatagttttattatctacagatgaatccatgtttctaaaacattatttactataatgtaaaatatgggttgggcgtggtggctcacacctgtaatctcagcactttgggaggctgaggcgggcagatcacctgaggtcagcagttcaagcctagcctggccaacatggtgaaaccccatctctactaaaaatacaaaaattagccaagtgcagtggtgcatgcttgtaatcccagctacttggggggctgaggtaggaggattgattgaacctgggaggcagaggttgcagtgagccgagatcataccactgcactccaacctgggcaacagaaggagactctatctcaaaaaataaaaataaaaataaaaataaaatgtagtagataaaggtcataatttctatgcaccaaagcttttataggaggcctgtattttagcaatcaacctgtccttattctgttcaaattcaagggcacttgaatcactttagatggtgtcacctacattgggaagcaatcacagtatagatattttttcttattatgtttgcaaaataaacttcacaaaattgtctagcaaccttgtgaccacttgttttcttttattgaacataataatccttttaac

SEQ ID NO: 5537 - DNA, 4594 bp, Homo sapiens
gcacgtgtgcgctgcctgcctcttgcgcgcccacgaacgtcggcctcgcttggatggcgcggtctcggctatcacacctggatcctctgcagtccccccgagtccagtgcccaccgtcccgggtcccaaacaactcaggaaggagggggacgtggcgggaccgggcgcgggtccctggagcccgcggaagagctggaagtgcccttggtactgaggcgccgggtacatcgcggggtacccggacagtagcccgtagggggcgcccgacgccgcaggcactgaaagcccggtccgcgggaagtagccacccgaggagccggcgccgggccccgggtacaccggttgcagcgccagcgccttgggctcgggggccggggctggagccagggctgggcccacgaaggcgtcgggagcccgggctcgcagggcagggcgcacccaacccgagtgatcctccgaacccaaaagcccagccaccagccccgggccgccagcatatgcgcccagagtctcgggcggcggcggatattgcgccccggaggcctcgctgggcgccagagcgcaggtctggggcgcgccaccgggctccgggcccgagaagttggtgaggaggagatccaggtcccaggtggcgtccgcgcccctctcatcgtcctcttcctccccgggctggtcctcagacttcacgtggaggggcggctccgtggggtcaggaggacccgggcccatgtcctgcgcctcttcggagcgccaccactgcgggagggagcaggcagctcgaggttcggtggacactggggtgccctgcccagggacatcgcgggctggacactctgacgcagaggctttggaaaggggtcttgtttgcctgtctgtctgtcccacttccccaacactgcccctctaaccgcccctctccccgctccccccccagctccagggacagaaaccgatcaggtctggctggagacaggagataagacttccactatctggaaccacactcggggatgggggaaggggtagcagagctgctggagatggaaaactggcaggggacgggggagaggatgccagccttgacttagttttcccccagaacatccctctccttccctgtctcccaaaacaagattaattccgaaattttggatgtcccccagacacactcatcatttcccgctgatatctggaagattgtctgtgagcctagatctcgttcctttttttttttttttttcttgagatagggtcttactcttttgcccaggctggagtgcagtggtgcagctcactgtatccttaatctcctgggctctaatgatcctcctgcatcagcctacggagtacctgggactacaggcacacgcccccatgcctggcctaatgtttttggtattttttgtagagatagggtttcaccatgttgcccaggctaccttcgttttctattaccgaaatagatcacacttagaacctcaaacccctagaccaccctcctcaccccctgccagactaagctgagatctcctctcctggactgagcgtacctcagtcctggttaagtctcttgatttcaggtcaagatgcaggtctggaccccaagatctgtgactgtggccctggattccagccagcccacctagaccccaccttctaggccccaccttgaggaagtcatcctgtgtgtccgggaaggggcccagggcggtcagtgtgctgatggagggcaaggcggtctcggctgtggccatggctggctggtgcccaccctgggcctcaagcctcctcttcctcggctgcctcgtgaactctgaggctgtgatagccccttcgagggctcctctctgtccttagctgattggctgcagcctctgataaggcaaagcaaggcaaggcggcgggggggcactgtttctggggcacaaacttcacgttggcctgtctggggctggggttaaagactaaccctgtgtccaaagccaagtcaaatatcaagggttggggggttcagggtttgagggtccaggtgctgggtaaaaacagacattgggtctccaaagaaggagagacttgggggtcttccctcagttaactttcctggaaaaggcagaaagggtattctgggaagaagctgtgggaccccctgtccccctgattgaggctccacagccctccccctccccagtaaacagcaacaaccgtgctgatggcgggacttggcacgagctccccgccaagcattatcagacaccccagacgttggaggctgctatcaggtgggggcccaggccagctagagctctgtcctccggtgaaggggagggctgggagttgggtcttcaaattagcctggcgttcaatttgcctgggttgggacctcccagggtctcagccctgcagcaggaggaagcccctgacaactggcccaccattgtctactggggacccttgggtggcactgcatgggactgcatggaggctggttcagtgccagctgctttagtgcgatgggggcagccaagggaaaagtgaccctctctcctcctgggtgggataggaccgttggatcaagccacaggcagtacctgacctgcaggagaccagtgccctggctctgggcctggctgctccttgattctgcccaacatgaggagaggatctgagtttctacaacaggaacctccactctggtgccctgggagcctgggaaggggacatggatacgtattacagacacataactcatagtcactcattggaagactgaggcaggaggatcacttgacaccaggatttcaagaccagcctgggcaacataaaacctatctctccaacaaaaagctgtgagtggtggtgcatgcccatagtcccagctactcaggaggctgaggtgggaggattgcctgagcccaggaggtcgggactgcactgaactataatcacaccactgcagtccagcctggggcacagaaagcaagactctgtcgctggaaaaaaaaaaaagttgggtggccatctttattcctggcagatcaacctgggtgacacaaacaaaaacaaggccaggtgcggtggttcacacctgtaaccccagcactttgggaagccaaggtggggagatcacttgaggtcaggagttcgagaccagactggccaacaggatgaagccctctctctgctaaaaatacaaaaattagctgggcattgtggcacatgcttgtaatcccagctatttgggaggctgagctggagaactggttgaaacttggaggcatggggccaggcgcagtagctcacgctagtaatcccagcactttgggaggccgaggcaggcagatcacctgaggccaggagttcgagacaaacctggccaacacagtgaaaccctgtctactaaaaatataaaaataggccggggatggtggcatacacctctaatcccaggtacccgggaggctgaggcacaagaatcacttgagcctgggaggcagaggttgcagtgagccaagatcatgccactgcactccagcctgggctacagagtgagattctgtctctaaaaaacaaaaacaaaacaggcttggagcagtgagtagtggctcatgcctgcagtcccagcactttgggaggccaaggtaggaggaatgctcgagcccaggagttcaagaccagcttgggcaacatagcgagatcccatctctaaaaacaaaaacaaaaacacagttactcacaggaccatgcaattacataatgacatgagttcctgttccctcagtcacactgatcatataatccgtgcacatataattgtgtgtctgtctatgtatatggactatgcacagacatacaattcccaggcactaaaacacaaccctatgctatattggttacacaatgtcatagccaaacaatctctaaaacacagaattcataatccacaggcaggcacacagttatacaatcctactgacacaatttagccgtaattgagcagacacacatggggagtcagatacattgtcacagaactttttttttttagatagtgtctctctctgtcacccaggctggagtgcagtggcatgattttggctcactgcaacctccacctcctaggctcaagtgattcctctgcctcagcctcccaagtagctgggattacaggtgcctgctaccacgccacgctaattttttttttttttttttttttgagacagagtttcactcttgttgcccaggctggagtgcaatggcatgatctcagctcactgcaacctctgcctcctgggttcaagtgattctcctgcctcagcctcccgagttgctgggattacaggcacccacaagcaggcctggctaatttttgtatttttagtagagatggggtttccccatgttggccaggctggtcctgacctcaggtgacccaccctccttggcctcccaaagtgctgggatgacaggcatgagccgccccagccagtcaaaacctacactttatacagtcacaccaccggtcacttttacaatatgtaaagtaattatttagtcacagttgcatagctaccagtgcccaaccgtaggggatgca

SEQ ID NO: 5538 - DNA, 25134 bp, Homo sapiens
ctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccaggtaatgctacgatgcttaacgtcccgatgacgtcataggtcagcgcgcgctgccctggtcgccccccaagcccataaatgaccatttccggggacctcagcgctgggtcccctttctcggttgcagtctccatctctatattgggactcactgggttatccttctgtgcctcagtttcctcctctgtaaactgaagaaacccgtctcatggaatcttttgaaaataaccagatcagccaggcgcggtggctcacgcctgtaattccaggactttgggaggccgaggctggcggatcacgaggtcaggagttcgagaccagcctgaccaacatggtgaaaccccgtttctactaaaaatacaaaaattagtcgggcgtggtcgctggtgcctgtaaacccagctactcaggaggttgaggcaggagaatcgcttgaacctgggaggtggaggttgcagtgagccgagattgcaccaagtgtgaatcaaccgtccactttctgctattctttgttaaataaatacttttaaatccttactggataccaatgctctccaacaggacctcctaccactacccctcttttgtcctatattttgccacataggtaaaatataaaaataggtaatatagaaaataaaacacatactgctgtattgtcaggtagtgataggatttatcactacctgacaatacagtatgtgtttgttttatatatttagggtgtacagcgtgtgttttgatacacatgtacccagtgaaataataattatgacagtttttttttttttttttgagacggagttttgctgtcgttgcccaggctgaagtgcaatggtgtgctctcggctcactgcagcctctgcctcccgggttcaagcgattctcatgcctcagcctcccgaatagctgggattacaggcatgcaccaccatgcttggctaatttttttgtatttttagtagagacggggtttctccatgttggtcaggctgatctcgaactcctgacctcaggtgattcgcccaccttggcctcccaaagtgctgggattacaggcattttcaccacacatggccaattatgagagttaagcaattaacctatccattgccttccataattaactgtgtgtgtagtgagagtatctaaaatgtactttcttggcaaattttcaatatactatgcaaaattattaacacaaagtatacgttactttttgtttgtttgttttggctggctgcggtggcttatgcctaaaaacatgccctttgaggaggctgaggtgggaggatcacttgaggccaggagctagagaccagcctaggcaacatgtcaaaacccagtctctcaaaaaaaaaaaaaaaaaaagaaaaaaaggaaaaaaaagagaaaaggaaaaaaaagaaaagaacaacaacaaaaattagccagatgtggtgcatcatgccagggtcccagatacttgggaggccaaggcgggaggatcattcgagcctgggaaatcgaggctgcagtgagccatgatcaccccactgcactccagcttgggtaacagagcaagaccctgtctcaaaaaaaaaaaagccttgctttcctgacccattgatctgtttgttttttgtcctctgtcagcagcatatcagcctgatgacatcagggactgtatctgtccccatcattgctgtaagttccccactgctgaataaatacgtttatttattcagtggtgaataatctaagcctagagtcaatgtactagttattagagcagatgccattatcgcctcttggatctcattcccagggtgttcattgggcatctgtcaaaaaaacaaaattacaacacatttagtttaaagatcttaattgattttatttgcaattctacaatcgggcaacacttcatttcacaaaatgaaactaattttcccatgagctgagcaggtaggttggttttacaggcagaaaaagggccaagtaaagcacaaacagaaaataaaacgtggaggtcaggtgcagtggctcatgcctgtaatcccagcactttggaggccgaggcaggcagatcacccgaggtcaggagttcgagaccagcttgaccaacatgataatgatgatgaaaccctatctctactaacaatacaaaaatattagccgggcgcggtggcaggtgcctgtaatcccagctactcaggaggttgaggcaggagaatcacttgaaccagggaggcggaggttgcagtgagcgaagatcacaccattgcactccagcctgggagagcagagcaaaactccgactcaaaaaaaaagaaaaaaagaaaagaaaacttggattggtcattttaaagtttccttttggagtctgagtcttgctctgtcacccaggctggagtgcagtggtgcgatcatagctcactgcaacctcaacttcctgggatcaagcaatcttcccacctcagcctcctgaggagctaggatcacaggtgtgtgccaccatgcccagctaattttttttttccagagacagggtcttgccttgttggccaggctggatttgaactcctgaactcaagcaatcctcctgccttggcctcccaaagtgctgggattacaggcatgagccaccaccgcactcagcccaaagttacttttcttgtaaaggttaaagcagagaggacatccttatcatgatggctaaaactgacctggtgggagacttggctatcccatctctctctctcctgattttgtagaaggtcagataaacaacttagtttctttttgatcacgtaaaactttagcatgagtgactccattttggtttagtttgttgggcctggtgtaggaagtcagtccaaagtaatagcctcctataagttttgtataacacatcctgtgtccagattggtgggttcttggtcttgctgactccaagaatgaagccacagaccctccggtgagtgttacggttctgaaagatggtgtgtccagagtttgttccttctgatattcagacatgtctagagtttcttgcttctggtgggcttttggtctcgctgacttcaggagtgaaactgcagacctttgcggtgagtgttacagctcataaaggcagtgcgcacccaaagagtgagcagcagcaggatttactgggaagagtgaaagaacaaagtttccacagcatggaaggggacccaagcacgttgccgctgctggctgcggtgtcctgcttttattcccttatttggccccacctacatcctgctgattggtccattttacagagagctgattggtccactttacagagtgctgattggtccgttttacagagtgctgattggtccgttttgacagagtgctgattggtgcatttacaaacctttagctagacacagagtgctgattggtgcatttacaatcctttagctagacaggaaagttctctaagtcccctacgcgattagttagacacagagcgctgattggtgcatttacaaacctttagctagacacagagcgctgattggtgcatttgcaatcctttagctagacagaaaagttctccaagtccctactcaaccaagaagcccagccggcttcacctctcaatcacccctctaaacagaacaccccaactgctgttgggaatttggccgatgaccactctagctacttcctgctggaagaaggggccctgcaattgtagtgtcctccagaggggaactctttaggccagtggaagggccagtgggtcggtccaggggtcctcagtagaagttgttagttgaactcatttggggttccatttttaagaccatctgtagcttgatggcctcgattctagaagaaacaaatttgacaagaaggttaaaaatgcagggcccaaaggtgagtaagagcaagatggctgccacaggacctaggggagaagccatgttgcccaactccagaggttggtattagagttcgaaaggcattgtctgatttcagaagccttttcctgtaaatgccaggtggcatctcgtgctatccctgactgtttagtgtaaaaacaacactcttcccctaagaaggtgcagagtcctcctttctcagcagtgaggaggtctaggcctcagtggttttggagagttgctgctgccaaagagtatatttgggattgtagagtaaggatagattttgttatttcttacaaactgtctgagaaatcctttgaaggtgtatggtagtagaataatgaagtggataaactggctattccggttcctgtagcagtagccattcctaaccctataagtagggatattagttgtatggccctgcgctgatagacttgagctttgaggggcacagatacggtctgatttccataagattagaagttaggataatacatgttacactgttaacttttttagcaaactttacttttgttgaaaaccttgtaagtttgggatttcaattattctttgctattagtaagaccttgttcagtccatattaacttagaattggtatagatggctgcttcctgattctgtaagtactttaagatttggctgagtggaaacaactggcatgtttgagcagaccaattattaggcaattttcctaactctgcatctacaagagtttccttatcacttactgaatacccattgtgtctttttcccttaatcgcctgggaggaaccatctatcatcctgtcctgaagggagttcctcctagatctggtcagacctttgtatggtaattaattaagatttagatctcctgttaggaaacctgctgggttaaggatttttgataggaaggctacaggttgtcagtggcctcagtgctttccggctatgcccttgtttacactgacaacaaggtggtattggagtgttataaggttacagagaagaccttcaattatcaattataggttttaaatttacgctagggtacacttttttttttttactacttctatctccttttctctttgacttcttctttgtctctgtctcttcctctctgtctccttctctttgtctctctgtttcttcctctcttctctctttctctgacttcctgtctctttctctctttcctttctgctggtctttccctgcctctgctagccacttatgctgctgttctcccctcttcttcccatttttgatggcttcggctgtgtaagactgccacctccttgggtttttgcactgtgtgcaataactccatggtttccttgtggtatttaatgggggttcccccagaggttagaaactccctttctttccatattgcggcatgggcatgtaggattaggtaagcatacttgctatatgtatacacatttattctttttccgtttcccagttctaaggctcaggtaagtgccactagttctgctaactgggcgctggtccctgggggaagaggcttactttcaagtacagttacatcactaactatggcataacctgcccttcatatcccattctccacaaatgaacttccatcagtatataggttaaggtcaagattagctaaggggacttctaagagatcctcttgggcagcataattctgggctataatttgttggcagtcatgctcaattggttcctcatactctgggagaaaagtggcagggttgagggccacacatgtgcatatttgaagcaccagcccctcaaggaatagtgcctggtatctaagtaggcgattgtctgatagccataaactttctttagcacctaggttgccatttacatcatgagtagtccagacagtgagatcctttccttgtattattttgatagcctctgacactaagacagccactgctgcaactacccataagcaatgaggccagccatttgctactacatcagtttccttacttaggtatgccactggttgtggggttatcccatgagtctgagtaaggactccaagagctatccctgctctctctgtgatgttttgtcctgtgggaaggcttaaagctggagcttgtactagggcctgctttaaggttttgaaggctgtttctgcccctggttcccattctactagatgagtatttgccctctgggtctccttgattagagtatagaggggcctggctatctcgctgtatctggggatccacaatcagcaaaagctggtgatttcaaggaacccctgcaactgttaaatgtcttagggtgaggataagccagtataggctgtatttgttccttgctgagggccctgattcctctggctaagattaggcctagatatttgacctgctgtaggcaaagctgggccttcgacctagatgccttgtacccttgattagctagaaagttcaagagatctagagtagcctgctggcatgaggcttctgaactagtagccaaaagtaaatcatccacatactgaaggaccagagcacctggatttgagaagtggcctagatcttgagccagtgcctgaccaaacagatgagggctatccctaaacccttggggcaagaccatccacgtaagttgggacgtgtggtctgtgggatcctcaaaggcaaagagaaactgagagtcagagtgcaggggaatacagaagaaggcatccttgaggtccagaacagtgaaccattctgcttcctctggtatttgagagagcagggtataggggttggatacaactggatatagaaaaattattgcctcatcgatgagtctaagatcttgcactagtctccattgaccatttggtttttgtactcctagaattggggtgttgcagggactgctgcatttccttactaagccttgagcttttaaatgtttaacaatatcctgtaatcctttataagcttcaggctttaaggaatattgcctttgataaggaaatgtggtgggatcttttaccctgatttggactgggtgggcattttttgcccttccaaattgtccttccaatgcccagacttcaggcttgatttcatcctcaagtaggggacaacaaatgggaaacttgttccccatattcatgtagataatagctccagctttggctaatatatccctccctaataagggtgtgggactttcaggcataacaagaaaggcatgtgaaaagagcaaagtctcccaattacaactgaggaggtgggagaaatacctggttacaggctgtcccaggattcctcagatggtaacggacctggaggacagctgttcaggacaggaaattaacactgagaaagccgcaccagtgtccaggaggaagtcaatttcctggctgtcaatggttaaagttacctggggctcagtgagagtgatgacatgagctgacacttgccccaggcaccctcagtcctgttgttggatcatctggttgggggcttctgtcccagagaagctttgtcctctggggcagtgtgccttccagtgattgccttggcataggggacatggacaagggggcagcttgtttctcattggacaatcttttttaaagtgtccttgcaaaccacactgctaacaagccatactggatgattggcctgctccattttctgtcctctctgaaccaccaaggtttgtttgtctgagggccatgactaagtctgcggcctttctctgatctcacttttccttttgggcctgttcctcttggtccctgttatagaacagtgaggttgccaggtttaataatgcctctagattttgttcagggcacagggctcacttttggagctttctcctgatatctgtggctgattggataataaacttatcttttaggatcaattgacccttgagtgatttgggtgacaggggagtatattttcttaaggccttctgtagccactcgaggaaggcagaaggattttcttcctttccctgagttatggtggacatcagtgaataattcatgggcttcttcctaattatccttagtccttctagaacataggtcaacagatgtttatgactccagtccccatgatctgaattgaagtcccagtggggatccatactggggatggcttgctgaccagtagggaatttgtccctttcttcagctgtcattctatcatttacttaactaagataccaggtacctccaaagtcttgggctgcagctaaagctgcattattttcattaaaggccagggtttgatctaacaatagcatgacatctctccaagtgagattgaagatttgccctagaccctgtaggacatctatgtacctatcaggatcatctgaaaacttccccaggtgtgccttgatctgctttaaatcagagagggagaagtagacatgtacccatgttaggccaaattcccctcccgctacaatttgaaggggacataaccgacagcccaggggagttttgtggtcctttggagatttctttgcttatttccttctgggcaggggagattagaggaggcttgtcactaatacgaaggggagctgtagggaggctaggatatgggggtaagctgaaaggttctcctgtgggatgtaaattgcaacctttgcatagatgtgtattctcctttaatgaaaggaaagcttggacataactatttcactccatttgcctttctcttacagaaaaggtcaagctgcaggatagtattgtaatttgtacttccctcagatggccatttttccccatcagagagagaatattggggccaggccacagtgcagaaaaaaatgagctgcctctttttcagggtttgcaggtcagactggtcccaatggcctaggatgcatttcaagggtgagcctgttgatgcctgtttcccatctgaaagacaaaaccacccacgattttggtgtgtttttcttctccccctgcccaagaatccacaatggtccttgggccctgctgatcggaatagttgcgctcactgatgcagcagcagaaacaacccctgcccaagaacccgtaatggtcactagaccctgctgattggaatagttgcactcaccaacgcagcagcagaaacagtagctttcctcccagaccacaaggagaaccgaggaaggtcggatttagtggcccttaccaacgcattctcaaaaaacctgcacccttgcctgtcctcctagaccacaaagatgaccgagaaaaattggatttagtggcccttaccaacacattctcgaaaacctgttacagtcctaagcattctccttttagtattgggaccttaccaatttcctacaatgatgttatgccccaaaaatgaagtggagggccataccatgagggaaggaagggatctccagggttggaagagtgacaccttttgtcctcacttatatgaataggaagaatacaatttctgaggctccccatatcctagcttcaggaatagcttttattagtcctgcttgtctgaggagggatcctaaaattccagatagcccccctacaacagggctttgggcaaaaattatgtctttctgattagtgagcctaggtgcctaaagaaggtaacagagtcctgaagtttatactagaagtcattcttataggagaaactagaaaagcaccagagacagggagtggtttttagaggtgggactagcctcggagaagagaggcgagaggaagtttgtctgacaggcattaggacccaggaggcaagggtcaggacagataggatagatgggcgagtctcacttgggcgacatgactttgagagttctgctcatggccacaggatcaaccaacttgttgtcaagaccccagagctgaatggctttcctgtcaaccctcgactcagcccagaagtacaggaaaagcggaagctggttccaggcaaactaacgctcccaactccaaaaagtcggggtttgttagagagccccttcccagaaagcctcacacccatgtctttagtccagcacctgcgctagtcgcttttaactggccgacaggtgcccggtatttagcccccaaattctaaggaaaaataggacgaatagcaagcgaaaggggtccgatggtactcaccgcttggtgataggcgatagtctcaccgcttggtgataggcgatagtcccttcgtggtcgccaaaatgtgtccagtattggtgggttcttggtctcactgacttcaagaatgaagctgtggaccctcacggtgagtgttacagttcttaaagatggtgtgtctggagtttgttccttctgatgtttggatgtgtctggagtttattccttctggtaggttcgtggtctcgctgacttcaggagtgaagctgcagatctttgcggtgagtgttacagctcataaaggtggtgcggacccaaagagtgagcagcagcaagatttattgcgaagagtgaaagaacagagcttctacagcgtggaagggaacctgagtgggttgctgctgctggctcgggtggccttttattcccttatttggccccacccacatcctgctgattggtctattttacagagagctgattggtccattttacagagtgctgattgttccgttttagagtgctgatttgtccattttgacagagtgctgattggtgcatttacaaaactttagctagacacaaagtgctgattggtgcatttacaatcctttagctagacagaaaattctccaagtcccctacctgattagctagacacagagcgctgattggtgcatttacaaacctttagctagacacagagtgctgattggtgcatttacaatcctttagctagacacagagtgctgattggtacgtttacaatcctttagctagacagaaaagttcaagtccccacccgacccagaagcctagccggcttcacctctcaatcccataaacaaatttgactccttccccatatccactccccctcttgtgtctccatccttccttccctccctcccatcaaacccagaggacatggacttctgtctcatcttctcctctctgcctccctccctctatcatcctcagttgccttattctgtctctcctccctctgaaatttctcttgattctttttttttttttttgaggcagggtctcactctgttgcccaggctggagtgcagtggcatgatctcggctcactgcaccctctgcctcccgagtccaagcaattctctgccttagcctctcaagtagctgggattacaggcgcccaccaccacacctggctaatttttttgtatttttagtagagatggggtttcactatcttggccaggctggtcttgaactcctaacctcatgatccacccgccttggcctcccaaagtgctgggattataggcatgagccactgcacccggactttttaaaaatttatcgtagagatgaggtcttgctgtgttgcgtaggctggtctcaaactccaaggtcctccagcctcagcctcccaaagagctgggattacagtcgcgaggcactggacccagcctgtgatgaatattaatgccttattaattctttaccaccccctccccacaccatgaggccaggaagggatggtggcatggaggggtggggtgtcaaaaccatccccattttccaaatgcaggaactggggccagtgagctcctgtggtccaggagagggatgtgatttacagctgcagctctggagtttaacaggtccaggttcacatcccagcttcctggccccttgttagtttcctgccatggtgtttttcttttctttctttttttctttcttttttgagacagagtcttgctctgtcacccaggctggagtgcagtggtgcaatctcagctcactgcaacctccgcctcccaggttcaagtgattctcctgccttagcctcccgaatagctgggactacgggcatgtgccaccatgcctggctaattttttgtatttttagtagagacggggtttcaccgtgtcagccagtatggtcttgatctcctgaccttgtgatctacccacctcagcctcccagagtgcggggagtgtaggagtgcgccaccgtgcccaggtggtggtttttttttttttttttctgtcgttccccaggttggaggggcaggaaatgctttgaggtcaaggtggctgcaggaaaaaggatgacattgaagagatgagcccatcattggcagagcctggaaatgaagagggtgtggctagaggaaccccctctcctgcagactggactcaccaccagctccagtgacagtgggctcagaggagatcctctaagcctgctcagtacaggacacaggcaaacaaggaacctggagagggcagcctctagcctccctggcctggcagctgtaggacctacctctacaaagctaaaaagtttgtcacctatacccagccacagccccagggaaacagctgtgtccccagcacctgccaggaagggtcaagacaaggaaatcacagatattttttcttctagcgcaagaacccccaccacctccccaagagacatctataaggaatatttggagggagatactggggcaaaaataaattaacaggccgggcacagtggcttgcgcctgtaatcccaccagtttcggaggccgaggcgggcagatcacttgaggtcaggagtttgagaccagcctggccaaacccatctatactaaaaatacaaaaattagctgggtgcagtgggaggcgcctgtaatctcagctactcgggaggccgaggcaggagaatcgcttgaacccgggaggtggaggttgcagtaagctgagatcgcactaccgcgctccagcctgggtgacagagtgagactcttgtctcggaaaaaaaaaaaaaaaaaattaacagcagctggggttcagaaaatggacagatgtggttttcctcaaatacatgtcctagatgtagggtatccaattattacaatttttattttatttcatatttatttatttattttttagacagaatctcgctctgttgcctgggctggagtgcagtggcactgtatccggaattggggggttcttggtctcactgacttcaagaatgaagccatggacccttgcggtaagtgttccagctcttaaggtggcgcgtctggagtttgtttcttctgatgttcaggtgtgttcagcgtttcttccttctggtgggttcatggtttcactggctcaggagtgaagctgcagaccttcgcagtgagtgttacagctcataaaagcagtggggacccaaagagtgagcagtacaagatttattgcaaagagcaaaagaacaaagcttccacagtgtggaaggggacccaagtgggttgccactgctggctcgggcagcctgcttttattctcttatctggccccacccacatcctgctgattggtagagcccactggtctgttttgacagggcgctgattggtgcgtttacaattcctgagctagacacaaaggttctccacatccccaccagattaactagatacagagtgtcaacacaaaggttctccaaggccccaccacagtagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagagtagctagatacagagtgttcattggtgcattcacaaaccctgagctagacatagggtgatgattggtgtatttacaatccctgagctagacaaaggttctccacgtccccaccagactcaggagcccagctagcttcacccagtggatcctgcaccggggctgcaggtggagctgcctgccagtcccacgccgtgcgcctgcactcctcagcccttgggtggtggatgggactgggcaccatggagcatggggcagtgctcgtcagggaggcgcgggccgcacaggagcccatggagggggtgggaggctcaggcatggcgggctgcaggtcccgatccctgccccgcgggaaggcagctaaggcctggtgagaaatcaagcgcagcgccggtgcgctggcactgctgggggacccagtacaccctccgcagccgctgtccggcccgggtgctaagcccctcattgcccggggccagcagggccggacggctgctctgagtgcagggtccgccaagcccacgcccacccggaactccagctggcccacaagcaccgcgcgcagccccgattccggctcgcgcctctccctccacacttccctgcaagctgagggagccagctccggccttggccagcccagaaaggggctcccacagtgcagcggtgggctgaagggctcctgaagtgccgccacagtgggagcccaggcagaggagtcgcagagagtgagcgagggctgtgaggactgccagcacgctgtcacctctcagcgccatctcggctcactgcaacctccacctcctgggttcaagcaattctccggcctcagcctcctgagtagctgggattataggtgcgcatcactatgcccagctaatttttgtatttttagtagaaatgaggtttcaccacattggccaggccagaccagcctggacaatagagtgagaccctatatagggatctcactatatagagcaatacagcgggatcacccgacctcgggtgatccgctcgttggcctcccaaagtgctagtgttacaagtgtgagccaatgcgcccagccctattctttttttttttttttttttttttgaaatcaagtcttgctctgtcacccaggctggagtgcagtggcatgatctctgctcaccgcaacctccacctcccgagttcaagtgattctcctgcctcagcctcctgagtagctgggattacaggcacccgccaccacacccggctaatttttgtatttttagtagagacggggtttcaccatgttggtcaggcgggcctggaactcgtaatgtcagatgatccacctgcctcggcctcctaaagtgctgggattacaggcatgagcgaccacgccatcttttttttttttttttaacaaaacacagatgtagaattagagccttcaggggtgggtgcagtggcgctcacacctttaatcccatcactttgtgaagccaaggcaggaggatcccttgagtctcggtgtttgagaccagcctggacaatagaatgagaccctgcctctacgaaaaaaaaattatttttgttttgagatggagtcttgctctgttgcccaggctggagtgcagtggcgcaatctcggcttatttgcagcctctgcctccttggctcaagtgattcttctgcgtcagcctctagagtagctgggactacagacgtgcaccaccatgctcggctaatttttgtatttttttgtagagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaagaacaaagtgttctgaggttgcttttattccaagaactctgtgagctccgcccagataccattggcgcctgcttgtgtccccaggggacctacacacaacagcaccagcaccatgagggcgctctcgacccacacaagccctggtccccgtcagtcaatgtgactgagtccgccattgaggccagtctggctggccccaagtggtccctctgagtccccaactccctggccagcaaggagtgaagctccatgccccttggtccacgcctctagagtctgagcatatcctgcagcctcgatctcaggaggcaacgcatgcagcccccctgcactcagaaagggggcttctccagtcgtggtcttcttctctgtccacaagtttccagatggcccctccttggagcccctgcccaggcagggaacggccacatcctcgggcagagccaagagtcaccgtctttcgtgggcctgggaccaggcccagccaggacgctaggaggctgcctctgctgccatgggctggatcaacatggtggtggcctgcagcgggtagtagcggccccgccaggtcttccagaagattcccttcttaagcttctgccgctgctgtgggatggagcggaagtactggccgttgaggttggaatggctgcaggtgccaaaccaccagcctcctgccggggtcaggggagagggaacatggtcaggtctttgagccaccgatggggctgaaaggagatagggatagggttgaggatgaggcaggttggggaccaggctgggctttggacttgacttttttttttttgagattgagtcttactctgtcacccaggctggagtgcagtggtgcgatctcagctcactgcaacctccgtctctcaggtttaagtgattctcctccctcagcctcccgagtagctgggattacaggcgcctgccaccacacctggctaatttttggtctttttttttgagactgagtctcactctatctcccaggctggagtgcagtggcacaatctcggctcactgcacctctgcctcccaggttcaagggattctcatgcctcagcctcctgagtagccgggattacaggcacccgccaccacgcctggctagtttttgtatttttagtagtgagggggtttcaccatgttggccaggttggtctcaaactccttacctcatgtgatccaccctcctcagcctcccaaagtgctgggattacaggtatgacccactgcgcctggcctaatttttgtatttttagtagagacagggtttcaccatgttggccaggctagttttgaactcctgacctcaggtgatccacccacctcggcctcccaaagtgctgggattacaggtgtgagcccccacacccggccttatttttaagtttaaaaacaattttttttgagacagggcctggctccattgcccaggctggagtgcagtggtgtggtgatggctcaatgcagcgtcaaccttacgggctcaagtgattcttgtacctgggcctcccaagtagctgggaccacaggtgtgagccaccatgcctgcattttttctttttcttttgaggcaggggtctcactctgtcacccaggcttgagtgcagtggcgcagtctcagctcactgcagccttatctcctaggctcaagagatcctcccaactcagcctcccaagtagatgggaacacaggcaggcaccaccatgcccagctagttttttgtatttttaattgagacaggatttcgccctgttgctcagattggtctcctgggctcaagtgatccactcgcttcagcctcccaaagtgctgggattgcaagtgtgagccaccgtgcctaatttttttttttttttgagaattgcttgaacccgggaggtggaggttgcagtgagccgagatcgcaccactgcactccagcttaggcaacagagtgagaccctgtttcaaaaaaaaaaaaaaaaaaagaatcctgtggagcaccattataaagatgtttgtggccgggtattgtggctcacgcctgtaatcccaacactttgggaggccgaggtgggcagatcacttgaggtcaggagttcaagaccaccctggccaacatggtgaaaccccgtctctactaaaaatacaaaacaattatctgtgcatggtggcgggaacctgtaatcccagctactcaggaggctgaggcaggagaatcacttgaacccaggaggcggaggctgcagtgagccaagatcacgtcacttgcactccagcctgggagacacagcgggactctgtctcaaaaaataaataagtaggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccaggcgtggtggtgggcacctatagtcccagctactcgggaggctgaggcaggagaatggtgtgaactcaggaggtggagcttgcagtgagccaagatcgtgccacaaagcactccagcctgggtgacaaagtgagactccgtctcaaaaaataaatacataaataaataaataaacaaacacataagtaaataaaagtaaagacggtcaagacccttttcaggatgggaaaactgaggccagataggctaagttagtggcccaatcacacacacggcatgtaaggaagaggtgggggcaggaaacagatgcaatgtggggttgaaggcaggacagagcagcagaaagataaggagggaagctgctggctgggtgtggcatggcagggcctgctcaccagagaggctcttggcgcagttcttgtccctgcggaggtcgtgatcctggtcccaagtggagaagggtacggagaggccgctgggtgggacggtggtggcgcccagctggccggccacgggtgcagtgagctgcaggctataggccgtgtcctcgccacccaggtgcacggagaactgcagcaactcggcgttgccatcccagtcccgcagctgcacggccaggcggctgttgcggtcccccgtgatgctatgcaccttctccagacccagccagaactcgcctggagtgggagaggccactccatgaggcagggccacttctgagggtccctcttcctcccctgcctctgtccccactagaaacacctaccgtggggatccccaaaccccgccttgtaggcttcccagggccggttgaagtccactgagccatcgtggcgcctctgaattactgtccagcctccatctgcccagaaaggtacaaggtcaccaggaagtccctcttcacagacgaccccactccctcatctggctgccaagcaccaaaccccctccaaacccaggaagacagcagctccctcactcatccctggaggactcgaggagggtgggtcagagggaggaatattatgggctggccttgggaagatctttgtcccaagaacccagcagggactgagtgtgggagggagtaggcagtggaaatctgcaaagcctctctgggccagctgaactgggtaaaaccccgtgttgtaacctcttgtaatggaaaggacttctcagtggaaaaaaaagctttctttttttttttttttttttttagagatggagtctcactctgttgcccaggctggatcgcagtgccgcaatctcagctcactgcaacctctgccttcggggctcaagcgattcttgtgcttcagccccacaagcagctggaatcacaggcacgcccggctaatgtttatgttggtagagatagggtttcaccatgttggccaggctggtcttgaacttctgacctcaagtgatttgcccgcctcagcctcccaaagtgctggcatttcaggtgtaagccaccgtgctcagcctttgtttttttttagaaacgaggttttgttgtgttgcccaggttggagtgcggtggctattcacaggtgtgatcacggctcacggcagcctttaactcctgggctgaagtgaccctcctgccttggcctcccgagtagctgggactacaggcatgtgccaccatgcccagcaagggctgaattttattttattttattttattttctcttttttatttttttgatggggggacggagtctcgctctgtcgcccaggctggagtgcggtggcgtcatctcagctcactgcaacctctgcctcccaggttcaagagattctcctgcctcagccacctgagtagctgggattacaggtgcacaccaccatgcccggctaatttttgtatttttagtagagacggggtttcaccatgttggtcaggctggtctcgaactcctgacctcgtgatctgtctgcctcaacctcccaaagtgctgggattacaggtgtgagccactgcacttggcctttttttttacttttacaaaattttttgtaaagatgagctctcactatgttgtccaggctggtctcgaacttctgggctcaagtgatcctcatgataggcctcccaaagtgtcgggattacagatatgagccactacacccagacaagggctgcattttaaagaaaagaggccaggagcagtggctaatgcctataatcccagcattttgggaggccaaagtcggcaaatcatttgaggtcaggagtttgagaccagccagaccaacatggtgaaacccagtctctactaaaaatacaaaaattagctgggtgtggttgctcgcacctgtagtctcagctactggggaggctgacgctggagaattgcttgaacccgggaggcggaggtttcagtgagctgagatcgtggcattgcactccagctccaagagcaaaactccatctcaaaaaaaaaaaaaaaaaaaaagaccagcttgggcaacatagcaagaccctgcctttaatttttttgttttgttttgttttcaatttaaagaaagacaacagggcctatggggagaggggcccctggtggactaacacaccctacctgaggtcatcttgcagttcaccaaaaatggcggagacccctgaggctggatttcaaatagtccactctgcctctccccaacctggaacagctcctggcaatccctgggcagccctgaagggagataaagtggagacttgaaacaggagggcagcccctggggggggtctcaggagccaggcatatctgggggcttaacagtggatgaccagggaagtaaaaggcaaatcttatctcatgaccacctctctgccatctgcctaacctcttccatggctccctatgtccttcctcagcatggtccacaaggcacctggaggaccagcccccgtgcccatcctcctcctgccatgctgtacccacaccctctctggcacacaggctttcttcccacccttgtaccacacaccgtcctgccacagggactttgcacatgctgttccccctgcctgggactctctttttttgttttgttttttgatacggagtctcgctctgtcgccaggctggagtgcagtggcgcaatcttggctcactgcaacctccgcctcccaggttcaagcaattctgccgcagcctccggagcagctgggactacaggcatgtgccaccacgcccgactagtttttgcattatttgtagagacgggggtttcaccatgttggccagactggtctcgatctcctgacctcgtgatccgccagccttggcctcccaaagtgctgggattacaggtgtgaaccactgcgcccggcgggactctctttcctcacttctctctctgggtcccagcttctggaaggacaccctgccttgcctcacccccagaccaggccagaacaccccaaatgggaattgagcaaggacttcccactcctggacactgaggtcatctaatggtctctcctctgactcaatggaggctccatgaggctggggacaaggagcagctctgcccacagcctggcaccagcatccacgcaggccccagcgcatagcagctgctcaataaagacttgaggaatgggccgggcgcagtggttcatgcctgtaatccagcactttgggaggcgggcggatcggtcaggagtttgagaccagcctggtcaacatggccaaaccccatctctagtaaaacatacaaagattagctgggtgtgatggtggacgccagtaatcccagctccttaggaggcagaggcaggagaatcacttgaacccgggaggcagaggttgcagtcagctgaggttgaaccattgcactccaacctgggtgacagagtgagactctgtctcaaaaaaaaaaaagacttgataaatgaataaaaattagctgggcgtggtggcggtaggcgcctataatcccatctacttgagaggctgaggcaggagaatcacttgaacccagtgggaggcagaggttgcagtgagctgagattgcgccactgcactccagcctggacaacagagcgagactccgtctcaaaaagcaaacaaaacagtcttgacaaatgaatgaatgaatgaatgaatgaggcagcaggtccagaacgggaagaactgtgctgagcaggagcatctcagaggctctgcctggggtcccagctcctagagggagaggaggcagggttgaggaaagaaagagggagggaggaggggaggatggcgttgagcacgtctggaggctcagacgctccagactgggaggaaccgcccccagcccagccggaaaagtaggggaaaggtcgaaatgagtctgcacggtgggggtgggggcgggcccagagtgaccaggaagacgctttccggcccctcaggcatctcccctttcccctactttcctcccatccagtaaggatgggcacgcggccaaaccaccagtgtggcttccatgaatgccagctgttcgccttcccagctctgaactttctcctacttggcgggcctgagccaagagtctgggagtcccgaacccacagaacccctgcccccttccaccgcatttcccagccaggacttgtgccttcccccgtcaccctccagaagcccctcatcctgggatggtggctttgggagggtggacaggaccctgaccacgctgagatgctagcctggcggggttgggggcgggcagcacggaggtgggaaggagcgggagcttggggaggagagaaccctcaggtctacagtgctggaagcctgccactgaccctagggtgtgagagggggatccaaactttcacccagttggctgtggacagccacagatgcagggaaggatgaggaccacagagaaaccgtgtggggccgtgaacttagagaaccgcgagtctgcatcggacacacgtggacatgctgtggttcgagatgaacggagatttgggaataaagcacctacaacttgtggtggcagcaaaagcccactttctgcggtggggagggggccggcgggggcggggagggaggaggagaacaagagaggaaggaggaagaggggtcagggacctggagcattggatttgtaagatacaagagtgtttctggtctgggagctgggggttcccagccctaattcccacataccccaagacattgtggagggcccaaatctacaaacactactacctggcaccccctcctccatgacaccctcccctagaaggttctaaccttcaggatggcaccccgaaccccatttctaccttctccagcacccctgcagctcaagtccctcaagacctctttctccacctctgttccaatcagtgatcagcagggcttcagggacagcccactggcttgcagaggagaagggttgggtggcctggctgggccaggtcagggctgaggaaggaggtgctcccatcagctttgacccagagactggtgagccctcagggactccaggccaggacatcttctccttaaggtggacctgacaaggagaggaccagcaatggcaagtggcggggtaggggtggccaccggagagcatcgaggggcagacactcacggtgcaggcggctgacattgtgagccgggtcaactggctgggccatctcgggcagcctctttcttcgggcaggcttggccacctcatggtctaggtgcttgtggtccaggaggccaaactaggatgggacgggaggagggtgtcaggtcctgcctggccccacgtccccagccacacgtccagttctcaccacctccctctcaacctggggtccagctatcagagggaccttttctcccttgatcctagggttacctggctttgcagatgctgaattcgcaggtgctgcttctccaggtgccgctgctgctgggccaccttgtggaagagttgctggatcctgctgttctgagccttgagttgtgtctggggaggggtgaaaaccttggtgaggacccagcttgcctaccccaacctcttaattcatccactcatccatccttccaaatctccatccgctgaggccaggcaagggagtctttcttttttcttttttttcccaatgacggggtctcgttctctcgcccaggctggagtgcagtggtgctgtcacagctcactgcagcctccaactcctggggtcaggcgatcctcctgttttcagcctcctgtgtagctgggactacagtcatgcagctctatgcctggcttattttttattttttcagacagagtctcgctctgtcacccaggttggagtgcagtggcgcaatcttggctcactgcaacctctgcctcccagactcaagtgattcttgtgtctcagcctcccaagtagctgccaccacac

SEQ ID NO: 5539 - DNA, 12564 bp, Homo sapiens
actcaccttggcggcgtctgacagctgcgccagcagcagcacggaaagcgccaggcacgacaggctgagcaaggagccaagccgaagaaggcctccccacagggtcgccatcgctgggggcccagcggtcccacagcccggagcccccgcgaccggctcccggctcgggctcaggctcaggctcaggctcaggcacaggcttgggacccggctggggatcctccgcccgcacttccgtctggacgcgaaggcgtcaccgggcgcgccgggtcagatgcaaaaagcatccgccccggaaccggttaccagtgcgaagggccgggaggctgggcagtcctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggaaccagggtggcagggctagatgtcctctcaccagactgcccagtgaaggtgctgtcactttgatgaattatcaaggctttgtagtgggtcttctactggacaaaggacaaactggagactccctggatcaaatgtgttgaaaatgttatagtgctgtcaggaagtgctgttctggaatacagaatgtggctgccgtgagtggagtgtgactatgagatagtcgcctgactggagacaatgaagcctcaggccaaggatgctccctcctactcagccctgtttagtgggatttttcagcccactgtaaagcctactgctgcctgtaaagccacctaagtgcatcacttgctggtgttcaccatgataacaacaatttatggggacagaatatgtttctagagctgctggtgccactgctgatgttactgggttccctgaaataaaacaccacagtgcaggtgagtaccaaagtggggagaatttttagttccttttagaggtgctaaatcaatattgttgatttcccagtaccttagaatatttaatgaaaacaggtcaggtgcagtggctcacgcctgtaatcccagcactttgggaggccaaggcaggtagatcacttgaggtcaggagttcaagaacagcctggccaacatggtgaaaccccatctctactaaaaatacaaaaattagcagggcgtggtggcaggcacctgtaatcccagctactccggaagctgaggcaccagaatcgcttgaactcaggaggcggaggttgtagtgagtcgagatcatgccactgcactccagcctgggcgcatggtggctcatgcctataatcccagcactttgggaggctgaggcagtcagatcacttgaggtcaggagttcaagaacagcctgaccaacatggtgaaaccccatctctactaaaaatagaaaaagttagccaggcgtggtggcaggcgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggccattattttactttttctataggaaataagatatgtgtttatactctgaagactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctcaaaaaatgtattccctttatctaactgaaacttcgtactctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatattgctaatgttttcttttgtttcttgaattgtctgtgttgaatttttaaggcttgtttctgttttgtgttggaagcttttcttaaacgtctagagatccttggccatccattcatatgtaagagtggggcactagaaagccaatagaaagttctgtgtacactggccagtgaggtggctcacacctgtaaccccagcactttggaaggccaaggcaggcagatcacttgaggtcaggagttcaagaccagccttgccaacatggtgaaaccccatctctactaaaaatacaaaaattagccgggctggtggcgcacgcctgtaatccttgctacttgggaggctgaggcttgagaatctcttgaacccgggaggcagaggttgcagtgagctctccagcctaggcaacagaccaaaactctgtctcaaaaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatagaaagagaattattttatgaaactttggtttcttacacatatcatatatacatattatgtactggtttgatcccataaaatgggagttttttttttttattgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgggaggctgaggcaggagaatcatttgaactcgggaggcggagattgccactgcactccagcctgggcgacagagcaagactccgtctcaaaaaaaaaaaaaaaaaaacggagataagttctcctggagtaaaattctctaaacttttgcctgcatgctagtctgatagacagtactcattcattcaggtattggttgaggacttactatgtgccaaacactgttccaggttctgggtatacatcagacaaaactgtctcctgggactagattctagtgagggagataaacagtgggttatatagtatttagatcttgcgctaggtaacacagcaacagaagggaaagctgaacatatgcatatagatgctggtaagagggtggatgtggtggatgaatgaagtagaaaacaaggtcatcatctgagagtgaaaatggggaggaagtgttggaagaaaagagaaggtgtgaaataatttaggacacagcacagcaaactatagcctttggtcaaatcctattttggtgcaatccacaagctaaggatacttttttacttttaaacggttgggaaaaaaatttaagatgatattacatcatagcatgtaacaaataaatgcaattcaaatttcatttatttacatattgcctctggctactttcatgctacagtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccagcactctgggaggccaaggtgggcagatcacttgagtccaggagttcaagaccagcccaggcaacatggtgaaatcccatctctacacaaaatacaaaaattacccaggtttggtggttcatgcctgtagtcccagctactcaagagactgaggtggagaatcacttgagcccaggaggttgaggcagcagcaagccatgatcacaccactgtactccagcctgggcaacagagtgagaccctgtctcaaaaaaacaaacagaatgctgagttttaaatccctatattcagtaggatgtctcccctcagctcccagttgttgttggtggcttcaactagttcatcttccccaggagataatgaatgaacaaatgaatgaatgaatgaatgagtttataaggggcgaggatctcaggacttcatagtctttcaagtaatcatcttgtttttagccctctacctactacctcttgcttttcagataactgatgcctccaattcctaagccttttctggggttctgtggtacaaacatgcttgcttattgctagtaacactccaccagcccctgccccagacttctgctttctctggtctactcagtttgttccttgttttttgctttccggattcaaagattttgttgacattgcctggatgctgccatcttttgtctcatattctttgtccttaatcatttaacattcctttactgtcattttaatggcatttcaggaggaagccatgtttctagtccaccgttcttttttgttgtttttgagacagagtcttactctgtcacccaggctggagtgcagtagcatgacctcagctcactgcaacctctgcctcccgggttcaagcgatcctcccacctcagcctcccgagtagctgggaccacaggcatgcgccactacaactggctaatttttgtatttgtaagtagagatgaggtttctccatgttggccaggcttgtcttgaattcctggcctcaagtgatccacccacctcagccttctaaagtgctgggattacaggcatgagccaccacaccgggccaatccactgttttttaaaaagttgtcaagagttttgttaaggggtcagacatgtctgactggttgacttttcccagaatgctgcttagtccctcaaacacacaaattcctgatgggtccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccttgtgctccaactggtctttatgaaacctgttcacttcaatatacttttaggccaggctcacgcctgtaatcccagcaccttgagaagctgaggccggtgcatcacttgaggtcaggagttcgagaccagcctggccaacatggtgaaaccctatctctactaaaaatacaaatatatatacatatgccaggcatggtggcatgtgcctgtagtcccagctactcaggaggcagaggcacgagaatcacttgaatccaggaggcggaggtcgcagtgagccgagattgtgccactgcactccagcttgggcaacagagcaagactccgtctccaaaatatatcttatctatatatagatatagataggtatatatagatctatatatagatatatactttcaattctccaattgttcccgtataccatagagaaactcttatgagctcagtttctgcaggacttacaaaacagggtaattgcctcctcattatggtcagctccagcaccattcaaattctctgtccttacccatttccagaacaagcaggatgaaaatcacttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccagaaaagaatgtaaaaaaggtactagaaagaaagaataaggcctatagccatcaggctgctagaacctttggacaagtcactatctaaaagcaggtaaagacccagctttttgtccatctggtcaggcacctggtggcgtgagtctttcagaacatactggtcaggcggtggctcacgcctgtaatctcagcactttgggaggctgaggcaggaggatcacttgaggtaaggagttggagaccagcctggccaacatggtgaaaccctgtctctactaaaaatacaaaaattagccaggtgtggtggcgggcatatgtagtcccagctacttgggaggctgaggcaagagaatcgcttgaacccaggagtcggcagttgcagtgagccgagatcacaccactgcactccagtctggatggtaaagtgagaacccatctcaaaaaaaaaaaggaacataccacaacccttcaataaaaaggtctctgagaaaacagttgtcacaatgtccatgtacttgtacttgacaccatgtgagaaacagcctccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcagcctctgagctcctgggctcaagggatccccctgccttagcctctgaagtagctgggactacaggcatgcaccactgtgcccagctaatttttaatttttttgtaaagatagggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaaaaaaaaaaaaaacaccttccacatgacaactctgaagacaataatcacactaccattgtgtttttctggatgtgccacacattgtatacatgtccctgccttacaaatgacatctcctatacacagagtccttaatatttctacatgcaatgtataatcaattaaaacatcagtatcatcttaatgtgaatttctgttaatccaagttctcccccactatgcaagtgcaataaatatttaaaaatgaaggtaacaatatatatatatatttttttgagacagagtctcgctctgttgtccaggctggagtgcagtggcgtgatcgcggctcactgcaagctccacctcccgagttcatgccattctcctgcatcagcctcctgagtagctgggactacaggtgcccaccaccactcccagctaattttttgtatttttagtagagacagggtttcactgtgttagccaggatggtctccatctcctgaccttgtgatacacccctctcggcctcccaaagtgctgggattacaggtgtgagccaccgtgcttggccaacaatatatattcttaactgtgtaaattttaatttgttggttttattcttttgagattattatgaatattgattctgtcattcatcgcttaaggaccaggcaggtgaaccacttgacattttttatcatcagaataaattgacaaaaacaaaacaaaatactttgaggtggaatggaagtatcttgagtagtagtaaaaccatagttctagatggtgataatcattgtcataatgaaagcgtgttgcttgttgactatttaaccatgctgtttaagtcatattaaaaacatcaatacgtccctctccctctcccctctcccctctcccctctcccctctcccctctcccctctcccccttcccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgttttttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatcttggctcgctacaacctccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggcctccccgtctgagaagtgaggaaaccctctgcctggcaaccgccccgtctgagaagtgaggagcccctccgtccggcagccaccccgtctgggaagtgaggagcgtctccgcccggcagccaccccgaccgggagggaggtggggggggggtcagccccccgcccggccagccgccccgtccgggaggtgaggggctcctctgcccggccgcccctactgggaagtgaggagcccctctgcccggccagccgccccgtccgggagggaggtgggggggtcagccccccgcccggccagccgccccgtccgggaggtgaggggctcctctgcccggccgcccctactgggaagtgaggagcccctctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccatccgggagggaggtgggggggtcagccccccgcccggccagccgccccatccgggagggaggtgggggggtcagccctccgcccggccagccgccccatccgggagggaggtggggggggtcagccccccgcccggccagccgccccgtccgggagggaggtggggggatcagccccccgcctggccagccgccccgtccgggaggtgaggggcgcctctgcccggccgcccctactgggaagtgaggacccctctgcctggccagccgccccgtccgggagggttgggggggggtcagccccccgcccggccagccgccccatccgggaggtgaggggcgcttctgcccggccgcccctactgggaaatgaggagcccctctgcccggccacgaccccgtctgggaggtgtgcccagcggctcattggggatgggccatgatgacaatggcggttttgtggaatagaaaggcgggaagagtggggaaaaaattgagaaatcggatggttgccgggtctctgtggatagaagtagacatgggagacttttcattttgttctgtactaagaaaaattcttctgccttgg

SEQ ID NO: 5540 - DNA, 4521 bp, Homo sapiens
tatgccctaaaatctgggccctgggcaagcacacagcaggagagacaggcccccggtgggctatgggcagaacacgagggctccggcaattgggctgacaccgtccctgagcgtcagggatggccctgccagcacctgccgttctctgggcctcactttccttgaaagggtgggaaaggtggccctgaccccctttccagctctgcgcacctgaagactctcaggacccccaccccagggccgtggcttcatttgcttcattcagaaacacattgcaaaatggaaaatcaagggttagggtaaagaaagaaagtagccagaaagagcccccaggccctcccaaggcgacgtggccaacacagagttcccaggccagcccctgccctggacgagcggcctcctggggccactgggccacctggagcagctcccagagctaacagcacaagacagcatagccacattctctggggaggggttgggggacctggaggccccccatggggtcttggggatcaacgacgcggccactcagctgccctgggggtcttgggggttggtcagtgacatggccactcggctgccctgggggtctcgggggtcactgacaccgacccgtggatgtcctgggcccccgagggggcggcaggcagaggtgcggcgcgagcatgcgagagcgccaggcggccaccagggggcagcaccggcctccgccccgccccccgcacccagccataccttgcagtgtgcggtactcaccaggccgccgcaggacggagctctggccggtcagctcgtgcacgatgcagttatcagcctcggtgtcgggtgctgtgggcaccacgtgctgtgggcaagcagcgctgagccatgcacgggctggccgggcgccccccacgctggcgtctccacctgcctggctgctcacctggtcagactcccgttcctggggccactggtccagctctgctagctccagctcccgagcctcatacccctttgccgcctccttcctctgcagagaccagcgtcttgagcccaaaccagctccacaccccacccagaggcaggaggtcctgagaccagccccatggcctggcctcagcccacccaccatgggtggcaggtgctcacctggccggaggggcggtacgcgcggagcttgcgcagagaggccgtggcgtagcacagcagcaggaggacgccggggctggcatacacaggccagtccaggccggtgttgaggaccagcgcgtgggggctggagcagttggtgggacccacgaagtccttgagacccagcaccctgtccagagaagacccgtcacagcctaccaccccagaggcagtggggccacaggggctagacgagccaggtgggcgggaccagggtggcaggaaaaaggggctgtgtggcaagccgttacctagcccagatgccggcaggcgggagcagagcctgtgccaagggcatctggtagcagtagaggcagatgagatggccggcgccgaagcaccccaccgcgacgcagagtctgctgaagccccgagtgctgatgggaaagtggcaggcccaccaggtgcagagggccaggaagagcagcagtcatcagggaactcccaagacccctcccagtgtgactgccagtgccccctgcctcggtgcgtacctgccagtgcaagcagtgttacggccaggacccgcccagccgccaccagcagccagtgggccgtgactcggaaacgagcggccagccgtgacctccgtgtaggggccagcgttgctgcttcctgcagccctgccgtcgggctggcatccacatccctctcatcatcatcctgccaaggtcacggacaggggcaaggtcaggtgtatcgcactgacgccacctctccagcccacacctgcccagccaggagcgtgggaggcggccacatccacagctgctcctctgagggccacaggacagcctccccgggcacaggccccagccgtccctgaggtctgcctgacaccttcctacttcctcactcaagctcacagttcctgcaggccttcctggtagcagctcccaccctggccgaagacccagggtctgtcctgccaagcccaggcacgtgatgaccttgccaggtacagacagaccacagactgtcctataccacctcatctccccgaaccacgcacccagggagcagcggggccctgtctataccccggggggtctctagagaccaagggggcctgagggacatggccaggctccagggtctcctgtgtacccctgccagccttctgggtggctctgcctggaagataggggtggtactcctgccctccccaagcctctggggggacagaggtggccagctgcctagaagaagtgacaggccggcctggggctggggagagagacctgccgggcctgttttccctggacctgactaaagatttcccagaacacagccatttcccaaacaccagggaaagccaggtgtggtggaaagaacacggctgtcgtcagatgccctggctctggcctggctgccaccggcccagtgtccccatctgtgactcgggggctctcctggtggctgaggcgccaggtgcccgggctgagaccgcaggctgtggggctggacgataggccccaccccagctctgacagtctccgtgctctgcaggccgaggcaagtcacagcctctcggagcctattccccttctgtcaaatgggatgggggcttgacgggacagatgaaccagaccagtcctgtcctcacaggcctccagggctgcaggggctgctgggaggctccgaggccagggtaacagggagatcagggcaggagaggcccaggccctgagcccacccctctcagagaccacacagcagctgggggcgaggctggatcagaacgcagggcgccatcgctcaccccacccacagcctggccctggccctggccctgggaaatcttctgagcagagccgtgaaaaatgagcatttctgggagtggaaagaacagaggcagctgctgtgagagaacaggtgtgaggccaccgaggggcaggcccggccctgacttggggtatgaggccaccgaggggcaggcccggccctgacttggggtgtgaggccaccgaggggcaggcccggccctgacttgggccccacgtgccgcagccatgctgcagacgcccctcaccctcctctagcggccagcacccctcgggctggctggcacactccgtcgcatgcctgcaaacacgtgtgtgtgttgcccatatgtgggagtgagggtcgcccgggggccctgccaggccgggtcatggggcttctagatctttcggaacggtatcctgcaggtgcctggtgcccccagctcactctgaagtctgtccacgctggccgcccagggcgcagctgcacactcaggctcccatcacaccaagatgaagatgaccagagtccagccacccagccccttcccagcagccaaactctaggaagctcatgccccatgcccccatcagcatggaggggctgacgagggaggggcgggtctcttggaggacaggcagcagcacagtcctcatgagcgctggaccccctcaaatgcccggaaaagccacttgacctccaggtccccgttcccacttctgaaatgcgggcaccagccttgccccatggggtggcgacaggacaggcaggagggcaggccgcctctgcaggctgagcaggtgtactcgacctaccgtgtggcttggggaacccctttccctctcgggactcctctagaagttgaggcccatgtgcgtggcgagcatcagctatctgacgagtgggcactgggagggtgaggtgggaggaggctgggtgcccggggcagggagttcgtgggccaggacacccaggtggccataaatcctggctgagcctggggatggcaagtgtgggcccaggcagggacgagagggtctgagcagtcaacgttgggtgtcgcaggccccagctcatgccctgtccgtgtgagggggccatagctcagagattcccggggccggacctccaagtcttgtagcagctaaagttcactctgcctcccactccgaggacagaggccctgcttcaggcccgtcgctcctggggtccaggcccctgctggggctctgggccgacagcctgtttgcctgtaagtgcatggggcctgctggggccgccccttctcagcccttctgcagtggctctccagccagacccactgcccagcactgcaggtttccaccaccgcgtggccccaaataattcccctgtgaagagttcctaagggcacagatgccatgtcggggcgtggaggtttctgactagaggcagagcccgagtagaaacaggtctgaacggatggaactgcaggctgggccccggggtgggatttggaacttcctcctctctttaacaccaacttacaaccaaaacgtctacatctgttttaaaaagattaaaataaccctcaaaatg

SEQ ID NO: 5541 - DNA, 414 bp, Homo sapiens
gggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgg

SEQ ID NO: 5542 - DNA, 1824 bp, Homo sapiens
cttcgcgagcgtctgggcgggtggtaggtgagtgggtattgcgggctagtatccgagcaaaagatggtggcgcaggccgagttaagagctttaatcctgtgaagacatcttagtgaagagtttagagtgctgagagttgaaagcttgcacgtgggaaacgtgcggccggactgccacatgtactgaggttgagtcgtgacggccacaggctccgagttttggcgtgaggaaccgctgatcggccacgggcgccgaacttgctggcctccggcatgtgcctgagcggcggcggaaaaaccaccttaattggggcggagggttagttttaacagcaaagggcctttactaaaatggcgaaggccttccgtcggcgttgttttaaaatgggaagcctcgaccctgtattgaaactgagctgttcgaaggcggcgttgtgtgcaattcggattaatgaaggggaagggttttgtgtggaaaaacgccttggagtgtgacatttctgcgagaatgcttaaataccgatttcccgcaggaacaatggcgctgtcttcagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaattactgtgagtgaatgtttcgggtttgtgcagggtacaatgtaagggtttttggatcagtgtaagagtggagagacaggaattagaagtaattgttactaagcaaatcatggaatatttagttttgatgtaactataattttgaaagcctggatgcttaagttgagaaatgggggaatgagatacagaaaataaggagcacaatagaataataatagcagtttattaagtatggtcatgagggaaggttactgataaaacaatctggtaaagacattcaggcttgctaaaatctaggaagaggtcatttggcaggatgggttacataatgctatctgatactaccaaataaaatgagagagaagccttaggcatgtaacgtttggagatagaaaatgtaccttcactatgaaggtagtgtgtgtaagatggcagttgaaagcattgcttgtgtttatgtttatacccttgatctctgatgcccttacctaccgtacttaaaactctgttaatcattgtctttctccccctcccacaacttctgcataaaattttaagatctgtgtttcattagttcaagagtgcctagaatagggccaggcactgttatacagtatgtggtaaaagactattgagattccagttttcaaggaagagtgccattaccgttttgttaaagctggcaaacaagacaaagttgtgaaatagactggttgctttggagccctctgaccgcttttcctgtagctccttctacctcccttgcctcccaatagattttttaatatgtcacattatctatcgaaatt

SEQ ID NO: 5543 - DNA, 581 bp, Homo sapiens
aaaacaaagaaggttttcacagattggaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcat

SEQ ID NO: 5544 - DNA, 348 bp, Homo sapiens
gggaaacagagacattcaactttcgggctcacaagagaggcgacctaaagagtgggttattggatgtcttctggcaggtgctacaggattaagaaggtagctggtcagaaacaaactttgaattagggggattttttaaaaaatagttgactaaagtaaatatgatcgttagcttaatcctccatatctaacgtgagattcaaatttaataggcaagtttaaaaatcggctggcatgtgcatctattatttgtgtatgtgtctggatgccttgctccaagagtacaggttagttgtccgtgatgaaatttccaagaccttcctgtttatcaggcccagcagtccaaaa

SEQ ID NO: 5545 - DNA, 18437 bp, Homo sapiens
agctttgaagccggcgagcggtgaggaggaggcgccctcgcgtgtggagagcggactccgcctggactccaccgcccacggccgcatcccatcgccgcacaagatcgccggagtcatattatcgacgtagttaaagcccactagcctaaagccgggcggactgcggtaaggaggccccgagaccgaacctgcagcccctgcagccccgggggggcgccggggaagggactcccgagaggtcgcgaggggcggaaggccctgcaggttgtcacccggaaataacgttctgaggccccccagccaggcgaacgcaccctgctcggccacggcctccgaggctaaccggaaaggtgccaggccgaggtgcaggggcgggatggccccaggaagagccgagggccgaggagggcgttgggtgggctccgcgctgcccgaactggggccgcagtctccactccctcctgccccgcggccctccgccgacagccaggcgccggcggggagtcctggacccctcccgggccctggaagccccgtcccgccggagctgacgcgccctcttggtatccatccggccgcctgggctgcccctcgcccctcgccttggcaaaaccagcccccggaccgagccctgccttggagagtgtgggtgcgcaaggccagccgagctgtcggttccggggtttcggggtgcgccactgtatggcggcgtaagccgagaagtgtccgaggccgggctccagcagttgagaggctgatttggccacggtgaaggacgcgcccggaggaaggaaacgggaatccgaaacgggcggtggccgcgcctttcccgaggccggcgtcgagggcttcagcgcctcagggtgggcgggaggggaaggtcgtgcgacccgcgtggccggcggaaaggagcagcgggagccgcggccgtagggaagccacgggaagacgggcggctgcgctgcgatgcgcggccctctccctgaagccctcggctcaggcgccacaggaaaggctccttcgggcaggcctcagctttcagcttaagtttttttcctttggccgagtcaactgcggtgccgagttgtattttcctttcagaggtgtgtccgagaaccattcttaggagacgcctgccggccgctttgggatagggcctgtctgcccatgctggcttccaaaggcctctgtgtgttcctgtatgtgggcgtgcacgtacctgtcacatgtgtacgcgcagaccacaggatgtccacactggcttccaaacacatctctgtgtttctgtctgtgagtgtgtacgcaggtgtcaaatgtgtacgcacagatcacagggtgtccacactggcttccaaacacgtctctgggttcctttatgtgcgtgtgtatgcacttgtcatgtgtacacacagatcacagggcatccacactggcttccaaacatgtctctgtgtttctgtctgtgggtatgtacacacatatcacatgtggaagaggtaggaagaggctggaacaggtaagggtcatgaaggtgcagtgcactattgtactgtttgcgctttatatgtgtttggttagttttgcaagaacatgctggtgaaggagagagaaccccaaacaattgattagcagtgctactgaaactcagatatacacaggaatggcaaagaaacatctatgaaaaaaagcagattctggaactccatctccctgagattgtcactcatggggtctgcaggaagtttcaggaatctgcattttcttctaataaacgtggtccacaggttataagttgagatacaaatagaatatataaagtaaaaaaggaaaatttgaagtttcctgcctagcccaactcttctcattggtagtgtctgttaaattggaaacatatctctttccagacatattaataccttttatacagttgactcttgaacaacattagtttgaactgcgtgagtacacttatatgtggatttttttcagtaaatggaatatttttggcgatggcaacaattttgtgaaaaacctcacagatgagtcgcttagccaagaaatatggaaaaaaaaagaaaagaaaaagctagatatgtcatgaatgcataaaatatatgtagatactaggccattttattatttactatcataaaatatatacaagcctgttataaaaagttaaaatttatcaaaacttacacgtacaaacagacagttacatggcacccattaggttcaagagaggtgtaaacagttgtaaagatgcaatattaaataataactgcatcaaattcactgtagtacatagagtactactgtaatgattttgtagccacctcctgttgctattgcagtgagcgtcagtgttgctggtattggctaaaaattccaagtaacataatcatctctgagtgagcagttgatctctccagtacattgcatatcacagtaaaaggtaagctcttgaggttctcacatatttctcgttgtgttcactgcagtactgtaaaccttgcgtaacaccatgggaccattacgaagtgccgctagtggtgctggaaatgctcccaagaatcagagaaaagttaatgacattacagaaaaagcggaattgcttgctgtgtattgtagattgaggtctgcagctaaggtcgcctgccattttaagataaatgaatccagtataaggactgtggtataaaaacaaaaggaagtttatgaagccatcgctgcagctacaccaacaagcatgaaaaccttgcactttttgggaaatacctttttatctcatattgcaaatgcagctttttgtgggtgcaggattgctatgagaaaggcatacctatataatctaatattcaagaaaaagtgaagtcattatctgacaaagcaaaaggaagatgaaggaaggtatgataattttaaaaagtgggttggctttcaaaaaatgtcaagataacaggagaagcagcttctgctgacccagatgcagccgacgagttcccagataccattaaggaaattattgaggacaaaaggccaggctttgtggctcatgcctgtaatcccagcactttggaaggctgaggtgggtggattgcttgaagccaggagttcgagaccagcctggccaacatggcaaaaccctgtctcttctaaaaatacaaaatttagccaggtgtggtggtgcacatctataatcccagctactgaggaggctaaggcatgagaatcgcttgaacccaggaggcagaggttacagtgagattgcaccactgcactccagcctgggagacagaatgagactctctcaaaaaaaaataaataaaaaataaaaataaaaaaaaatagagaaaatcactgaggagaaaagatatctgcctgaacaggtttttaaggcaaacgaaaatgccctattctgggggaaaatagtgccacagaggatatttattaggaagagaagtgaacatcaggatccaaggcgggaagggatgggctaactgtactgttttgtgcaaatgcagccagatgtatgatcaggactgcccttatctataaaattgagccttgaagggaaaagaaacactgcctgccactcttttggttgtacagcaagatggctgagcagcaactctttttctggatcagttatataaatgctttgtttttaaagtcgggaagtaccttgccagtaagggattgcctttaatgttcttttgatattggacaatgcccctggccacccagaaccccatgagttcaatacaaacacattgaaatggtctacatgcgcctaaacacaacacctctaattcaacctctagataagggagtcataaggactttaaggatcattacacacagtactctgtggaagagaaccccaattgagagaatatcatgaacgtctgaaaggattacaccattgaagatgccattgttgtttcagaaaaaaccatgaaaagccatcaagcccaaacaaattcctgctggaggaactccagatgttgtgcatcacttcacaggatttatgacagagccaatcaaggaaatcatgaaagagattgcagatatggcaaaaaaggtttcaagatacaaatcttggagaaattcaagagctaagagacaccacaccagaggaattaacagaagaccacttgatggagatgactccttctgaacccagtgccagacgatgaggaagaagacgaagcagtgccagaaaacaaattgacattagacaatctggcagaagggttccacttattcaatatggcttttgacttctcttataacatggacttttctatgaaacaggcactgaatctaaagcaaatggtggaagaagaattggtgctaaatggaaacatgtttagagaaatggaaaagcaaaaaagtcagacaaattatgatgtatctccatcagattacacttattgtgcctccctctcctgcctcctcttccacctcttctacttctgccacccctgagacagcaaagccaacccccgcttctcagcctattcaaggtgaaaattatgaggacggagacatttatgatgattcacttacacttaatggagagtaaatatattttctcctcatgatttccttaaaacgttttctttagcttactttattataagaatacagtatataacatatgtaacatacaaaattgtcgagtgcggtggctcacatctgtaatcccaacactttgggaggctgaggcagacggatcacttgagaccaggggtttgagaccagcctggccaacatggcgaaaccccgtctctattaaaaagataaaaattagccagacatgatggtgcgtgcctgtaatcgcacctactcgggaggctgaggcaggagaatctcttgaacccaggaggcggaggttgcagtgagccgagattgcaccactgcactccttgcctgggtgacagagcaagactccatctcaaaaaaaaaaaagtgttaattgtttatgttgttggtaagacttccgatcaacagtaggctgttactacagttttgggggatggaattttgactgtgagggtctgtgcccctaacctcatgttgcttaagggtcaactgtacatagatatgttacatacacacacatacttcctccctctctgtaatttggatcctatgcctattatcttttagtttactaacttgacttaagaagtcctgatcattttttgatgttcatgcataccgtatagatcctacctcatttgactcctacaaaatatttgttaagggtgttctaaaagttactttttgtagttaaactacactttatttacatttgtttgttatggaaataatgcataataatcgttaaaaatccaaacaaaaggggggaacatattaaaagaaaagtaagggtctccctgctactctacctacctacccacctaccttatctgttaccatatcctagacccaactgcaattaacaatttctggttttagttcttctggttcttttcattataaccttaaatactgtacatatacatcttgactcaccagctgaaaatccttcaaagggacaaaaacttattcttaactcctaatttaaaaaattgtattacttttagttttgctagaagctttcatgactttaggttgtttacctaaatcattatttataaattttacacactgtatattggctccctactaggagaggtgaggaattggtacattcttactttctcgtcttttcccctccccctcctaattttgttagtttcattctcatttttagtctgtcaagaatttgcattctttttgtaaataaaattacagacatcccttggtatccatgggggattggttccaggacctctcgtatacaccaaaatccacatacactcaaatcccacagttggccctgtggaacctgtggatatgaccattcgcatcccaagaatactgtattttccacctattcttggtttcagttgtggaacccactgatatggagggccaactgtatatattgaaaacaatttgcatataagtagacccacactggttcagacccctgttgttcagggtcagctctatatctttccaactttgtgcattgattgaaaaaccaacaacagtatgatattagggctataacagatctgttaggccaagcccacatgcccctgaacagaacattctgcacattgggccaacttccaactgccggcacctgaagttatttgcattatcagctatctttgtccaccagagcctgctctgcctgcattttgggaagacctaaagtgccaaggaattaacacaccctgcaagtatgctcaattgaaggcaatgaatagaaaaagacccctgactccttcacccctggatttcagggaggtaaatccaagatgtatgctaaggaggtgacacttaatgtcagacacacacacctgttatgagagtttcctgattgaataagaaagaggcattccaggcagaagtacccgaacatacaagagtgcaagaccaagaggctaaggcagattgctctgtgcaagaagtggcaggtagtgtggcgtggctggagatgaagaaatgactggattgggaaggactttatccaccaatctaatgaatttgactttcatcttgaaggtgtgaaatagcgtgctaaacaagtttaaaagcaaaatgtcattagcctatttgtatttagaaagagcactccagaagcaaggaggggatgggtgaattggatgtactgacactggaacaaggaaattattccaatagtccaggaaagaagaaggacatcaactaaaattgcacaagtgaacatggaaaaaagaggatgcgtctgagaaatataaatattggccggggcggtggctcacacctgtaatcccaacacttcgggagggtgaggtgggcagattgcttgaactcaggagttcaaaaccagcctgggtaacatggcaaaacccctctctacacaaaatacaaaaattagccaagcgtgatggcatggcctgtagtcccagttactcaggaggctgaggtgggaggatcacttgagcctgggaggttgaggctgcagtgagccatgatctcgccactgcactcccacctgggagatagagtgggaccctgtctaaaaaaaaaaacaaagaaatataaatattgtattagggtttaccaaagaaacagaaccaatacgatatatgtatgtatacgggtatatatataaggagattcatataaggaactgactcacaagatcactgaggctggcaagtctacaggatgagccagcaagctggagacccaggagaactgatggcatagttcctgaccagaggctagcaggcttgaaatccaggaagagtcagtgtttcaatctgagtctgaaggcaagaaacaagctgatgtcccagtcaaaagatcagaaggcaggagagattctttcttactcagggaggatcagtttttttgttttattcaggcttctaactgattggatgagactcactcatatgttagggaggtcaatttgctttactcaggctatccatttaaatgttaatctcatcccaaaacaccctcatacacacacccaggataatgtttcagcaagtatctgggcactctatggcccagtcaagttgacacataaaattaatcacaaatatgttccagtaacttagtttttaaacaactagattcttatgagaataaactcaggataggataggggaaatgctttctggctttccacttgcatattcttggaatgtcactttttcttaaatgttaaaaattgaaggccaggcatggtggctcatgcctgtaatcccagcactttgggaggctgaggtgggtggatcacgatgtcaggagttccagaccagcctgaccatcatggtgaaaccccatctttactaaaaatacaaaaaaatagctgggagtggtggcgcgtgcctataatcccaactactcaggaggctgaggcaggagaatcacttgaaacctgggagacggaggttgcagtgagccaagatcacgccaccgcactgcagcctgggcaacaagaatgagactccatctcaaaaaaaaaaaaaaaaaatgaaaatgtgtcgttaatcatcgagatagtctttcagtctgcactcagtaatattaatgccttctcattgaagtcatctattctgttcccataaagatcaggatagtttaggtagtggtgaataaataaggttctcaatggcctattagtttttttaaatgttcaaaagatagtagcatgttgggaaaagagatgaattccacatttcttttggtacagtacaacttactgaaattgctttcttatttcaacaaggatttaccaggttgtgtgtagtggttaaaagcatggactttacagccacattacatgggttcaaatccacttactagttatgttaaccacaggaagttagctaatgtctctctgcctcagttttctgtttgtaaattaggataaaaatctccgtagatgtgaatatgtatagctagatagtagattgtattcaaaatcccaatcataacataataaaaatattaactattattagttgttttgaatatacaacctaatttcattttctccatgatctgagcatgttgagttatttttaaacaactccattttacagatgagacagtgttccaataagctaggtagtatgcccacagacacacagctagcagctgagatgaaccacccaagtctatttggttttcagctcatgttcttttcatgatattttgctttctctcaatatttatagaatttaatttaattgactagaattaaactaagagaaaatgattgaatgaagagatgcagaaggcaagagatagcaaaggtcattctgggctgggcatggtggctcacacctgtaatcccagcactttgggaggcctaggcgggtggatcatctgaggtcgggagttcaagaccaccctggccaacatggtgaaacacccccgtctgctaaaaatacaaaaattagctgggtgtggtggcaggcgcctgtaattgcagctactcgggaagctgaggcaggagaatcgcttgaactggggaggtggaagttgcagtgagccgagatgtgccattgcactccagcctgggcagtaagagcgaaactccgtctcaaagcaaaaaaaagaaaagctacctttaccaaagacagttaaaatgatggccaccaaggggcagtgtgcagcaggcagagaaggtggctttttaaattatttttcactgcctgctgagacaaagatgttacaccagaatatgccaccctaacatatgcttctttggcataaggattattttgagctgaagacgattgagaagaaacaaataaaagaaaaactctgccttccctttctttgcctaaaggcaggacatgctagttaatgatcaacccctgacctaatcggttatgttacctatagattacagacattttatagaaaaagaaaaacacggtgaaaatccctgtcctgttctgttccattgtaattaccagtgcatgcagcccccaatcacatacccactgcttgctcaatcgatcatgacactctcatgtggacccccttagagttgtaagcccttaagagggaaaggaattgctcacttggggagctcggtttttggagacgtgagtctgctgatgctcccagctgaataaagcccttccttctacaactcggtgtctgaggggttttgtctgtggctacaaacctgtctttggccagtctaatttacaggacctcagccagagaactaagatgggtagaggcaatacaggagatagaaataatttaggtaggtagatagggtgaaagagtccctgacaaaagcttttcttctgacaaaaaacagctcagaaattacttccattctaaccacaggcagtccaaataaatcacttctcttttaacaaagagcagcctggaagattggactgtataatgtagataagcatctccggcacagagggagagtttcttgggtagtcaccaaacttacataaatgggtcccagtaaaaacagtaggctttaatgagcacattcctttccccttttttggacagggacacactaaggttagctagaagcttgcatggtggggtgggggaaatgcctgcagctgcaaggaggtacccaggacaaggcatggaaactccccctattcttgttagcacatgcaaggtggaaggagaaaggcagtgtggagtcgcccaagctaagagcctgcctgcatgataaaagaatggggtaggggctgccagagattccactctatacagatgacacacctggtcctaaccaggttttcatgccctatgtagataagatacccgctccctactagctcgttgataaaaaccctccattttactgcagcacggcaacccgtctgggacctctctctgtgagagagagctgtccttttccttttgcctattacacttctctaacttcaccctttgtgtgtctgcattcttcatttctgtggccatgagacaaaaaacctcagctgatatcccagacaacaaggctgctttagagggaaaacggatagctaatattatcagttaattggctatgttaattgataccttcaaattaggtgttttaaaataaatgctgagaacaatatgaaagtgtttttcttttactaattctctgaggattttgttatttatttagctttacaatgcctagccccctttataaatgtaattattgtgttgctaagtgcatgtatacaaaaaattcattggttcaaaagccataggcctggtaccatagccatatatggtacgttcaaaccttggaaatgcacattctcagtgtgtcggaagctctgtactgctccttcttgaagaactactttgatttgtggttaactcgctgttttgactcactgttttaactcccattacttcagtatctgacattcagcctcagaatctggccagtgtatcagggctggaattaattgattaacaccattagatggcagtactatttaaattccaaaaatggttataaactcattctctaaaatgtgtgtcaaatagaatatttgactgataataactctaagagcacaaaaggattaaacacacacacaagacaaagtttgggatatacccattggaaaaacccttggtctctttaaattttttttcatatgtatgtatattgcacatattgccggcctctttatctcttttttccttttttttttttttttttttgagaaggagtcttactctgtcacccaggctggagcacagtagtgcaaacatgactcactgcagccttgaactcctgggctcaagcgaccttgtcaccttagccactgtgaccagccttcttttcccttttgactttgttatatcacactgactctagaaatgtggttctttattggggcgattttgccctcccccggggacatctgacaaggtctggagacattttgattgtgggtagggggagggacactctgctacaggcatctagttggcagagcccagagataccgctacacaccctacactgtgcagaacagcccctacggccaggaattatcaggcccaaacaaaataccaagttagtttttaatttcaaagtttacgcgtaacattattttttagatataaaaaatattcacacattaatttgatcacaagaaattttaaagaaatttaaacattttcagaaaaggctacttcaaggtgtcatgacagctttggaccaaacattaatgttctatatgactttgggcaagtcagtcatgtttattagacttaataacccaggtaacgttagctgttggagggttttttaaaaaacgttttattttgaaaaaacttcaaacttaaaggaaaaatggcaagaatactacaaagacctatttattcagatacaccagttgtcacaattttgccatattaactttatctattgatcaatttctctttcagtctattgacctatctatcttgaactatttgggattaagttgtagacatctgatccccttacccttaaacactttaccacgtcttcctaagaataagaccattactccacacagtacacttatctaaatcaggagacagcattgttataatactgttaccaagtggcaagctggtgcactgtccagacagggagagagggagagaggacctgatttgtaacatttgccagttcccatgtgtgatggtttactttggttcataactaccattgtccttgttacagtcttttattaaaatgtggggtgtgttaggccgcaagggcaggcctcaagaaacagaatctctctcctgccctcctttcacctgccccaaggcaggattccatcttctcccacctttccaactgtgggtcttaagacttttcagagagggtcctgccatacacactgggggaaggaatgctgacgtcatgaagcttccatgaaaactcaagaggactgagttcagagagcttccggatagctgaaaacatggaggttcctggttcctggagggtggcgccccaggcatggaagctctgagccccttcctccgcacctcatctcttcatctgtatcctttgtaatatcctttattataaaacagcaaatgtgtttccctgagttctgtgagccactccagcaaatcaatcaaacccaaagagggggtcatgggaaccccaacttgaagctcaatcagaatttcccaaggcccagatttgcaactgatatctgggggtgagggtggtcttggggtctgagccctcaatctgtgggatctgatgctacctccagatagatagtgaaggaactgggtggaggtcctggcttgtgtctgcctcttggtggtggggagaagttcccacacatatggtcacaggagtcttctgtgttgatgattgctgttgtggtgtgagagcagaggaaaaacacagtttgagagagttttcccaaaataccatggtaagtggctcatcatggctgatttcaggttatcaacagcttaacaaccagctcaaaacatgctttgctgtttaacaatcaactctcagggaatcagtgaactggtgagcacaaagctactgttaacgaatccatggttcatatgcaaaagttaccaactgctctaataatgtccttaatagtcatgtttttttccaagttcatgattcggtctgtatcatcatttgtcacctctctttagtatcctttaacctggagtggttccagcctgtttttgtctactggggcattgctgttcttgaaagagtacaggtcaggtgttttgtagaatgcctttcaattagggtttacccagtgtcttctctggattagatttacattatgcgtttttggcaggaataccacatacatgatgtttacttggttcattggataagaagcccgtgatgtcggtttgtcctattattggtgataccaattttggccacttggttaagtggcatgtgtgaggttttttcattgtaaaactgttatttcctttttgtaattaatatgagacactttgagactacgcggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttgttgtcttggagcgcttgctctggagaagccagaggtcatgtcgtgaggatactcaagttgccatttggagaggtgcacatggtgaagaaatgaggcctactgccaatgaccatgtaagtgagccaccacggagatactcccatagccctgatcaagccctcagattactgcagcctcagctagcatctggactgcaatctcatgagtaggcccaagccagaatcacccagaaaagccattcccaaattcctgtcccacaaaaactgtccaaaaataaaaaatagccactaagttttggagtaatttgtggcatggcagtagataactaatatagcatccattgaaaacttttttcttggccgggcaccgtggctcatgcttgtaagcccagcactttgggaggccaaggtgggtggatcacccgaggtcaggagttagagagtagcccagccagcatggcaaaaacctgtctctattagaaatacaaaattagccgggcgtggtggcgcacaccagtcatcccagctactcgggggactgaggcaggagaatcgcttgaacctgggaggcagaggttgcagtgagctgagatcgcgtcactgcactccagcctgggcgatggagcaagactctatctcaaaaaaaaaaaaaagacaacttttttcttcaatcagttactaataagatggctgcaaaatggtgaggtttcatcattttgttttacttcatcataacatctacatttattagtaggcatctactctaaacaagagcttttccttcttgttttatttatttatttatatcagtttggtgtatagactcctattttactcagttagttataatccattatttttattgtttattttgctgctcagattgtcccagccctggctggtgtccttttgactcctgtgtccttttacagagtcagtggtcttccctctcccagctctggagccagccatttttccacgtatctctatttccttttagtggagaatggtattcagaaaccaaacttactgtctataaatattattctgtacattctgctgaaagtttaaaagtgttgctttttatatttgaatccttaatctccctggaatttagcgtatggagtgagggagatatcaaatttcattttttcacacatatataaccaattatttcagcatctcttatattgaggagttgcttctttacccagatagctacaatgctgacactaacataaatcagcttgatatatgtcagtttttttcctgggttctccattctgtttcatttgtatgtgtttccataactacactaataacagtgttaaattattaaaactgtataatatgttttgacatctgatagggcaatctttcatttattcttctctttcaggaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaagaaaaaaagagaataaaacataatttctttagaaaataaattatgacagaaagccatggcttcaaaacagatgaaaactaaaatattttaaaataagttaataaacatctaaaatgacattagatatgaaaaaatgacgtgtcagatttagaaatatacagaaaggagatgacaaactcagaaaagaagtaaaaattttaaaaacatttcagaaatgaagagagaaagaaacacgagcaaataaacagaactgataatgcattaaaagaaaagatgaaaaaatatgaggctataaaagagacgtgtggtacaggataacggtcacccaaagatgtccccatcctaatctccagaacctgtgcctgtgtcacctgacatggcaaagtgacagcaaatgtgactaccttatggatctcaagagagaagcctgatcctggatcatctggctgagtccagcctaattgcatgggtccttaacagtggagagtcgactgcagtggtatgaaggaaatgcagctatggaagaaacggtctgagaaatggtacattgctggctttgtggatggaggaaagtggtcatgagccaagggatgtgtactacctctagaagctggaaaagggaagaaaacagatttgccctaaagcctccagaatgaaatccagacctactgacaccctggttttagctcagtgagacccatggtgggcttctgaaggcaaaattgtaagataataaatgtgttaagacactaaatttatggtgatatgctacacagtggtagaaaattagtacaagatgaaaaagatttaaaaggaaatgacagatatacatatataggaaacaggcaaggaagaccctgtacacatgggtacacgtgcatgcgcacacacacacagatatattagttcctaaagaaataaaatcagccaggcgcggtggctcacgcctgtaatcccagcactttgggaggctgagacaggtggatcacctgaggtcaggagttcaagaccagcctcaacatggagaaaccctgtctctactaaaaacacaaaattagctgggcgtggtggtgcaggcctgtaatcccagctactcaggaggctgaggcaggagacttgcttgaacctgggaggcggaggttgcagtgagccgagatcgtgccattgcactccatcctgggcaacaagagtgaaactccgtctcaaaaaaaaaaaaaaaaaaaagaaaatcaaaaggaatagatccaaacaaacaagatgtataattcaggaaaggtttcctgaaataagcatatacttgaaacgacatattgaaagattatctaaacaccttggaaaatggagtccaaatatccaataccaagacattctagtaaaattattggaagagaaaggaaagaaggaagaaggggaaagaaggaagaaggggaaagagggaagaaataaaatttcttggggttcctttccccaccaaaagaagatgcactgacattttgaaagaaaattagtttgacatcagatttttcaacagcaatgccttatgtcagaacaaaatggagttacatattcaggccaagtgtggtggcgcacacctgtaatcccagcactttgggaggctgaggcgggtgaatcgcttgagcccaggagttcaagagcatccagggcaatgtggcaaaaccccgtctcttcaaaaaattagccaggcatggtggcatgcacctgtagttccagctattgaggaggctgagctgaaaggatcgtttgagcccaggaggttgaggctgcagggagctatgatctgcactccagcctgagtaacaaagtgagactctgtctcaaaaaaaataaaaaaaataaaataaaatgaaaaaagatactcgaggaaagtaaagataagccaaaataattttcaagtataaaagcagcaaagtgttaccaaaatgcaaagactcaggaaatacagttaccataagctattcctaaggaatctactagtgaacaagtttcaaacagtcacaatgactgcagagacattgacgtaaagacagatggcaaatattaagtgggtgggtaggtagatacagctgtagatatggccagctgtttgctggaggcaatttggacaagcttatgagagccaatgaacttttcaagaattttatgagttggttattaaacatagacattatgaacagttaaagtatatacatgtacgtacatttaaataaattaaaaacagtaaacactaaaaacacatcgcttcataattatgttactacattttacaattatctatgcttttgaggttatttacattgattgtatcaaatggtggagatagggtcagcttctgcacatcttttcccgaactccacatttaatgatgtcaccttgatagctcaccaatggtgaaagtatttactccatggaaagctgcaaaatgctatgaatcagggctttttccccctttttctggagagtctcttgttaaacatttcctagcacatcaatggattcaaaaaagagaagctagtatgcaacagatccatgacttgacaatgtagatacaccaccactctgaagacatatgaggagggcactgggagagcgtatgaaaaatgtctttttagcctttcagtaatcattttgggtgatagtgatgtcatcgttattctgagaatggagtgtgtgcaatgtcaattaaagcaaataaataatcatatgatatatttaattgtgttatcctctctgttttgaaaaccaggatttggccgtggatggtggctcacacttgtagtcccagcactttgggaggctgaggcaggtggatcacttgaggtcaggagtttgagatcagctggccaacatggagaaaaccccgtgtctactaaaaaatacaaaaattaggccgggcacggtggctcacgcctgtaatcccagcactttgggaggccgagg

SEQ ID NO: 5546 - DNA, 406 bp, Homo sapiens
acaaatttggagatggagttctcactgaaataatccaccctcaaatgacctagcttcagaaagtgatcatccccaccacgtaaatgatgtgtatcccaatcactgaagatttaagactgtgtgtgtaccccagtgactaaagtataggttccttcctttcacatagtaacaacccattgctaactggatgctaaacatcacccctaaatacttaatttgctcctgttatctgggcctacaaaaagatacttgaaagtcggtatacagaaaatttctggaagaactgcttaagaaagtgataacaatagttacctctggggaatgggactagatgacttgaggatgacacactatttttgtaccatcggcatttatttttataataaaaaaatacactgggctccta

SEQ ID NO: 5547 - DNA, 2269 bp, Homo sapiens
tcccggcccgcctcctcctaaagctcgggccctctgggactgctaggaggggaaaatcgtttcaggattggaaaggaaggtaccaaaatgattggagagggcctttccccgtttcactaggcacttggagaagctgtgacagagagctggacacccagcgcgtgcggaccccgtgcgtatttccccggagtccgcgttccgtgaaagggagaggggtgcggttagctccagggattctctagccctggagccaccgctgatttgcgcagctagttgcctgggggtgataaacgggcgtcgtctctcttcaggagcgccaacactaccaagcttccccctgcaaaattcagaaaggatgcgctttggtgagaacttggctcagccttcccgtggcttgggagatgaggttggagtgagaatgtcaccagacctcggaaggggacataacggtacctcctagtcccaggacacgggtacgtgggcggaggtggggtgtgggaggttggtgggaagagcgcaggttactggactcaaacagttcctgttttttttttgtttgtttttgttttcgtggggtttttccccccctctgcttggtgcgttctgcgcagccccagagggagtctataatgggtactgttggcactctgaggtcttggggttggggggcaagggtgattaaaaataaaaatgattaccaagatgggctccggaaagcttttcacatccagcgggtggtggaggaggggatggagttgccgaggccgtctcgggagcctcgtttgtgcgctaagccacttagaggcgctgacttgcccctttagtgcagcagctgatgctaatgacttgaggtctttaacagcctgcaagttgactccttcaacggggctgcaacaccacgtcgctggggaatctcgggcttctttttcacagttcaattctctactcctaaaggaagaaaggcctttgagtggtatagacagtttctcaactccttcagccccacacacaccaccactactttgaagtgggcaatctgtcagcattaggataaatcggattgtgtagctagctaaagtggaggaggcagaaccacaacgtaaggagacagcctcgttgttgtttttcctagtgttgaaataatgtatttggggagttggcaaagagcagcttaccatgttagtttgatcctctcccagctttgagacccttctctggaactcagtggggtattgaggctttgacagcctggtgactgcagtcccaggaggccaggggaggattttgctgaggagaaacaagtgcaaggactttcccatgaagttcatgttcttccttgttctctctctctctctctctctctctctctctgtgtgtgtgtgtgtgtgtgtgtgtgtatttccttctcttttctggttagtaccccaggcaaattccgaattgctgcctagaattaagctgaaattcacagaaggaagggctgcaaaatccccatatattcagagaaaatggggaatcccttagttttcaggttagctactgacttttcaaagaaagcttcttgaagtgcagttttatgtactttggctatgtgcaattttatctacttcggctaaggttggctcctaatgaccaaggctcagtgcaatgagggctctctcacatgcctgtatgtaagaatctgcagctatactgagctaccaattgtcttctgactgattgctccattgaatactagattcacttctcagtctctctctctctctacacacacacaaacacacacacacacacacacacaaagtatggacacatggtcccctaatacttctttaaagaatgggtggaagcattagaaatgtgaaaataatgtctcaaacatctggaaaataaacctcaggtttgaagaatagtggccagaaacttaagttaattcagagtagaagaaagaagaaaaataaagagcagaagaggcacgggtgtaaacaacttcaagttaagaaagaaaagtagccataagagagtcatgtggtcccttagaaactagactgataaatgcaatatggtgtgtgaggagcagtgtttaagaacataatttcattaatctgtctaacagaacactccttaatgctttcttttgctgttatttagagaattggaattttatctttcaggaaaagtcatctgtccatgcaaaccattaaaaaattatcttacatattgtaaatatgtaagcctctactccagaatgtggacatttagaaaataa

SEQ ID NO: 5548 - DNA, 286 bp, Homo sapiens
gaaatccctaaagtcatcagccccatatgtaactgcaataaagaaggcaaaaagaaagctgggttgtgataccaggagagagtatagtcagagtttaacagaaagcattacttttttttaaaaaagaacgttttattactcaaaaccactgttcagctactcatctgctattgctggcccttctataggcaacagaaaagtaattactcatgaacaggaccacaatcccctcaggtgtcaactcacagcattatatcccataaagtggtttggagcaattactgat

SEQ ID NO: 5549 - DNA, 3950 bp, Homo sapiens
aacttggggtgggaaaggggaggtagcaatttttgaagtattttagccatttttttcatttaaagaaaccacttgtccccatttcctcttctccactttctcataattttgttttaagaggaacactggttgttttttatacttctcctaatctttaaaaactgcatattgttaagaccccagtgtatttaataggtattttataagcatagcccattggctcatgttagtgaaaccataatcctctttgcttagaacattaaactcataagaagtactacaaaccccaccactctttatagatgtattgtaccactaatataaacagctaaaaaatggggaaattgtaatgttacgcctgtgcaatttttaagtggcatattatggcagattaaaatttagatacttggcttttcttgggcaagccactaagttgtggcggaatgttttctggtgttcttggactgcaattatgcactattaaagtagtggcctgctacataactgcatttagccagcatttctgcagtgcgtaactgtgaggaacgtagtaccgcaaatggcaatggacattaggacccggatgtagtattcctgcttgctccaagattctcattgccgactgcatacaggtaggtaacaagcaatataatctaacttggtgacttgtatgtacttttattccgtgggcattctggcatcacatttctgacaatgaaattacagtgcagcacctaacacttgtatggtaaagctagcttacatcaaaactgtgtgggtgtggggttagagctgtaatttgtcaggcagaattcagtgctgttgcagttctcagataaaaagtgcaaacttgattctttggtatatctgactcagttgtgtggtttcctttagttgcattgtaactgaagataacatggaacacatcagtggtgtgggggagagggaactaaactatacttgggaactagggtgcttttagcaccttgacatggaccgtatagcatgtgataattagtctctattgtagcaaactgacctgcccatagatcggcaatatcagtaatttcattatgcaatcttggtaattctacaagttgagttgaactaaaagtacaggtttttttgtaatgcgatttaaaatttttaaaaacatgggcttcatgaaaacaccattgttactaacttgggcttagatgggaatctaatgtgaatagttcaagttatgggacttgtctaaatgtgtctatactctaaacctgggggaaggtggtgtggaacattgacttgactacagtcgaatacatgttgggaatcattcccaatcataagacatcgtcgtttctgtaggatgactgcatatgttcagagtagctttttgaatttggttcccttagctttagggatgtgatgttatagtccaaaatgtttacaagaaaacctaagtcttcaaaagcacaacttttgttgcttaggactttgcatcaactgttgttccagacctcacttcaacttcttggtctctgaactggttttagctagcatgcatgagagacagttttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacaactttggactctactgatagatgaaagagcaaatgatgactagtttagcctctgcatatcaacaatataatgcagatcaagtataatgctcaatattagtgacatgagtatcactaaattacatagaaccctgatggggtttcctgtgtcgtaatccattaaatcggtggccagtgcttgctgccgtggtttagtgattgggtgttagaaataaaaactcaggtctatttcttaccagtcagtaacaatttttagagaatgtacttggtatataatatatggacttcaggaactttattggggtggggggttaattttgccttaccctgttcactttcagatgattaggcttttgcactttagaatgagaaacttgtgacgttagtgtgttcttactagctttaatttgtatgtagcaatgaattgtgaatcttagtgcagtgggtttttttaaaaaactcaaaaagctgggaattaagtggtttcagtaataatgctataccgaggtgcttgcattgtatttcataattttgttacaaaccaaaattatttttaatgagaacagtcttgggttcagaggtgtgatgccagaatgtattttcgtactgttaggcccttggaacagataccggtgctttctgaaagatgaaagaaatgcaatgggtgctcttcatgcaaggttgcaaacctaccaagaatgcataatagtctcacttttccccaataaagagatgcgtgtgactagttttggacttttaaccttaatgggggttgcatgtctcctattgttaatcattgtcagctgcagtgacatgatccacagtcctgcatttactgcctttcacttaatgattttggacaggttttagagagccaggatgttggtctgggcctttatttggttttggctttagctgataatgttttagtgatgtcagctagtgcagttctcaaatggctgcctattagggaaagaattcagaggatttgactgctcctaatcatctgtcattgctgctagataatgattggcaatttttaagactcaactggaaatctcaacagttgctggtaaaccattaaccataaaaacgttgcttttgaacaccagtgctgaaaaaaatatttttttttttttttttgagagtgaaaagggcttggacttaagataggacaatgtggagaatggggggaagaatgcaaaacgatatagtatcccttatggatggtacatgtgcaacagggaactcttacttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggacttagatgggaaagaatgaggtaaatacaaaggattgcaggacaacaactacagcgttgtgtactgtgggaaggggagttgggcactcttggaggactcctgctgaaggtggtcagcctgcctgacaatggaagacatacttgaatggggagcagggtatgtgctttcatatgaaaaaagagctgatgttaaaactcatttggtgaggtcaacgttgtcacataccttcacataagggatagtatattttgggttgcagtcaaacttgtgctcagactggtgaaactgagagtcaggcttttacattttaaagaaaatacagttttcattctaattcaggtgtctacttattttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatccta

SEQ ID NO: 5550 - DNA, 1555 bp, Homo sapiens
ttccaagtaattagcactttgcatctattttatttattgctactactaagaaaacataaccgtgaaggcataaaagcaaacattttctgtagacacatgaggtgacacaagagtgttgaaacttctttaaggataaaggcctgatgttaggcatgtcgtgagcgcaaaaccaatttctgtgtaactaaatttaaaagagtcatattagaggggagaaatggaagataaactgcaaaacgtaaacaatgattacttaggtgatagagttatgtctgatctttgtatttgactcatctgcatttataaattttatttaataagccttaatttcctaggccatatatcatatacaaatataagttatacctaacttataggtattataatatgtatatatacataaatgtatgaatatttacatatgcgtgtgtgtgtgtattctttcagaaaagcaaagttttcttcgggctttaaacacgcagcctctggtaaaggtgctattggtacaaaagttcaacaagcatagctccaagctttgacaattttcttacactttactaatactgctgtccaaaaactatgagattttcaaagcagccaacattgcagtggtgcaatggttaataacaagagagagaagagtgtggcctgaggttgtataaatgttttctcaatcttgaatcattaattttctccaaggaagtttctaaagaatcccaaatagtgcacactatttctgaaaggaacaggatttttttttctaatcataaaatggacccagacatctcagcctcttggtgtaatctggatatcagatgcaatcagcgaacagcctgagttttggaattagatctgagttcaatcccatatctcccatttactagctgtgtgatcttggctgaattactgaagctctctgaacctcatttcgccatctgtaaaatggggatgtggttatcttccccactacatggctctcgtgagaatccgcggagatcacatttgtaaacacttctctcgctatgcctggcactttgttggggcccaataaaataaaaatccatggactctcagaggctccggtactcaaatgagcctcctggatccacgtctctttgattagccatctgcaagctggcatttctgagcgagggacttttcaaaacaggctgctcaagtttcttggccaataataggcgccgggttctgtgcggtgggaacgagtaccaccaaccccagcaggagaccaagcagaaatcaccatgggagtgcaagctaagaaagggcaaaagaagaaagagaagggcagaaaaacaaaacaaaatgaaaccactcaggcagcgacttacagtcttaaagagagaattcccggaagggagacaaggcagtttctttttctgtgtgacaataaaaaacggtaaacaagcctccagaagctcattcagcccccatataactttttcgagaaagaaaaggtgccgttcttccgagccctccggcttaaccactgcttcggtgctgacttatttcctacgtctgagaactgccagaaaat

SEQ ID NO: 5551 - DNA, 5958 bp, Homo sapiens
aaggtggactagacaaagttgtatctagacccttatcatatatgtgatttgcaaatattttgattgtgtgggttgtctttttacttttttaatagcgacctttgcagcacaaattctcattttgatgaagtcaaatgtatctaactttcatttggctgcttatgctttcagtgtcatctaggaaccatagcctaatcgaaggtcattaggatttgcacctttgttttcttctaatgattttataacattggctcttatttaggtctctgatacatctgctgtgaatttttatgtatggtacgaagtgggacgggggaggggtgtcccactttaatcttttgcacatggatgtccagttgttccagcaccatttgttgaaaaaactattctttcctcatgaactgtcgtcttgcctctgttgttgaaaatcagttgactgtaaatgtatggatttacttcagaactgttaattttattccattgagctatatctattatgctagtaccatacagtcttgatgactgcatctttgtaatatgttttgagattggaaagtgttcttgggctgagaaatgtaagaattttccatggtgtttgaccttgagattagatcattccagttcataagtatttgtatatgtcttagtcagttttgtattgcaataaaggaatacctgaggctgggtagtttatttaaaaaaaaaaaaataaagccaggccgcggtggctgatgcctgtaatcccgcatatatattcacaggataacattatatgtggtattttagaaccacatttctaacattccatttatcatgttttgtatttgcatagtattccatttcgtagttgtaccataatatctttagacaatgcttgtggtcaaataatttcccccaatattttactgttacaaaaaatgtttcgatgaacattttggtctaaagttgatggatcaaggaatataggggtcattataagttaacaaatacagcgtcagatcatggtactactctgctgaaaatcccccttggctcccatcttactcagagccaaagctaaggtctttaccatgacctaaaataccctcagccatccggagtgtgcatgtatgcatacacacagacatgtacatgccactcactcctgcctctctagctcatcttctcctgctcacccctgacttgttcccctgaagctattcctggaatacaccaggcaagcaagcccctgtgtcagggccttggcacttcttccttctgcctataacaattcctccaagtatccacaggcttcctctttcacttcctttgttgcgttggctcagatatcgccttatctgagtgcccttccttaactatacaatacaaaataagttcatgaatctgccctcacccctacattccctgtttcctttaccttgttctatttttctataacatttacctgacaaatcttatgtttgtttattgtcactcttcttccagaatgtaagcactgtgaagtcaaggactttgttagttttgatcactattgtatccatgggttctaaagcactgcctggcacatagttggcactcagtaagctaagaaataataagactaacatattgggattgtggcaaggaggtaagtatactccactttttcaaggggattataaagggcatcatttttaggtgggagatattggacataggagtttgtgaaccaagagacagagaaagatgttacttggagatatggaggttataagtatcagaagattagaagttccggggatgttttaaagtaaaatttttcccattgcaaaataatagatatctgttgtaggaacgtttagaaatacaactaaagcactttttgctttacttggagtgggtgggactggaattgggaggaggggccatggagaggctgctttttttcattgtgcatctttctgtaagacgtgaatttataccatgtacaccaattacttaaataataagagcatgtttggacttccagtttctggtgatggctggttatgaaaacttgaagaaacaaaataatggctttttttaagtgaagaactaaaaaaacattgaacttccaggccagtttttggataaaagtctataaccagggagggaaatggaatactggaacaaaaagctgcctgtgctgagacagcagttgctgataccacaaacacttgtctgctgtttctgtggcctggctgagccaagaaaacatgttaaagcacagagcccacgcaagacagtgtgcttgcaggagaccctaccaacaggaatcggataacaaggagctaaaggtaaggaggagtcagagctgaacccagtgccctctttgtccacagatcgaaaccatttattcctttctaatctgtacgccttttcttttctttttttctctttttattgtttgctcctccttcccttcatgtgtcactttccacctctgtcccttctctccccttccctctctcactcctcccttattacattggctaatatgaatagatctcactactaacagccgagagccttgcgtgttcttgaacttaaagggaaagcattcagtcttttgctaagaggatttattatgactggatattgaattttggcaatttttttccccatcaaatgaaatcatatgatttttctaatcagctgataggatgacttccttgattaatttttgaatgttgacccaactttttatgtatttatggattcaatttgctaaaatgtggttgaagactttttatatgtatgtctgtgaaggacatggtctgttgttttcttgcagtatctttggttttggtgtcagggtaatggagggctcattaagaaagttgagaagtgttctctcccctttcattttctgaaagagtttgtatagaatgctataatttcctctgcaatctgttgtactgctttagctgcatctctcaaattttgatttgttggttgaaaagaagccatgtaggattgacccataaaccagtgcaagaattttagagattttaaatcctaaaaacattaaatccaattctcatacaaactagcactttgtactaacatttttacatgatgataaagtcaataagacaatatagagctgttttttaaactaaaatcatttcaatttgtccaaagggatatgatcataaatgttacatgaactcttttaatagaattcattctaattttgatacatgatgaaactatgtattcataaaccaaaattttaaatcatgtcaaaaggttttaagtttcctgctttttgtatcttccaacctagtaaccaagaccattattcaaactaacagttaacttttttctcctatattagttttaggaagaaaaatttaaagaaccagtgccagtaaaacttgacaatttttaaaaactcgtttgaattttatctggactgtatgagtatgtaaataacatcataatacttttttattaattcacatgtttttctaagagcaggagacagagaagtagaaggcagaaaatgagagccagctatgggaaggtcagacagggcaaaagctaacctaccacctgaaaatgttacagttctgaaaaattgaatcttttaaatacaattgtgggatttatagtattacccatgtcaatttgaagagtttgtttctgtcctactattaaagatacttatcttcttgggctaagtggatcgttggaatttggatgctacagtacccgtttggtgaccccttttataatcactcagaggcttctggttctttctcttcttgactagaatggaaccattttccagtgactttttaaattcacaatatgaagtttttgtatcctagacccacaaaaagatgagctgcttgacagaggtcaagaaggttgtggagtgggtgggctgggacaggattcgggaatccttagcagtggcacaaagttctgaaaatttctctaaaagtgaaactgctttaactgcatcccaaagatttttatatgttgtattttcattcccttcagtgtatttttacatttcctttgagactttctctttgaccattggagtatttaaaagtgggttgtttaatttctaattgttttgtgattttcctggtatctttctgttattattgatttctagttagattcattatgaacagataatatattttttatgatttcagtccttttaaatttgtgaaggtttgttttacatgacccaggataggatgtggtccatcttggtatctatttattagttgccaaggccattttttccatatggccacacctaactgcacagaaggctgggaaatagattttagctgtgtgacttagaaggaaatgggaatcaagtctggaaattacataacactctcttgtttttgacttttttaaaattttctccctttattcccattcccaatcctatagttatttaactacataccctagtgtatttaatatatgtccttctgatctaccttctgtacattttttttttttttctcagtctcaggtatttttttatagcagtgcaaaatcggcctaatatattgtctgtatagcattctgatgattagttcttcactgtgtattaagattgacttatgttgctgcatgtatggctaattcatccctctgactgcttcagaaatattccactttattcatatttattcaacattttacttatctattcccccgtgtactaaaagtcaaaagcattactaatttaataatgtcatatttgttcttctaattattttttgctgcataacaaagcactcctaacttagtggcttacaatgataacagtcatttattttattcaaaaatctgcaatttgggctacaattggcagaacagctcatctttgctccttacagtattggctggagttggcgatgactcagcagatcaaggctggaagactcattctcgtcaggtggttgacgttggctgtcagttggaacctcacctggggctgtttgccagaacacctacacatggcatgtccatggagctatttgacttcctcactgcaatggctgggttccaagagcagttatcccaagagaacaaggcagaagtgcatgacttttagaatcttgtctcacaagtcacacagagtcacttccaccatcccctgttggtcaaggaggacatgaaggtcttcctcaaacagcactgcttttcctaatataagcacagttcttgcacatagataaaactgtctttaggatagagtgaaaagagaataagaatgttaaatttataactattaagatgtattgaaagttgaataatgtgcagaaagcaaatcgctctacacagaaagagagggtgatagaagggttcttggagacaacaagcatgagaagacttatctagggtttgatgagattttcagtaagagctttatcatccccacaggggcaaaattaattcttgggagacaaaaaggaacttagttattcgatggtttgtggccttcagagggttgcagttgtacataaacagaaacacagtatatcagtggtattaaaatttcaagatgggagagagattggggaaaatatctaaaatgtctccttacaggggtgataatgagaagcaatggactagaggattcaagtggaagagtcttcatcacccgtgagttctcctgggaaagtgaattggaaacaagctaagtgcattttctcagcagaaggaagatcttacacatcacctagtgaatatccagttgggaatctgaaagcagcagtgggcaggcaggggaatcaggagcaatgttcatcagtgaatgaaaggagtgctggaaagagaaccaaatgctgacatcaaagaaccttcaatcatatgattttagtgtggaaagccagatgatacactctaacatctgtgaaatcaaatcaaaatgcaaattggtttttggctttcctg

SEQ ID NO: 5552 - DNA, 13291 bp, Homo sapiens
atcccagcccagctagttctgcccatgcagcagagctccacaaaagtgcgggaatgtctgacagggaagaatcagagaaaccttcaccagcagcccgacattcacctggacggacagtgcacttttcttacgtctgggcagggaaggcagggcgcaccatctaccgcaggctaggatgatcaccaaccgccccaccgcaccctgcgccagccctacggcgcccgcgggctgcaagtagcggcgacccaggagcatgcgcgctgccgcccctggcctgccaggacccagagggagcggagcacgcgcctttgggaatcttcggtgcgccaagtctgttcgccgccggggtctatcacccccgcccctcgcctctgcccgtgagcgtgtgagttgtagcgtaccctggggtctgttctggaggaggcctgagagcggggttgcctggggcgtgggtctctcatccctctcgtcctggtgaagaagaagagtatacccagcgggctggcttggctttttcagaggaaacagagactctcagacatgaatactgtgacactgaccaccaggccaacttaacatcagcagatatcctgtctcagatgaagagacagttaatcagagacttactccaacccagaagtttataccaaaagacttgattagcgcaataaaagcactaaatgaggagctcggattaattattgatttaacatacaccacaagatattatgaagttaaggtaaagttgcaaatgtatattgttatcatgggtaggtcttaaaatagaaagtttgttttttgttttgttgttattttgtttttttaagacagagtcctgctctgtcactcgggttggagtgcagtggcgtgatctcggcccactgcaacctccgcctcctgggttcaagtgattctcctgcctcagccttctgagtagctgggattacaggcgcccgccaccacgcctggctaatttttgtatttttagtagaggtggggtttcgccatgttggccaggctagtctcaaactcctgacctcagatgatctgcccacctcggcgtcccaaagtgctaggattacaggcgtgaggcaccacatctggcaagaattttttttttaatactgcacttggaaagtgaattaagatattctcttggttattttaatattaatttcagaattgcccatgaataatctcttagcaatgtttttagtccttcatatactcatacaatattctttttctaaaaaccattggttgtgcaaagaggaaaaaaaacactgaacttatccttttaaaaaagcaaaataactagaaggaaatatagttgcaaataggaaaagtgaaaaagggacagagaaacaaaaggagggaaagacagcaatatgatgaaaacggaagaaataaaaacgtaagtgagatgggtattacaacagtaatttttgaactttaacagagaaatctttcaattaaatcttgctccgaagcccgttatataaagcagatatggtaagtggggagttgggttggttgaagcaggggattgaggatccagacttagtccacttgacatgataattattctccttccttcactttccacccacagactaaggggcagaaggacacttcgaagagcagaattttaaaaccctgctctagaggaaaataatttttagaccttatgagaaaactaaaaattgcagtgacaagatatgaaagcatctgtcttagcagttcacatgaaaaagtggaattttactagatgcagtatgatgccagtgattaaaaagctaatgcacttttaaagtctgatattttaaagttccagatttaagtcaaaggaaatagtagttttactatgcatgtggatggttctaccatttttcaagtgttgagttcaatggtaatactaaattttctttcttttttttttttttgagatggagtctcgcactgtcgccccagttggagtgtaatggtgcgatctcggctcactgcaagctccgcctcccgggttcatgccattctcctgcctcagcctcctgagtagctggaactacaggtgcccgccaccacgcccggctaattttttgtatgtatttttagtagagacaaggtttcactgtgttagccaggatggtctcgatcttctgacctcgttatccgcccgcctcagcctcccaaagtgctgagattgcaggcgtgagccaccgcacccggcctataatactacattttaaatcactaaaaattcaagatggataatgactgagtctcatgtctcctataatatagtagtaagacagttaaattctttcaagacttcagtttttgacctccacaaagacagcaattagaaattgattttctgaggtcccctttggctccaaaatgcaatgattaaagttttcattgaccctgcttactgcctttatagaaataattcccaatatgtggaaagggaatgcagagaatcttaaatgggacataatcactacagttgtttgtatttggagtatatagaattagagccaatgacaacaaggtggattttttttttattgtttagtttaatacttttacaaccttaattttaagggataagagaccattttcagcttaggtgttgatagtgctagagtttcaaagtgtggaatatgtgataaaggatttttatgtaaaattagacatagtattaaaaccagagctagacagtaaagaaagcagtaaaaaatagattttactcaggaactattggaataaagtaagggacttgagtatagaactgtgctcagttctgaaaagaagaagaataaggggggattcataccaaggaacagagtggggtcggtggatggaaaattcctaggaggaaacatcaaggtaagaggtaattctggttaaacagacctaacaggattcttgctgaaggcaggccaggatgatcagacaacacctcgggggcaatggaggatgaggaatttgatcagatattgaaggaggtcagatatgaggatgggattcttacaaaactgacttaacaggattcttgctcttgaggacaaggcccaagtaccgggcctagtagagaatgggctcaaaggaacctgactaaattttgcttaaggagagtctttgtcagtagtcatcatacttaaattgtttatttttgccaagtacctcttaccaaagctttataagcatttaattgtgcttctcattatgagaacagataaaagaaaaggctattaaaagaaaaggaattgttattagccaattcataaagtaggagagagttgttagacccaagatttcagagtaagaaaaaaaaaatgacgccactgggacttctgctttcagataagaggaagtaacagggaccagattaaccctcccacctgaaacaacaaaaaaaaaagtgaagaaaatatatgaaacaacaatttccaagaagttggatatcaggcaatgaaggacagtgatctctgagaaatgttccagcttgctgccttgagagagtttccaggtcatggtgcagaaagtgggaatcatgatggagcaagtcactgccaagttaaggggacagaactgagacgcctgggaaaccaaggcagctagcactggacaagagagtactgcccagggagagtattctagggtactctttaccaaccctcagatactttcctggaatgcagaaggtttccctgcatttcaggaaagtacctgaggctggagaaagagctactctagaagattagaaggaacagtacttggagctcacttagggctggcaatagggacttttcccaccagccattatgaggttatggaaaacctcataattcacaggatactgggtagcattcagaagagccttgtctcaatagtgggaaataatgagccctagactaaacactactctgatctatggaaaacctcataatagtaaggaataatgagctctagactaaacactactctgatctatggaaaacctcataattcacaggatgctgggtagagttcagaagggccttgtctcaatagtggggaatgaactctagactaaacactactctgatcttacctaataagtcttaacagcgagacctgaaaggatcaaactgtttccaagtaactgcttcctgaaacaaagcttaagagtatttgtaggaatccaaaaaagatacagtcctatgagtttgggttacttttctccttctaatttttctgtttctgttctgaaaatgtgggaggttgcatgggataatgaaaaaagtattagattagaaatcaggagagctgagtttttgtctagttctgctaccgacttaccatgtgaccatggtcaaggttttcttttttcttgtcacaagtgaccccagtacatggagggatttggatcaaacaaattctgaaaaattcttaaactctaaaatgaaattgtcttcaggccttctatatttgctcaaaagaatcaggaacactaaaatgcagaaaagattacttgattctacttagttttactaattgttttatcaagcataagggattctaatttgttacaaaaatttaaatcatttaaaatcaatttgtgaatttctcttaaagttagtcatttactggataaaccaaattatatatgatgtttattcattttaatattttttatttcaatagtttttggggaacaggtgatgtttgcttacgtgcagaagttctttagtggtgatttctgagatattggtgcacccatcacccaagcagtgtacactgtacccaatgtatactcttttatccctcatcccctctcccagcctttcccccaagtccccaaagttcattgtatcattcttatgcctttgtgtcctcatagcttagctcccacttatgagtgagaacatacgatatttggttttccattcctgagttacttcacttagaataatggtctccagttccatccaggttgctacaaatgccattatttcattccttgttgtggctgagtggtattccctcgtgggtgtgtgtgtgtgtgtgtgtttgtgtgtgtgtgtatacacaccacattttctttatccactcgttgattgatgggcatttgtactggttccatatttttgcagattttgcaattgtgaattgtgctgctgtaaacaagtgtgtgtaagtatcttttttgtataatgacttcttttcctctgggtagatacccagtagtgggattgctggatcaaatgtagttctacttttagttctttaaggaatctccacactgtttttcatagtggttgtactaatttacattcccaccagcagtgtaaaagtgttcccttttcaccacatccacaccaacatctatttatttttatttttttgattatggctattcttgcaggagtaaggtagtattgcattgtggttttgatttgcatttccctgataatcagtgatgttgagcattttttcatatgttcgttggccatttgtatatcttattttgagaattgtctattcatgtccttagcccactttttgatgggactgtttgtttttttcttgctaatttgtttgagttcctgtagattctggatattagtccttcattggatgcatagattgcaaagattttctcccactctgtgggttgtctgtttactctgctgattactattattattattattattattattatcttgctgtgcagaagctttttagcttaattaagtcccatctatttatctttgttacatttgcttttgggttcttggttatgaagtcttcgcctaagccgatgtctaaaagggtttttccaatgttatcttctagaatttttatggttttaggtcttagatttaagtcttttatccatcttgaattgatttttgtataaggtaagagatgaggatccagtttcattcttctacatgtggcttgccaattatcccagcacaatttgttgaatagggtatcctttccccactttatgtttttgtttgctttgttgaagatcagttggctgtaagtgtttgactttatttctgggttctctcttctattccattggtctatgtgcctctttttataccagtgccatgctgttttggttattatggccttatagtatgaagtcgggtaatgtgatatctccagatttgttctttttgcttagtcttgctttgactatgtgggctcttttttggttccatatgcatcttaggattgttttttctagttctgtgaagaatgacagtggtattttgatgggaatgcattgaatttacagattgcttttggcggtatggtcattttcacaatattgaatctacccatccatgtacatgggatgtgtttccatttgtttgttggttaggtatttaacataccatataattcacccacttcaagcatacaatttaatgatttttattaaatttacctatttatgcatctattactgtacatcagttttaaaacacttctatctccctaataagaaccttcatgttcatgaattgttcattcctattcccccaccccaggcaacaattaatgtagtttctgtctctagagatttgtctcatgtggacatttcatataaatggaatcatacaatattggtctcttgtgtttggcttctttcgtttagcataatgtttttgaggtttgtccatgatatacagcatatatcagtagttcatttgtgtttttgctgaataatagtacattatatggatataccacattttgtctacctattcatcagtaggtggtgtgaaaggaaaattaatcttggggccccaaaatcactaagctaaagggaaaagtcaggcctggactgcttagggcaaaccggcctcccattgtattcaaagtcacccctctactcactgagataaatgcatatctgattgcttcctttggagaggctaatcagaaactcaaaagaatgcagccatttgtctcttatctacttatgacctggaagccccctcccagctttgagttgtcccacctttccagacaaaaccagtgttcatcttatatatttgatttatgtctcatgtctccctaaaatgtataaaaccaaactgtgctctatcttggccacatgtcatcaggacctcctgaggctgtctcacaggcacatgtcctcaactttggcaaaataaactttctaaattaactgagacctatctcagatattcagggttcacagtggacatttcagttgtttcccatttttggctactgttaataaggttgctaagaacattcatatggaggtctttgtatggatatatgttttcatttctcatggattgatatctaggagtgaaatttctgggtcatatggtaaatttatatttaacttttaaacaaattgcccaactatttaaggtgagtttagccttgccaatatttgttattgtctatcatttttatttattattttagtgggtttgaaagggtatgtcattgtgcttttaatttgcatttccctatttataatttgcattttgtattcctgagtggctttctgccattatcccatttagattcattctttacaataaagcttaagattattggcaatagaatttaattatcactataagaatagatcactaccccatttccctttttattagtctttgccttattcttagaaaaattttccttttttttttaaagaaaaaaatctttcatttctacagaatgtgattcctttttagctctaggatctcactgtccctatcactttcctctctggcatcttaaatctcccttgccgctttcctcttactttcaaatatacctagaagtattctgttggtttctattctcttgtatgaactactattccactttcttgttgtgcctattgtcaaacatttgaaaacaccttggctgtgatcaccacctccatttctttactgtcccattctcttcttaaatgtgtggtttgttttcaccacttaatgaaattgccttctcagaaatcaccaacaatctagccaaatcctgcagccttttctttgcagcatctggcatctacacatacagattgagaatgccaaatccaaatatctgaaaattgaaatgctccgaaatatggaactttttgagcaccaaactgacactcaaaggaaatgatcattagagcatttcagatttcagattttgggattatggatgctcaactggcatagtgcaaatatgccaaaatccacaaaaatctgaaatctgaaacacttctgggcattatggatgagggatcctcaacctgtacttatatttttttattttgaacacagtaattatccaggtttgcctcttttctgatagctctcaatcactttggttgtctcctattcttctcactgtagaggttttataaaactctttctttggctttgcttttattcccattctcttgtcactttggctgtcatgtctgccagatgacccctaaatgtttcgcatacctcagttatgtacaaaatccccacttctctaaggaacactttcttttcaaatcacaggtctttgggatagtttatatagctcataaaaagaatgaatgttttatgtatatttgtttctttgacaccatatctgttttgtttgcattatgatctttcagtgtttcataagctaaataaaatcaaaccagaaactgaattttgcctgaaagctagggatttccttctcagtatttattcaggtattctgggaggaaaatttattggttcctaatttcttataagagctgcttgataaaatgttctctccttatagtcttcttccctttgcaaccttttacttgtgcttgtttttagtccctacctaaagaaatgttcttcccaatagatgacatctgaaaattaacaataccagaaaattaactctggggatcttttactagaattcatataagtcattttctgagctcatgtcaacattaatatccatctaaggttgtgattgctatttatagatactaatatataatttttccctgagaagattgcttttataacatgcctggatgtcagttttctactttatgaaactaagcaacactggaacaattcaaaaatcttagtgtcttttagcctaaactcagtggcatattcctaaagaatactttccatttaattttatcttctctaatgaagataatggtattcatgcaacatcttttatatgctgtatggtactcaagcaacatcttttatatgctgcttagcaactctgttaagcacctctatgtgccaggcatacagctcaacactagacctacagaggtcagaaggagcccttgccttcaaggagataggtaagtaaaccagcaaatagacactttatccattccacaagtgtttatggaatacctactgtgtcctggcactctgcttagctctgaggattcagcaatgaataagacaggtgtgaaaataagtaattcaaaatctaagctgttggaactccaaactattttgatccttaaagaaatgtgattatggggcctgagtcacgttacaagcagctgtaacctgggaagctgtaatctttgtttctatgattatagattaaccttcctccttgcttacattgttgtacaaaatgttacaaatgactaaagggctccaggaaagaccccttccctgttactgttgatttttattatagattaacttcccttttagtttctcacccaaaggtttcatggctatcacaccgtgttaagatggagtgttaaatacctcttttaaatcagaaaggaaatgaaaaccaactgtaaagaaaacaagccatacagaaaagaaactcataaactagcgttctagaaaatgttataaacctactaaacttctttgttttctgcctatatatgcaataatttaactttgaactttggaacactgactctatttctctggagtctgtgtctcccaaatggctattcccagctttttacttgaataatctcgactggattttgatccttttgattatttcaggttaacccagaccaggccatgaagattgtaaatctgtgtgggcttgcaaggccttatatgatgggattttgcacttgctgtttcctctgcctagaatgctttatctttgcatggctcggttcaaatgtcaccttctcagagggccagccttccatgactgtcttatttagtgctgttcctctcttctagtcactgttgattgtatgatcttgatttccttcaaagcacttattactatcagagatgatgtgtgtacttgcttttggtctgtccctcttgaggacagggactttgattgatttggtatctctaagtgtttaaacggtatctggaatattttgggcacctaaaacacatttgatgatgggatgaaacaacgaatgtgtggatggtgctggagaaaggcattcaacaaataaggcaatttcagatagtgaaagtatgggtactcagagaaggttaatggagaagtggagtcagtattctgatgtctgagcagaaatgtaaaggaagagttggctaggcaaagaaaacaatgtaagctggatcacagaggtgtgaaagcatggcgcatgggggattcacaagtagtgagaatgcctagattataggttcacctaggggcagatagcaagggtgagagctccaaggagctgacttgtcttacgaagatttgaattgcaacctaaaggcaaaatgtagtcacagaggcattttatgtagaagtcacataataagttatgtatcttagatcattctggcaccagagagtaagatagattcgaatagataggttacatgtaggaaaaaaggtattttccctgctctcacacagctactcaacacttctgactccagatgtgtggggattttcccacaaacatcaagcagttctgctatgtacaccatctgggtgtccgctaattcaattctgttgacactatctacctggagatagcatcagatcccataggttgaggacttagtcttacaaaactgtcccccacttcagatgccaatcacaagccccaggttgcagtctgtacttctgacaactataaatcagagttcccacaacccctcctaaatcattctattaatttcctagagtgactcacagtatgcggggaaacacttatgtttacccattcattaaaaaggacattgcaaaggatacagaggaacaaccagacaagagatgcacagggcaaagtacgcgggaaggggagccaggcttccatgccctttccaggcaagccaccttctaggaacctccgcatgttcagctatccagaagttgtccaaacccaagccttttgtatttttatggaagcttcgttaggtaggatgatggattaaattactggccattggcaaggagattaacctacagcctttctcccctccccaaaggttgggggatagagctgaaagtcccaacactttaatcctgccttggtttttctgaggaccagtccccgtgctgaggctatcaggggccccaatcaccagtcatctcagtagtatacaaaaggcactcttaccactctggagattccaagggttttgggagttgtatgtcaggaaatggactatgaccaaatatatgtttcacagtatcgaagaatggaagtaggttgggggcacagagattagtgtgggaacaattacagaaattaaaggaaaaattaattaggggcctaatctaaggcagtggcagaagagatggtgaggaaaacagttgaagatttttaaagagagacttattaaaataatggcaaagagatgtaggtgagtgagttggggggaagaatgggttgattcccaggtttctcacttggtaccaatcacccaggttgatgcattaagtagagaagagataattagcttcaccagctctcaaagtcattgaactgctggggcacaggtgcctgcagttgtgtacgtagtcctttggctaaaatctgaaggataaccctcgtaatgctttaatgaaacacagctttgctcatcttggcaacctgtgctgactgctgtctataaaacttctagctgtaccagtttgggtgtaaggatatggtgtttgtcttctaagaaatcttagctactggccaggcacagtagctcacacctgtgatcccagcactttggctgagccaggaggatcacttgagcccaggagttcaagaccagcttgggcaacataggaagatcccacctctacaaaaaataaaaatttagctgggtgtggtagtgtgtaccttggtccaagctacttgggaggttgaggcaggaggatcacttgagcctgggaggttgagtgtgcagtgagccatggtggtgccactgtactccagcctgggtgacagagtgagactctgtctctcaaaaaaagaaaaagtcctgggtacctattagagaacaaagttattccctcaacaggcaattcagatgcttattttcttttgttcctagaatagagttttgaacttaattatacattagaatttattatgacatttttttaacctgatgtctggtcccatccaagagcaattacatcaaaattaaaaagtgatcatttcatgtacccatgtctgagaaccttctagattcactgccctcatgaatcagagttctattttacatccctactttttgggttgatacttggaccagagaggaaattggaaatttgagtttgtgatcagtgccaatgggttgattttccattgctgctattacaaattatcgcaaatttagtggcttaaaaaaccttacagttccgtaggttagaagtccaacgagggtctcagtgggctaaaatcaggtgtcaccaggcctgcattctttcctggaggccctacaggggatttgtttccttgccttttgcagcttctagatgccacccacacttcatggatattggcccccttccttcatcttcaaagtcaacaactttgcatctctgtgtaactttcacccatagtcacatctccacagccagaaaggttctccagttttaagagcctatgtaattagattgtaaatatggaccagctttgactagccattttaggtcaaatactacttcggttcttcataaatatttgttggactgaattgaaaatatgaggtttaagcgtttgtctagtttaaaaggatgacactggtcttggggacccacaaatgactacttttgttgttttcccactgtctagctttaagtgatctgtcttttctgggag

SEQ ID NO: 5553 - DNA, 2660 bp, Homo sapiens
gggcccacccagccaactactggcccagacttggcccgcggagagagcagacagggaacgccgggagcaggaccgggcgcggagggctggggccggggacccggggcggcgggtccgagtgggagaaaggagcggcggagggggcctagagttactcgggctcccgggactccccgaagggcagaaataagtttctaaaaataggcagcggcctgccggaagaagtgagtgaacggaaaggcacaaagcacacaccctccccgcacccctaaggagacgcccgcagtccccactcacccgcgccgagaggtctggaggaagccgcgcggctgggaaggaggcggtactgccgcactcggggacgtaagggagggaggaaaagggcggctgcggcgggaagaggctgggcacacgcgcgggagtcgtcgtcgtcgccgtcgccgccgctaccgccccctcagcttctctgggttccgctgccccgagctggcgccgctcgcgcgccccgccgcactgacagcggcgcgagccccgcaaccgcgagccctgccctcggccggcaccactgaggcgcgcgggggtgggggcacccggagcggctccccgcagctcggctccgcccgccgctccggccctggttccgggctctcctccttctctgtctcctgggaaggacacggtgacacgagcacgaggagtctgcagccccgcccagaaacagcccggcttcccaggcgcatgggctctccccaccctctcagcctggctttggaaaggtccagagcttcggcggggacgggaggaaggcggggccagggtggggcctgaaagggaggagggactgagacgcggcttggggaggcggggctggggcgggaagagggcagcttgcacaggtttggagccgaagtaggggcggagctaagatggtgatgaggccctgggaagagggtcgccggaccagtggggaaggccgtgcaggagatggagagccgggaaccaggacagcgcttgaaaggagatgctgctgtgggcggtgcaggagggatccggaagagacgaggcaggaagaaactcctggtcctttcgcttttaaggaacgtgccacctagacaagtgttccagcctccggtgaaccagtcttcctagtgagagcacgagaagcccgttgtccttcattcctcagctatggatttccctgaaagttgagaactgaccatattctcgatgcctcctccgacctgtgatttcatgactcacatcgcttccccagaacctgcttaacagacgggattcctgagaatggagcagagtttgaattcagagtcctggctttgccataccagcagttataattgtccttctgttgtttgatgacctccctgccctgcttcaaaaggaagagaaatcaaagagttgacgaccctgagcgcaaggcctgggacgttcttccccaaactcgctttaatatcaccttctcaaaagaactcttccctgaacaccttgtctcaagatgttctctagtttgtcttcttgttctgtcatttatttgtctgttcattgtttgtgtgttttttgaggcggagtctagctctgtcgcctaggctggagtgcagtggcacgatctcggctctctgcaacctctgcctcctgggttcaaagcgattcttgtacctcagcctcccaagtagctgggattacaggcgtgtaccaccatgcccggctaatttttgtattttcagtggatacggggtttcatcatgttggccaagctgggctctaactcctgacctcaggggatctgcatttgaggataaaccctgtcttggctcctccctgacgggggtgagaagtagccctcctggaattgcctcaaagcccccggttatcaccagtgttctcggttgcaaattacgaaacataaataaactcagactaacagatgcagcaaaggaatttatcaggaaggaatggggagctcccagaactgatgggaaggctggagaaccaggctcagaaaatgcactgaagtggtgagcgcagaggcttgaatgttgccaggactctcctcccagtcctttatctcttctctctgtatgcgagcttttctcctcaaggctaggcacctggctgcagcagcgctcaccactcacaactctcacccgttccaccggagagagactgaggatttctgcttctggtctgaaggacaaaattttagggaaaaactttgattggtccaacatagatggagaaatgacaactggagaggggagttctactggagaggggagttcacacatatacactgaaagctgcccatcaaaagagttgcagaaccaggactacagcccttgcatcttgactgccagtacgatgcaggttaaactctgtgtttgatgcttgttgatgtggacgtctggaacttgaatagaagacatttcttatttcagatgcatccattagcaggtcttagccaggagccaggcccttgcaagtatatattgcaagtaattgatgacattggagccagaaatcgaatgaaccgggcccagttcaatccacttactggacaagctcctcaagcactctaagccccaatttcctcctctgtaaagtgggcataaattacatttaccttgagggttgctgtgaaggct

SEQ ID NO: 5554 - DNA, 2080 bp, Homo sapiens
gcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 5555 - DNA, 3128 bp, Homo sapiens
ttggccccactgtgcaccacacactcctttcccagcccaggggcacgcgaacaaaatgaggctcaagctgaccaggccgagccggaggaacgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaa

SEQ ID NO: 5556 - DNA, 587 bp, Homo sapiens
cgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaatagcctgcagctggtgttttgagaagccctactgctgaaaacttaacaattttgtgtaataaaaatggagaagctctaaattgttgtggttcttttgtgaataaaaaaatcttgattggggaaaaaa

SEQ ID NO: 5557 - DNA, 4164 bp, Homo sapiens
ggagcacggggtgatctgggcactaacgctgatggggagcagcggacatcagcctcgacctcccacgagcggtgcacgagcgcctgacccagacctcgaccctagccttcacccccaccctgactccagttcatgaactggtcaaaggaagagccatgccagcaaacgtctacactgtacatgctttttattacaagactacggagcataggaggaaaattcatcatctggtaactacacctaaagcacaaatatttggggggaaaaaaagaacagattcattaaattatatgattaaatcattgacccaatagaaaatttatataataagggcggggcctggtggctcacgcctgtaatcccagcactttgggaggccgaggcgggaggatcaggcggtcaggagatcgagaccacgctggccaacatggtgaggcccggtctccactgaaaatacaaaaattagcctggcgcggtggtgggcgccggtaatccaagctactcgggaggctgcggcaggagaatggcgtgaacccgggaggcagaggttgcagtgagctgagatctcgccactgcactccagcctggtgatagggcgagagtctgtctcaaaaaaaaaaaaagaaagtttttgtaataaagccagaaaaaagttgtaaaatatatagtaattattcacattcaaggctgtatatcaatacatataacaacgtggccccgaacatgaattcaatacaaataattcatatattagaatttaggccgggcgcggtggctcatgtctgtaatcccaacactttgggaggccaaggtgggtggatcacgaggtcaggagttcaacatcagcctggccaagatggtgaatctccgtctctaccaaaaatacaaaaaattagccagatgtggttgtgggcgctcgtaatcccagctactcggaggctgaggcagagaattgcttaaacccaggaggcggaggttgcagttagccgagatcaggccactgcactctagcctgggcgacagagtgagactccgtctcaagaaaaaaaaagaatttaaataacaggctgaactagaggccaacaatagccagcaaataaccttctataagattaaaaacacaaaagtgtatatcctaataccattgtattatttgttttcatgagttcttttaatttttgctttgtctgtacatcacagttacagctacagaccaggtagagaatattacgcatgttctgactgccacccacctgaaagacgtactagtcatttatcctatttcatgttgtgaaggaacagctacagcagctctaaatactgtaacaatttaattttgccaacatccaacttaacagtcgtaatagaggcttttaccagcacaatgacccctattcgtagtcattctgccagacggttaggctatgtgggttacacagcttaaaaaaggtctgccttttgtaaaaagttctctgtacatagtttggtgtttcttcatatggaagaaatgagttatggggaaaattcaggtacacacgtaggctcgttcagttgctcaccacagccatctcaacagatgaaagtgctctttgttggaaacagcttcctcctcacaccagttctccacaggcagcctcatctacaaccctgcaattttgggccagaagtggtggcccctcagaggctctgaagtgcctccagccccgattcaggcacttgccacgtgtgctgcgtaagaagggaccccacccagtgagtcaacataggctcatgtcaagtttgaaaataactggggaaaagtgtatgacaacatcttccagaacatagtaccttcaccgtattctcacagcagctgcgatctctgaagtctcagcagtgagcaccccgggtctgtcaaccagccaggcaagggggggccctcaggcttcagagggcaagaaaccaaattccgtgcaatttggccataatctctggtagagtgaagcagcactgaacgcagtgcctagaaaaacctcctgcacgttcccctgcacaatcaatggaccccaactacagtggagaaatgaagaatccaaccaaatttgggtggtctggacttgctgccagccaggcaatctgcaacactgtgggcagggagatggggggaggcggcctgaaatctacaccagctgggacaaccacgccctacaatgaaaaagccagcctggctgctgggctcttgtgaaccactaagacctgaaggtgggggggtggaagggggagacaaatgcactcttgtaaaacccaatcagctacgtggtttttttcaagtagaggctttgctctgctactgactccaaatggcctaatgtactttctgagtctataaacttaattacagatcactcactaagcatgtggcaaggtcagttcaacacttgttatctctgctgactgcgcagttgcaaattcaataccattgtggacatgaagtacaagattctgaaaatatcgccaagcgcttgaaagccacggcagcagggagggcagagagctgacatgcaggcagagccaggttcttgcaaccaaaacaaggaaattggctcttggaaaaaatcggccacaaatggattgcagtagtgacatcctcttagcatttaaataaagagcggtcttattcagacattctttggaacacacggcttatcagaaaccgatttgttcagaatctgtaagacacaactaaggtggttctgctactggaactgagcgtctacacatcaggtcgagagagagacagaaatatcttcaaaatgaacaaactctttcacctcaaaataccacttccaggcatctaaggggaaaaaaagtaagaaatcagaagattttaaagatattcatcacagcattatttaaatagtggaaaaatcagaaaccgtcaagtattttacagtagggaaatggtcagataaattatagtaaatggacaatgactaaatagtacaattgttaaaaacatgtttctgagaaactcatgacatgggaaaatgcttaaaatatcaagggagaagacgatgcaaacggtgtgtgtcggatgttcctattttagtttaaaaagtgaacaaatggcagggcaggatatacggcaaaatgctcacagtggtcttctctggccggtgagcctacagctgatcttgtcagagacaaacgttagttttactgagtcacccagagccctgtgctggtgcctgagggtttgttccatgggacagtctccacaattcctctggggaagggccacaaatcccacagtgtgtcccaagagggctggagtaggcggagtccccagcagctgtggcatgaccagccatctctctcaaaacaattgttaacaagccttctgcaagttaaggttccacatggtagccgtggtacagaggcatttctctagggtggagaggcttgtgctctacaccaggactgcccaccgccctggctggggccacacaaagaggggagaaaggaatccctcagaagccagcccccaactgtgtcccagagaaaggcggggcacctgggacacctaggccggcagcgaccacagcctccctccactttgtgccgagaagccgcacagtgtggtcccgacattccacctgtccttgcccatgtgtggggaggcacatggccccaagtctattaaacagcaagtgaaatcttcctcatcttggataaacccacaactgtaattccacgtaagtgtgtctatgtgcacacacagtaccccacgttctaccgtagaatgtaaggcgcctgcgtgccaggtgatggctctaaggatgtggtagagaaaaccggagtagacatgagcaagcacagggtaaggaaagaaaacacacgggcctttcaaaagggaagagcaaggtgaggagaaaggtgacccacagaagggcttggctgtcagctcaggcaatggcatcatttcggctggcggctgccagctctggctctgagcccctagttctgtggctttggaggttaagatggagcttgtcagtgacgcccaggaggtggtggttctatccagaggaagaacgcacggaagagtctccccaggcagcccagccgagtgctccaattaaagccacgtccctgctccacttgtttccctataaccagacgccc

SEQ ID NO: 5558 - DNA, 1327 bp, Homo sapiens
atgttaatgactttactttgagatatgatggaaaaatattacaggtacacatggaaaagacatgatcaccaagtgaaaacaatctaaccagaaagctttaacgtctgtcagttaagctgaagctgaaattctgggagcatgacatgctgcagggccaaaaggaatggataattagtattcctctccttcttcctcaccctctccttcaacagaatccacaccaacctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatgctgcgcttggttttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcgggggtagggcaccaggttggtctggaattctgtcaggtcaacattcagggctccatcaaatctcagggaagcagtgatggaggacacaatctggctaataaggcggttaaggttagtgtaggttgggcgctcgatatcgaggtttctacgacagatgtcatagatggcctcattgtctaccatgaaggcacaatcagagtgctccagggtggtgtgggtggtgaggatggagttgtagggctcaactacagctgtggaaacctggggtgctgggtaaatggagaactccagcttggacttcttgccataatcaactgagagacgttccatgagcagggaggtgaacccagaaccagttcccccaccaaagctgtggaaaaccaagaagccctgaagaccggtgcactggtcagcctgtaggggaataaaaaaatgtaatattttaatgccaggacacattatcttagaatttctatttcaactttttagattacgaaccatatctcactgatgtaagcacaaggaattggcaaaacagacatatccacaaactgtccataacctagggactatctgatttagaagtcca

SEQ ID NO: 5559 - DNA, 6066 bp, Homo sapiens
gtgcgagctgagttgcatacgcagagcgagctgagttgcatacgcagtgcgacttgagttgcatacgcagagcgagctgggttgcatacgcagagcgagctcagttgcatacgcagagcgagctgagttgcataggcagtgagtggattcgcatacgcagtgcgagttgagttgcatacgcagtgcgagttgagttgcatacgcagtgcgagttgatttgcatacacggtgtgagttgagttgcatatacggtgtgagttgagttgcatatgcagtgagttgatgtgcatatgcagtgagttgatttgtatatgcagtgcatgtttccagcaagttgtttaccatctttaggaatgatctagcctgagagggacggtctagcccccacagcaagaccccaggatgaaaatgtaccctaacaaaaaaaaaaaaaacataattaatacaattggtcctttaatattttatcttactctgaggaaccctcagacattgggagtggagattttcacacaggagggcataagttgccctaagtgacacagaacacgttctgagagttaggaagagaaatacaggtatctgcctaaccagtacttgcagtcctgcccataacccagttttccatcatgcttggtgtcttagtctgtctgtgttgctacatatctgaggctgtgggtaacttagaaagaggcttatttggctcatggttcagcaggctgtgcaagcatagcactggcatctgacctgcttctggtgaggactatttgctgtgtcaaacagggcagagaaggtcaagggcagtgagccaaacccgagggacggcttggctttatcacaaccatgctcccagtaactagtgcattcccctacaaaccaatccaggcttgacacagcaagaatgaatggtatccaaccattcaggagggtgcccccatgacccaaacccccaccaggccccctcccagcactgccacactgagggtcaaagctcaacatgagacttgatgagggcaaaccaatcacatccacatcacagcatatggtattactcaagaaaatcactttgaaatgttgggggtccaatgataatatccttgaggagttataaaggtgataaagggatgagtttgacaattatcaggatggcaggtctgtagttctgctgcaggagggtatgaagcaaacagttagtatgtgtaaagaagaggctctgtgtgaagccaagtcaagggagtaaggagatgagatggaaagctgcagcggaggagaaggcactggggagacagtggccttcccagaggctgataggaggcgggcacctcctggtgaaacaaaacattttggtatcaattattgagacttcacagacactactaactcctaccagattttcctacaggcaaggggtgcagggctgtgggttttggttgagattacaccaggatcacgggttagcggacagcaagctcagctcatcacagaatctcaaatatcaaatttgtgccttaggaaccccagtccatgggcatcgctgctgaggaggttctgaagaagtgcgtgaagtcacctccagtgaagggagggggagtcgtcggaggggtagtcgtcttaattgaggtctgtgctggggtgatgtctccaccaacagtgggcatatcaggcagggtggtgtctgggctaccgcctgctcaggatgctgtcactaggagtccgagcaccaggatgatgcagtcctggcgtcacctgtgacccacaagttctggactcaggcaactgtgagtcagttctagcagagacctgcaggacttatttcagccaatcaggatgtcacctgagaccagtccaggagccgctacaaccccacaagctggttcccgctaatctgatgacctttagtgtcaatgccaacaattaaaggtggcaacagatgagctaaatagccacactcaatcccacaagagaaacatggcacaacccactcctctccacaacaaacacgtaacatgaaggtgcatggctctgtccatccagaatttcaaacacgtgacatgaaggtgcacaggtctgtccatccaggatttcaaacatgtgacaggaaggtgcacgggtctgtccatccagaattttaaacacgtaacatgaaggtgcatgggtctgtccatccagaatttcaaacacgtgacatgaaggtggacgggtctgtccatccaggatttcaaacacgtaatatgaaggtgcacgggtctgtccatccaggatttattgttcacctcgttgtagattacctttataccgtggggattcaacaccacagaaacagtcaccaagcagctgctgccctgatggccacaaaaaacataacccaggattgctgcagccagaggacacacattcgtgtcactcacatgaagtcttgctctgccactgtgtgtgtttaagggcctcatccaagaagcgccagtgacagggccaagcgccacagaacatcaggaccagccgtgtccctggtctgttttcatggtacacaaaggagcagcacacacacaagcagcagctgccccaggagtgccgggtcgcagcagctgccccatgaatgccggatcacagcagctgcctcatcagtgccggatcgcagcagctgccccaggagtgccagattgcagcagctgccaggaccgctctgcatgctgtgaagaggatctggaggtcaacaaggacactcagggctctcacccgtccggcactgcctaaggtacaggaattccctcctccccacgtggggggtggtggttctccctccacggccatgaaacgggggcatctcagggtacagacctcgcccctctccactctgcccctccttgcaccctggtgttttatctgaagggatcaggtatgggagaggaacaagggcattttcataaaatgtagagctgtgttatgccccaacattggccagtgtgggaccctacaggtgggtcatgcctaagagcatgactaaccaaccagagcctacgctgctcatacaggatcccatctggatacttaagactaaccaaccagagcctacactgctcacacaggatcacatctggatcctcaagactaaccaaccagagcctacactgctcacagaatcacatctggatcctcaacactaaccaaccagagcctacgctgctcacacaggatcacatctggatcctcaagactaaccaaccagagcctacgctgctcacacaggatcacatctggatcctcaagactaaccaaccagagcctacgctgctcacacagaatcacatctgcatcctcaagactaaccaaccagagcctacactgctcacagaatcacatctggatcctcaagactaaccaaccagagcctacagtgctcacacaagatcacatctggatcctgaagactaaccaaccagagcttacactgctcacagaatcacatctggatcctcaagactaaccaaccagagcctacgctgctcaaagaatcacatctggatcctcaagactaaccaaccagagcctacactgctcacacaggatcacatctgagtcctcaaggcctactgttagccaggctgcgacgtggacactgtagcaaccagactggaggatttctacagggaacagagtcctcactccaagaatgatcagtgcagcatcataaagattcaaaatacgtctacagaacccccagaaagacatgtctcaagttagcccacaaggttttagaacacagggaagcgactgctatcttccatacattcacaacacttcaagtgtcaatcaccacgtttactaaagggtgaggaaagatgtaatgtaaaaaatgacttcccaacaattctcaccctcctaaggtttttcttcattgtgagatcacaagggatcatcaaagtactgagcagaacagcaacaatgctgctgcatatcacacatcaatagagttctctctactggataccatccatattcagcaagaccttagagaacactgagggctttctctgtgtctgctgcatagggctccagggtgagttcctgcctgccgggttgtgatgagatgctgattgcctagccacattcctcaagtcatggacatctggagaacgagaggtctttcatgtcttcaacgtgaatgagtgtagctgacagcttccccacattctttacattagaaaggtttctcatcagtgtgaatttgagtgtgatggttaaggcatgaggaattcttaaaagattttccacagtccttacatacaaaaacctgctcttcagtgtaagtttttaaatgttcttttagtagataaaacctattgtatgctttcccacattccttacatttatagggtttctgcccagtgtgaattcttccatgtttatgcaggtgagaggaggcacggaaggctttcccacactcgttacatatgtaaggtttctctcctgtgtgagtccttctgtgttcgataaggtgtgaggaggaagcaaaggctttcccacactccttacatatgtagggtttctcaccggtgtgggttcttatgtgcacgataaggtgtgaggatgtggtgaaggcctttccgcatactttacattcataaggtttctctccagtgtgagttcgtatgtgctcggttaggctcgaagaaacagtgaatgttttcccacagtccttacattcataaggttttattccagtgtgaatctgaatgtgcttattcaggcacgaggaatttctgaaggatttcctgcataccgtacatataaagggcttctcctctgtgtgagttttcacatgctcattcagtagataaaccctattgtaggctttcccacagtccttacattcatagggcttctccccggtgtgtgtccgcatgtgtttagtgaggcctgagcgccctgtgaaggctttgccacactgcttacattcgtagggtttctctccggtatggattctcgcgtgctcagtcaggcttgaagaaacagtgaaggatttcccacaatctttacattcatatggtttctctccagtgtgagtccttacatgctcagtaaggcccgaggatgtacagaaggctttcccgcagtccttacacgtgtatggcttctcgcccgtgtgtgttcgtacgtgtctagtaaggccacagcgcacagtgaaggccttcccacagtagctgcatgtatagggttttattccagtgtgaattcgaacatgattattaaggcatgaggaatttctaaaatattttccgcaaaccacacatgcaaagggcttctccctcgtgtgagtttttccatgctcattcagtagataaaacccaccgcaggctttcccacagtccttacattcatagggcttctgtccagggtctgtttggacgtgtttagaaagacctgagagtccagtgaaggcttttccgcattctttacattcacagggtttctctgcagcatgaattcttacatgttgagttaggctggaagaaacaggggaggcttttccacattcttccaattcacagggcttttccccagggtggacttgcacgcgaccagtaaggtaggcagtgtacctaaaggccttcccacattccctacatacgtggggattcctgacggcatgcatttcaacaggtgtggcgcagcccatggagtgagttagagctttcccacacggcttccatttccatgtttcttctccgttgtgacttcccgcacgtgcctgaaggtatgactgattaaggaacacttccccacagctgctgtagtcaagagatctgtcccgagtgcatgcttgctgggaaacaacatttggagtagagctgaaggcttttccacactgacccaacacggaaaactgctctccaattttgaacaaggttttctggcatggaataaaaaagtccctttcataatgattagacacacaactgtctcctgtattttgagttctcacgtgtgtgctgaggcctgagtgttcactgaaagcttctccacactgcgtgcggtcacagagctgccctccattgtggcttcttg

SEQ ID NO: 5560 - DNA, 3769 bp, Homo sapiens
gcttcgtcgaaccgctccaagggatcaggacggaggcccggagcccgcccgtgggagtcccggcaaggcgcagccggcagagcccagaactgccagcccagcgtggggggtcgcggcttccgaggaaatcgggctggcagcggggagacggggcggaccccgacttcaggacctcgggccgctcattcccacccacttcggggcgacccccgccactcctgccccggcctcacggacactgagaacgcgtcggccacgtccagggcccaggaaggtggcgccccgctcccaagcctgctacagggaacccgggactcggcccaagacggggcctgacagcggctgcgcggccgccgctccctcgaagccgagtgcgcctcagatcccgcgagactggagtctccgcgctgcgaaccccctcagtggcgagccccccgcggtcactgctcggacaatgacccttgcagtcttccctgtcgggtcctactcgtgcgctgaaccgaggtccgcaggcttttcttccagtggccccgctccgccgacagacccccctgaaccacagactcggctttctgggtgcacacgtggccctttattcgaatccgactttcacagggctccacatcgttgtgggcaaggactggccgccccgtaagctgccggcgcaccgcagcccgtgctccaggagagactcgaggccctgagcccgcacctcactggcgaagcgcctcctggaaggaggaggaagggagggagaacaggcgcgggctccaggcgggggacccggcgctcccgggaggcgctgccctgcacccaacacacaccgaaaggcgcccgccatggggccataggtgcgggagagcaggactcactgaaacgcccaggtgccgcccgggacagggctcagcgccacatgccactcttcccgaaagcacttacaggggacaagcctcctgggcaagcggctgcctccagctcttgttccaggtgaagtccctcctgggacagtgaccccagaggtcatcgctgctctcaggccacccttccccgagtcctggccgggccccttcaacctgccaaagcaaagcagcgttactcccaacgtcctccacagggctcacagctgcccctcccggcctccccggaaacagccacagcccctaggaaggtctcaggctagtcagggggctgtgacctcaggctccgtcacaggccagcatgcccagggcgggtctgcaccttggcgcagctggagccagctacccgtatgggatggagctatgtgggccagtgtgggctctagaaaaaaactaatggcggcaacagacatcagagaaagctaagttaagagtgtgacttaaagaggtctggaaaagacggtcaattgagcaaaaaatccaaaaggcgggggcgttcactggtcttcaatcctgcttaagggatttcatctatgagccaggcatgactgggcccaggctgcacctggctgcacgtggggagcgtaatggctgggcctgactttagttccagcttaattgaaaaaaacaaaaacaaagttaaaaaaaaaaggaaaaacaaaaaacagtcacaggaacattccccgggcacatgactttcagtgagctctcaacaagagggatgtggacacgagcggaaggagttacctcgaattacagggctatttccacatatgagctagccaagggagcagcttgcgtctcagagggttctgttgggcgcacaacacttctgtcctccgagggctgcagcttccataggctagcagagaatgctcagaactcgtgaagcaacagcagaactagctaaccggctggccgtctgaggtcgccctgggatgccacgtgcctctgctctctggcctgcttctagactgaggcagtccaggtcagcgtcaggtgcacgtccactgtccctgctaagctgcccgcacagtccagccctctggccaccactgccagaagcctcccagggctgccctgaggcctgagctgcccgctcccgtcccccgcctggctcccctaccctgaccagcgccagtctgctgggcctccctttctagctctgcaggccccagggaaggcttgcagacccgctgcttctccaccttctctctctgctcaggtctggctgcaggagcccgcagcaaggagtgtgtggtgcaatgcaagggaattgtcagagcaaggttcatttcacacggtcttttaatcggcttcgtaaagccaaagaaaactgcgtacaagaattcctcagccactgcaaatacaacatcgatggagtatgcgtacgtcttccagtaaaaaaggacaatataaataaacatcttcaagaacctctcagggacgtctgcacgtctactgtggggcgcacagcacagatggacgcaggggctggggctccagggcagttgctgccacacccgccggggtcctaccacactacactcagaaacgtcacacggagttggaaaaaagccacagcttgctcagcttccgacaaagagcggattcacagtccgttcgatctcagagaagtgagtggggcacccacttcatggggccaaccccactaaaaaaaaaaaggcaacgcaaccaaaaactaaaacaaaaaccaaaaacccacacaacccccgatttttttgaaaactcatggctcgtggtcaaaaaagtaaatgcttttcaaaatgttttgaaaaccctcaaaaaaaaacagcacttccttaaaaagaaaagtctagtaacgaggccatcccggcgtcagaagcggtcaggctgggtttgacaagatcagaaccgaaatgactacgaaagtgggaatacaaggaggtgcatttactacacattaacgttcagcgaagctcccacaatctttaaacacacagccattggaaggacgatcttgagcaggaagggtttttactcgttgtgtgtagctgaggacaagaagcaggcacagtgtaaaggcaccgaagcaacaagaggcagcttcaccccagaggccagaccagggcgcggcctgcggccggggagcaaccaccccccacagccgagggaggctggcctgcggccacacatgcacctagctgactgcccagcgggccctcgctctcccttgcctttttggtcagtctcatttggcttttgcgtcctgcgatagaaatggctctgagaggacagatgcgcctcttctgggcaagcacagtgacaaggtctgagtgtccagcctaaagtgcttggagagggcaccaaggtgaaccgagctcccaccgcaggccacagcagcgtggcgccctcggagtgtgacttaccgtaactgtcataactgtctctgtaggacccgcccgagctccggtcactgtagccaccactctgactccggctgcaagacagacaaacgttgagtaccggaaggtacccgtctacttctgctctgccacaacaggctgagccgccagcccccatgccagccgtcccttctggggacacaacaaggaccccagcagggcagcatcttggaaattgttcaaaatctccaccagcctgtcccccaggccctcccgcttctgcgaatgtcctgagcagtctcctctcctcttggcctgggtccccacctgcctctgctccttgcccagccagtctcatctcagctcccccagggacctgggacccgggacggaagctggccatcccgcaaccacccctgtgcttgggccggcctccccctcacctgctatagtagtctctggagc

SEQ ID NO: 5561 - DNA, 5080 bp, Homo sapiens
aggcaatccctttctccactcctcatcatcccagttatgtcttattagttgaaacagtgtctcgctctgtcacccaggctggagtgcggtggcatgaccatagctcactgcagccttgaactctgggctcaagcgattctctcacctcggtctcctgagtagctagaactacaggcatgaccaccccgtcccggctaattttcttattattattatttgtagagactgagttgcactgtgttgcccaggctggtctcaaattcctggcttcaagagatcttcctgcctcagcctcccaaactgttgggattacaggtatgcgtcactgtgcctggccataaggtcattttatattctgttgtctatcaccatcagtacaatcactaccatatgctgagccaagtcctgccgatcgcagagcttagggctcagaatccccaggatcctggggggtagtgaagctgggaggggtcatgcccccaggccagggactgaccaaggagaatcgaaaggaaacctagcccagaaattccaagagaacatgctgcagagccggacaccttcacgtgcccccagcaagatgatgtggccctgagagaggagcggaccagagggtacacctgacagcagaggcaagttaggaagtccggggacagtcctaactctggatagcaaagatttaatttcaagcataaggcagccctggaaaagcaattgactgccactgagtattgatgaagctagcacttactgcaggctgtggcgggcacagttccaaacaagagccccgttctaaagatggggaaactgaggtatcggcatttagacatcacagaccttacttcagggccgctggacaggggtcaggcaggccctggagcacaggtggccatgggagtgaaggcagagggactggggcagaggactggtggggtggtcagttctggggcctgagctgaagaagtcgggagcggggcgtggcgtggcgtttccacgcccatggattttagacagctgttccgggggaggaggcgagcccaccgaggatgctgagtcatgttgaccggcgaaggcgaggggaccacgcctctggagctaccggggttggctcatcgcctccggggaggccacggagcaggtgtaggcggggttgagcgcaggcgcggatggggcgggggtaatgcgcacgcgtgtgcgtgtgggccagcacgtccgggtggtcaggacgcgcgcttgtgcgcatgtccccgcgcagggtcgggcgctggggtgtggagactgaaccttgcagacacccgggtccgcacgtctgggatggacgtggtgagtgcacgtgcgcacgcgctgcgtaggggcggctgcgctcatgcgcacatcgggagtggtgcttggagaggccacctactcaccgcgcccccaagaggccgggggtttgtccctggtgttggccctaccctgcgcgatccagtcttgtcgtttcggggcttcattaccagagccccgtgaatcctttgctagatgcttaaaaacattttccccattgtacatagctgtttccacgagaataaaaagctttacatttatttgaggcctgcttgggcctatccgcagctccaccgtagtgctaatcccctcccagtcctggaacagcccagatgatgtatttaatagtattcttttagcccaacgcgagaatgttttcgtctggttgtttttgtttttcgtttttagagacagtctcgctatattacccaggctggagtgcagtgtcaagatctcgactcactgcagccttgaactcctgggctcaagtgatcctcccacagtgctgggattacaggcgtgagccaccgcacccggcctctagttctgtctttttgctcagtattagaattcgtaagttctggccccagcaactcgtcctttcatctgtctcaagttgcactgtggtggtcacaggagctgtcctgcaccttgcacatgtggccatgaacaagactcgctccttgctctcatggggccttcattccagtgagacacaaatgcaaacacaaaattccagaagagtgctgagtgctatcatgagaaacgaagacaggctggaagatgggctctgaccccagaaaaccgatggagaggcccaagcagccttgggagcaacaggcaagttggaggacacacggcaaggctacttggaagtaggggagggtgcatgggaaaccctgaggctgtggggggagaggcaggagccaggtgaagtccaggtagatggcagtggagatgtaagaacatggtggaatttttttgtttttgagacggagtcttgctctgtcccccagggtggagtgcaatggtgagatctcaactcactgcaacttccgcctcccaggttcaagcgattctctgggattataggcacctgccaccatgcccagctaatttttgtattttttagtagagatgggttttcaccatgttggtcaggctagtctcgaactcctgaccgcgggtgatccgcccgcctcagcttcccaaagtgctgggattacaggcgtgagccaccgcgcctggccagaacatggtggaatttgagtgtgcttgggaatacacttataggacttgctgattagttgaatgaggaaataaaagaacgaagaatatcttctgggatttcagcctgagcaactgggttgctggtggatggtggttctcttatcaaggatgggaaagatgggttgtctcccctaaaatactgagttttaaaggcagggactgtatctttgcagtcctggctcctagcaagggcctagcccttatatgacattcgtgaatgttgaaatgaatgtgacacgcctgaaacaatccttctccctcacctaggcccacatctccaagtcaatattccagtacaagccacatccagtcccctcactgacacacacaggcctgggcccaggagctcacccctgtgctgtaaggctaggtgcatgtgttatttccagagtctacccttggaggtgcctcagactcctgggtacctgtcgctgggaggtagccagtcatgctgtccacatacatgcttttgggcagtagagaagctgatcattgggaaggtttatttcctgtctccacaacaggaggcaggtcacagcagtggccacacagtgcacaaaaggccatcccctcacagccgcatggttggcatgcagcatctcagcctccaaactggaagccccctatccaaggagcccccaggtgggagaggaaggtcacaagcctcccaagtacctcaagatgcctgcgcatcctcccccatttctcagatgggccaaggcctgtgaagcccttgcagtagtagctcaggtgtagcatctgctcagcttccctccccactcatttgcacacagccagagctgcgggacttctgccctctggcctccagcactgctgtgaatcagaactagtcaagagaactgggtgcttgtgttaaatgggaacactctggaataaaatatgggcttttttaaagagatggggtctcactatgttgcccaggctggtcttgaactcctggcctcaagcaatcctcccaggtcagcctcccaaattgctgggattacaggcgtgagccagcacacccagcccctgctagctttttaatatgaacttccagtgtattcttgagcactctcaggcaacatggccgttaccgagcaactttgtcctgaggtgcatttggaaggctctgggacttggtccccatgctcaacttcagggcaccttggcagaaagaagagtggttcctacaccagcagcttatatattaatgcccacattactccattttcttcaggtcgtcaaaaaaggttccactgaggtgctgtctttctgtaaatgaaaatgagctgaaatgctcctgtgacctgccctccatttgtgggtctcatgatactatctttcttctgcttaacacgatggcatcatccagtgagacaggtcctgtttttgtttttttctttttttctttttcttttttgagacagagtctcactctgttgcccaggctggagtgcagtggagcagtcttggctcactgcaacctctgcctcccgggtgcaagcagttctcctgcctcagccttccaagcagctgggattacaggtacctgcgaccataccacctaattttttgtatttttagtagagatggggtttcgccatgttgggcaggctggtcttgaactcctgacctcatgatctactgtctcagcctctcaaagtggtgggattataggcgtgagccacagtgcctggcttttttttttttttggagacagccccatcgttctgtcgccaggctggagtgcagtggtgcgatctcggctcactgcaacctctgacttcctggttcaagcgattcttctgcctaagcctcctgagtagctgggattacaggcacacgccaccatgcccgactaatttttgtattcttagtagagatggggtttcaccatgttggccaggatggtctcgatctcccggccttgtggtccacctgcctcagccacctacagttctgggattacaggtgtgagccactgcggccggcagagacaggtccttcttatccctgtaaggcacagtatctctgccatagattgggtccctggtttgggaagagggtaaaacaagccctcattcttgggtctcgtcattggacaagctggctgggcaagtcacagcatccacatttggtggaacatgggtgttggtagaccccaacccagagagcttgcacccttgcagaggacgtctccttcactactgcactggctccccctgcacaggggcctaaaccagcttgggccttagggaagccaataggggaggcgtagctgcttgttctccctcctgcccatccacttcagctcaccgtaatatcccaagtggtcttccccttgctagaatcagaggacaggctgacctaaaaaccaactcagtatgcagcttttcaaagcaatgagtcaggcagggcttttgacataatgtcctctgcagttcattttaaacaaggatacaaa

SEQ ID NO: 5562 - DNA, 318 bp, Homo sapiens
gaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatg

SEQ ID NO: 5563 - DNA, 672 bp, Homo sapiens
ccaagagtgagggctggggagaagggaagccccaagggggagtttcagggccctgagttaggcttcagaggcagcgctgggtaggcctgagaggagcaagcacagtgggaggcccaacctcagaccacactcatctggatttccagaggtctccaggaggcaaggactatttggtggccctgcttcacccaactgctcttctagcattctccacatcatgtgctatgagttggattcgatcagaattctcaccactggttctaagtcagaatcatctggagagcaagaagcagaatgtctgaaatcttcctatggtacagaactgctggatgagaccatcagtgggatccctcacctgcaggccatgaggaccgttttatgggctctaaactgctcacggctcacaacaatgacaacatcagtcaagatgtctcgactccggagacgattaaggttgagaagaacatcactggcatggcgggtgaactggatacagctgtcagccggcgaggccattttgtcttcacttgaaaaaagaggccaaaatcctgttagtcctccagaacctgtttcctgcttgccacaggtatcagagcaggtggcttagcctgctaaggtacagaatgcaactcaggtcccttgtatttgatctttgaacaattcatagtccaa

SEQ ID NO: 5564 - DNA, 1112 bp, Homo sapiens
ggctggctcatcccttgtaggtcctgccgggctggggcctggggtctccgatgggctctcggctggctcgtcccctgcaggtcctgctgggcgggggcctggggtctccgatgggctctcggctggctcgtcccctgcaggtcctgctgggctggggcctggggtctccgatgggctcccaggggtaccttctttgggccccgttcgaccttctgtgtcctcctcaaccccgttctcactgtgtccagccttggggtgccccgatggggcaggggacccggcaagggccaaggtctgggcaccaccactggccaccgcagcactgtccccagcaccctcatccaccttcctccgcttcctcaccttgtcggccaccctggctcccaggggttggcggcagggctgcactgcctccccagggtcctgaccgcccacttcctgggtccccgtcctgaggctgccctggctgagggcacacccctccaaattcagagcgatcttctccacctctgaggcactctgagggcctggctctgtgggcggctgctcccgccggctcagctccagcttcctcttcttgctctctttggggcttaagggctccggcctatcttccccgtggccccctgcctcatccccctggctcctctccaggggtcccgcatcctggggctccacgctccgtggctggggcccctcgtccaccctgcccccacccttgctatgctctggcccacaggtccgaccctgggtgctggcctcgtggtcggggtccccggggcttccttcctcctccaccttcctggagccctcgagcggatggggcagagagctgggcttgaacctccgcagcttgtcttggggcccccagacgaacttgcagcggggccggaagtgctcccaggcgaagtgcaccagctggcggcgctggtgtcggcagcgcacggcgaacatgaagtagtccagggcactctgccgcacccccggcagctcccgccgcaccagcgtctcctccaggaagaagcggaccagcggcgcctggaagtgctcgaggcccagctcacccagcgacttgaggatgcgtgtgatgcggaggttgttgtggctgcgcc

SEQ ID NO: 5565 - DNA, 1042 bp, Homo sapiens
ctgtgtagatgggatctgcatgccctcatctaatgtctcagggaacatagcagctcgtaccctctgagctcgagtcattgcatactgtccatcaatatcagctacttgttcttgagtgaaggactgagaaaatccctgttcccactcatacaggacttgggaggtatccacatcctcttcctcaggattgcctttaccactcagagaaggagctgtggtagtggcaccagaatggattccagagtccaggtaaacaagccaggcgaagtggcttgtaattctaacactttgggaggcgggtggattgctgcagcacaagagttccaagaccagcctggacaacacagcgaaattccatctctacaaaaaaatgttaaaaattagccaggtgtggtagtatgtgcctgtagtcctagccactggggaggctgaggcaaagaggatcacttaggagttcaaggttatagtgagctatgatcacaccaatgcatccagcctgggcaacagagcaagaccctgtctcttaaaagaatttaaaaaaaaaaaaaaggatacataaataccactgtttcaactgcctatagtaacacgctatacagctttacaccctagaagcaacaggctatactatataggctaggcatgcagtacactatgccatctaggtttgtataagtactacgctaaatgtttcaagacacagattatcattaaactacagactacattagaatgctgtgttttccaacagctttatcaccaccaagtgatgttttgacaaagagggggctagccaacttctcatgtattttccatccagtctaatgcatccatgcatcttttttttggcaatatgaacataatactctttccaactacaaggatacttcaaaattcaccgtgctatttccgattttaaccctataaatgtctccagtcaaagtcaatgggagaaatcttgccacaactaatatataatagatttcacactgaagttatttttcctcttcccatcaggacagaattatcttaattaccttag

SEQ ID NO: 5566 - DNA, 3953 bp, Homo sapiens
actcttcaacctgcttccatcacaacttctgactgcggtcacaacccacagaaccgcacctccatgaaatattggggggaggcagtacatccacgatggtctcagtgtgaggggagggggtttgtagggaggggcagaggttcattcttcagtgtcctcggagctagctcttcggtgtgcttcaagcctttagcatcagaatcgctgggcacttggtaaaaatgcagatttctgggatctctctcgaaccttgtgaaggagaatctccgaggctgaacccaggaatctgcattttaacacttcactacaggcaatctttggcccccttggaggtgtgaaaccttggtccagcgctggtgacctttcgatggtgggggaggggtggtgaagaaaggaggtgaaccccgtcatccaagtagcaggggatcaccaaaactgccgaagtctggaaaggatgtcctgtcgcctgtctgctgtgcacccgtcttcaggcccctaccctggcactcctgcctctcaaaccggaaggaagggtttgggagcaggaattcgagaggcctggggccaaagtttcgccagtgagagctctaacttgggtctctgatttaaaggatcctggccactgtgttccggttggggtgggggggtggggagggtgacagtgacttacacatcccctgtcctggcaacccagaaagctgtttgatgccctctgcaccccccgcatacacagctagggtgctggcgctgcctgggccctgggtgtgagagtccgccctctggacaggtccaggtgagctggttcattccacacatcccagaaactggtgaacacaatgggccctaggacccagagaacaactcaggcacaaagcctccccccactcccagctgcttcctgcatctcaggcctttctgcggcctctgcctcctcccccgccctcttcccctccatcctcttcctccttttcctaatctcccactctctcccccctggcctggaagggctggcaaagggagccctcctaccactccactgcaggggtgtgtgtgggttttgtgggatattaacgcgttaccatgtgcaaaagagcttagagtacagcgtgggggatggggtgtggggaagccgcctgggaaccctggatattgggatcgggaggggccaggaaccgcaggactgatcctgaggctggtgctaaggaagagggaagatctaggttgtgagctagagccggaagtgaacccagacctcacactttccaaatgccacctgcatctttgcccagttgcccaggaaacttacccctccccagttttgcactttgggatggtgcagggtgaagaagtctgtctcctaacccttcttagaaggcctctgtcaggagcaagctttgggacttagatttccaaactcaagattgggtcttgaaaacccctccccacaggccccccaaccccaatatagaagtccggagaagacagaaacctcacccagttggggtttggaagtttgtacaatgtactcagaagctcttgtgtggattggaggagggcgcaggcccctgtgttctgcccagaatctcccacacccttggtggtagatcatcttaactggtcccagcccaaggggtctgtgcccacgcgtctggccaggtggggaagcccccagtttctgagggtgggagaaggagctgagaaccagctaccaggcccagagaccctcggactcccagcatttccggtagcagcttagagcaaactggaattacaggggtgctcttgggtctcccttgtccaaaggattatgaatctccggacaaacccctttaacagacccttctagggggtttgggcttcaagagggtggagctagccagagcttgggggactgaggctaatcagtgggattattatttcatgggctcctggttagcagagcaacaccctggccagaattcccaaagacgcttttatggagcggtaagtgcttcaccatcacttgttctctggtgtcaggcaccaagccggctggcctgtgagatgggtgaagaatggggtctcattccctccatcccttctctgcctgtctggagcagtaatcgcacctgataggaacaaggagggtttgggagggttaccatccaaactgaaggctttaaatagaattttcattcattgggctgtcatcttcacctacatcctccagtgaggaagcactccaggataatttaaccaccctttctctttcctttgtcttcatggaagagactttgatggccaagttgcccagtggtctttggatggaagttccttccttacctttgccttggcatagagtggttgacctaggagccaggctgctagggttcaaatcttggcttcactgcttactggctgtgtgaccttggacaagtcacttatcctcctctgtgccctgggaggatgaaagaaggcccagaaaggacgagagtggctcggacacagaagatagggtgtgggggaggagacgcctttcccagcctgtgctaaaaaggccagaggctgcgataggcagagataattcacccccaactctcctcctggtaaccgcccccctgccacagctttcccacacccccccaaatctgcttagggcccttgggaagatgctctgttaggactcttccccaaggcttgctagttttaaacaccaggtgtaactgcaaagatagtgatgaaggcagggagaggcctgacgagcgataagtcccgagccctcagcgccctgggcgcaggcccgggctgggtgccaaggctggcttctctttccagccctggggccttgagactcagcttctaaaagcggtttttccttggccacggtcatctaagcagaggctggcccagaccctgcacttggatccttttgtggtgagccagtggtccccacccagttgctctccttcaagagttgacctctgccagggatttgggctggttataggatgctggaaaggtatgctggaaaggtgtgtgtacacctcaaatccaggatgtcagtgttggaggggcctttagtggcccttggctgacctcttcacagggagaatgacgaaagctgagaagtgacatacctagttttaaaggaaacagaccaggctagggttcatgaggcctgaattgagtcctagctgcactcatttgctggatgaccgtgggctagtcgtgtcccctcccaaagcctgtttcctcaaaaagcttagcttgagtgtctgagtgtttcctgagcatagataaccctaggtgtccctcacttttgtgcatgcagcacaggccttgaagccaggccatctctgttagaatctccaacctcccactccccagctaaggggcttcaacaaattccttcatctataagatgaagataatataccaacttcatagagtttttgtgaggaataaatgggtcctcaatgcataaggcactaaaagggggctcagagtgttggctgttactgattgcagggtatccaagcacatgtgggggtgtgtgcctgcatgcacatgtgggcaggtgtggctgagaatgaaactcggtgtttgcatctctctgtgtgtcttcacaggactttggggctctcattttctttaaggttcaatatgtgaaattctgaaatataaacaccccttgcttacagcttctccaaatctttgggggtcattcttgggatgacctctcttctctacttcccaaagggtttttcactcctgcctgtgggtgcctcaagcccctcattgtccctgcagggagaggggtcccttagggtcctctcacagctaggagactgccttgctgctggttccctctgctgtacccagtttctttctatcactctccacacttgctccagtggctcttggaaagttcagatacatcttggagactagggagggagacttggtaggaggag

SEQ ID NO: 5567 - DNA, 1606 bp, Homo sapiens
aatttgcactcctcttctccatgctggcacttgaactcccacctgccactgacattttgttcctgcaaggcagcagggtgagagcctgctggtaggctgggtcccctgctcccctgcccacgtgcctcagtttccccagcgcccacacacctgtgcgtttccgtagggcaccagcgtgacattgaggatctccatgaccaacagccatgttgggaagagctcccggatcaggaaggctcggcagccaccgcacagtgcttcatagtagagggtcacattgacaagcggtgcattggacttcttcaggggcccccgcaggtatagattgcctgtctgtggattaggaaggcgtgggaggcaggtgtagccctgggcagttccccacttctctcaaccccacttggtagtcttgtagaaagggggctgtgatacgcaattcatcttgcacgccttccagaacttgccaggtggaatcttgactttgagacttttttttttttttttgagatggagtctcactgtcgctaggctggtgtgctgcggcacgatctcggctcactgcaacacccgactccctggttcaagcaattgtcctgcctcagcctcctgagtagctgggattataggcacatgccaccacacccagctaatttttgtatttttagtagagacagggtttctccatgtaggccagaatggtctcgaactcctgacctcgtgatctgcctgcctcagacttccaaagtgttgggattacaggcatgagccaccgcctccggccttggcccatgctcatttcttgtcacttcacctggagaccttgcctctgagctgagcaagggatccacgtgaaccctttccaagtccgactgaatagaggcggcacctaataggtgctgacttccggcttcagctgaggggtggcgggtggcccatgtcgctggagcggtgagcaagtcgctcagcctctagggcatctgcctaataggtcccaaagacacgcgagccctgccctggctggaatgaatgcatcaagggtagcagcaagaatgcatgccggcggcccttggccagctgctgaacttgtgccctgggccacaaaaggagaccccagctcctgccccaaaagtacacagtaggcgctcattgaacccttgggcgggactaggcgggtggaggcagctgcgcctctcagatgcgggatgcgaaagcgaaacggcacggagggagtgtggccgcagcgccgggaactgaacagggtttttccaggaacccggcagggacagcgtcccctcggggccctggtcttcccctgtgaagtctggggagaaagaaggagccgcgtgccccgacagggcgcctgttccctccagcctgcccgccctgtcgccgtccctaccttgtagttaactggtggcccattcccaaagaagtctaacgcttgcagaggggacgcctgcaccgccgccgtggggacgtccagcagcagcagcagcggtggcaggaacagcagaagtggcgacagggtcatcgcagcaggggcaaaggtgtggcgactgcagcggctgcctgggaaataagcgcctttaaccaggcggcggtcccg

SEQ ID NO: 5568 - DNA, 3827 bp, Homo sapiens
ggccaggaaacacagcacctgggacaccactgtgagcagggcctggaacaggctgtgtgggagcagaatccaggtgggcttgcgggccacttggctccctgagcccccactggcctatgctgaccaaggtcctgacctccatcttaggcaagacatttaacctctgtgggcctcagttccctcccactgtaaaatgggcataataataatgatgcctgactcatagagtgttttcaaggactaagtgaaacaggtatgtgccgaggcctagtaaatgtcactatcaccatctacagtgatgggagcacaaggggccccaggctggacggcagcccagactcctgggactggcctgtacacagatcccgacttcctgggccccgtgtcctcgcctctaaagccaacctggtgccttctgccacaactgccccttccagacctcagagacagttgagagaaggaggagtgagaacccacgtacaagaggatttcaaagtagctgtctatgaacgagatccagatgaacacgtggcgccgccagaagtaccacagctgcggaggaagggaggacagagggctgtgaaacctgctctcccgcatgccccctgctggcctggctgagtgggagcctgccacccaggctagagctaagtcagcagctttggttttgggggactcatgaatacttctgatagctgagatagcttgggactttctttccagaaagagcagccacctaggcaaggccggggggtgcaggtgaagagcctgtgcactgcatgcaggaaggggaagagcacctttcccttcccttctccctggcctcacagggagcacccataccccagccaacctgcgtttggtgcccaagttctgcccactctgcggaggtcccaatgtcttggtgtccagcctgtgtcctgcaggcttacagcatttcccactgaagaggccctactgggggaaatagcctgaaccccacctacctctggtctctgtgctccccaagaggggagcttcccagccgaggggcctggctaggggcaggcgcttccagctccattcctgggggagcagagtctgtactgccaaggaatcagagaagctatctgctaccccaaggaaccccaaaagcacagcagaggggttcctggggactcagaaggcaaggccagaacctctggccctcagcttcagtgaggctggttgctctgggtgggactgggtattgtcagtgaggggatgcagctaactttctctaagccccctgaagcagaattctaggtttgcttcttggtaggagaaggggaggggcactcacctggcccacgaggaggtagatcccccctagcaggataaggatgtggcccgtcagcagcatggagtttccaacctccgctttcaggtgaggggcggcctgctgaagacacactcagatgagacctagggccttgggtcctctctcgaacagctcacccttcagagctgaagctgagggcctactctgagcctgagctgtggagaggctcctcagaacggcatgggaacatgggctccagggaaggacccctggatcctgagaggcacattgtgtagcatttcagtgtagggtctgaagccagactccctggattcagattccctctccacaccacttccattctgtgtgaccctgggcaagttacttaacctctctgtgcctcccttccctctactataaactgggggtgattataattcaccatctcaagggttttggggcacattaattagtcaacacatgtccatcacctagaatcctttttcacatacagtgagcactcagcaaatcttcactgtatcaccgttagtactgcagtgctggctcccataagcttgggaatgtcactccagcagcccatgcctcagcactattactgccccatcttcccccagggttgtttcaagcaggcctcccccaagatgtgcccccccaaacctcacgcccttgccttcttcagggtaggctgatggtaggcaacagcggtgaagatgaacatgtagatcagattacacaggaagtttaagaagaacttggggatgagcagatcccatttcgcctgcagcagtttgttcaggggctccaaaacgaccattcggtgtcggtgctggggtggggaggggagagccatgggtacactcaacaagtgcaaataggctgcccactccatgtcaagatcaaagcaagggcccaggaaatgaggagagaggacagggagcaggcttccacaccccaggagccccaaaggacctcacgccaaccctcccagctacagtgtgactaaggggcttgccctccaaatgagatgctggttaacagagaggacccggatggttgccacgaggcccttggcatgatccccgtcttggatgggactagagtatggattgagtatgggcccggtggccatggtcagggtcgtgcctgctgggacatgcagccacacccccactggcacaggaatggggcagatatggtccagcaggcagccccaatttgtggaccttgctggaaactctgctgggtcctctgcgtgcacccatgctcctgtgggctcaccgggctcttgcaatgaaaggcaatgatctccagcactgagttctcctcacagctgtccacagaagccaggtcatacagcgacacccggacaggcccatagcaccactcggtgaactttcgggaaaggtggctcagtcctgaaaactcccgctgcaggatgtgcctgaaaatctgcagggtggccatatgagcttgcattcatggtcccttcctggcactgatcctgggccaaggctgggaaacacccaggactcagcagctgcccacggtctgcagagctgcagctgacacgtgcacgtacccccatacacgcaggtccttgtttgtctaaactcttaaacacacacacgcacccagccacatctgccccagcctgccagccagcctggctcttccttcccctcccctgccctgtggccttccttgaactcctcaaatggcagattgatccctagccctggggtccttgaggcccctgagatcagagtctactagctgtatctgtgtgtgcactttcgcggtcagaatctagaattttcaacagactagaaagtggtccctaatccaaacaggttaggaagcagtctggtttcacgcgtgaggaatgggaaaggaggaacagatcaggacactgctttcataggccacacagcagtgcctctagacaagaaagtgaggttcacacaccccagggagcactccaaaaaacttgggagggcagcgaaaaagggttaaaacttctatttatgtttatcgtttccttaatctttcaaaaatctccactgtaagcccatgaggccagccctggtgagctattggcaaaagctatttggaacaggccattggtaagctatctggaacaaagtgggggctgcctcatgtttactcttcctaccagaataacttccagctagtcaaagctctaggcattaaaaatgcagctgcaggctgggcgtttcggctcatgcctgtaatctcagcactttgggaggctgaggcaggtggatcaccagaggtcgggagtttgagaccagcctgaccaacatggagaaaccccgtctctactaaaaatacaaaattagccgggcgtggtggcacatgcctgtaatcccagctactcgggaggctgaggcaagagaatcgcttgaactccggaggcggaggttgcagttagccgagatcgcgccattgtactccagcctgggcaacaagagcgaaactccatctc

SEQ ID NO: 5569 - DNA, 2401 bp, Homo sapiens
agtagcatcttagctgcttccggccgctggtcgcagggctgcgggactacaatcttcgcatgaaatggaagagagggtggtgcggatagcttgaggaaggtacggataccttgagggaggtatggatacgttgagggaggtacggatacgttgagggaggttacggatacgttaagggaggtacagcagcggtgcgcgccttgcagggcatgctgagaggaacagttttttaactgcttctggctgttggtggcagagctgcgggactacaatcccagtatgctacgggagtggggatgatgctggtcccttgaggggggggggcagcgcggtgccctcctgccgggcatgctggtaatagtgtcttagctgcttccggccgttggtcgcagggctatgggactacagtctcagcatgcgcagggttcaagggtgttgcgcagccccgcagggaggggcagggcggtgttgacctctgtttccaaacccatgctggctactgaatctgtgccacccctggctaaggggagtgagtccatagagggacttgaagggcaggtctgggctgggcagtgaggagagtatgatactgcaaagtgcgcctcgcctttgccaaaatcggtcgggtctcaggctcaccccacctcccgctgctcagttccgtttccctccagagcatcaagcctcctcccgcccagggggcctcctgctttcctaagctgctgtggaatcggcctgaggtcccagacgctgtccattgtgctgctgctctctgctttctccagccagagtgccagttcatccgcttttgggagaactccgccgcctggcctgcccgcggaaaaggtcacagctttgcagggggtgacatgggctatggcttcctggaaatgtcaccctcactagcgccttttagatagatgtgaattttgagacatgagggagagtaattattggtttacccaggagatgctaagagcagaggagaaaaccctaatttccaggcatgtgtcctgagccagggacaggctggccagaccctaagcccccagtgccgccagagagcagcctactgccctgatttgtgtggaatccccttcgtgctgctgggccttagcgtcagggacagcccagtcaggtgaaggtggggatgacccatgggcttctggaagtgggttggtggtcctgggagggccagcccatccccccttggagagggtctttgtgctgaaggatgcccacagaggcctgggtaccaggaacactgctctaggcaaggtgcctttcttccagatttggctgaaaggaaggaagacttggtcagcttttccacccagccatctggcccttacagggctgctccccatggacctgggtttgtagagtcctccagggctttgtgtggcccactagttctgatactgaggacacccctgcaggctgttaatttcagaacaaggggtgtgtgcagactggggcatgggtgctgtcagggtaccccaggctgctccagggacggtaccccagtgttcaacttggcttggggccccctgcctcatgcccttactccagggctgcttggcctgggcttgagccatggtccagaactcaggtggccccattgccacctaatataagggcctgtctccacagtgggtgagacgcccctgggcactgggctcttcagtcatccagggctatccactccatggcatgagttcccacattcagctgaactctgtctggctctggactggggtccctcctgtgccctttccctgaatcctctctgggtccgagacactgatcctcttcactctctggcttaaggcttgttctcctgacctccttggaggggtgctcaggattgaggacccctgctgttctctggggctgttggtactcggaggtgtgggtgttggcttgcactgagaagtccaaccccttcagtgcccttcaggggtcctttaagagcaggagtgatagggtgtgggggagtgccttagaggggtcttgccctcatcccctgccctgtctctgagacgtgtccagtaaacctgaggtcagcacctcaggaatgaaataatgtcttttgcagcaacttgaatgaagctggaggccattattccaagtgaaataactcaggaattaaaaatcaaatgccatatgttctcacttataagttggagctaagccatgcgtatgcaaaggcatgcggggtgacataatggactttggagactcagacatgagggtggcaggtggatgaaggatgaaaaaactacctgttgagtacaatatatactactcaggtgacaagtgcactaaaatctcagaatccaacactatataattcattcatgtaaccaaaaaccacttgtacccaaatgatattgacatt

SEQ ID NO: 5570 - DNA, 3398 bp, Homo sapiens
atctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttaaaaagttcaacccctgctgggtgcagtggctcacgcctgtagtcccagcactttgtgggggccgaagttgggcagatcacttgagcccaggagttcaaggccagcctgggcaacatggcaaaaccccgtctctacaacaaatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctc

SEQ ID NO: 5571 - DNA, 3400 bp, Homo sapiens
atctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttaaaaagttcaacccctgctgggtgcagtggctcacgcctgtagtcccagcactttgtgggggccgaagttgggcagatcacttgagcccaggagttcaaggccagcctgggcaacatggcaaaaccccgtctctacaacaaatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctcaa

SEQ ID NO: 5572 - DNA, 4853 bp, Homo sapiens
ggctggccctcctgatctgcacccaggcggcttctacaccaccctgcagcaggcctggccaccggcctcagcgcttctgggagaaggtcagccaggtggaagatggagagggcttctggactgagccctggaggggggctaggggccaccagcaggcagatgagccctgggacccagctggccaacccacctgaccacggtgacaaggactgcttgggaaggataagcccaggttcgggaaagcaaattcaggctgcaggacagctgcccgggccccccacaagcctggcaccagcccagggaagactgaggagcctcactccatggggactgcaaacacctgaacacagcgaacctgaaggtatagggcatcttcaggctgctactgaggcggtcctgccgcactcaacccagaacctcatcactaaaaggaacctcatggttcaggctagagtgcagtggcgcgatctcggctcactgaaacctccgcctcccaggttcaagcaattctcctgcttcagcctcccaagtagctaggagtacaggtaagtgccaccacgcctggctattttttttttttttttaatttttatttttagtagagatggggtttcaccatgttggccaggctgatctcgaactcctgacctcaggtgatccacctgccttggcctcccaaaatgctgggattataagcgtgagccaccgtgcccagctgtggatgtgcattttttttggaagagggtccatagctttcatcaggctctccaagggtcaatggccactcagaggcacaggactgccaccaccatggcagtttccagccaggtgggaatgcctttctgccgtgggaggagtctccagtctggccaccaccctgggcagacctgaactgagtgaaactggtggcctcacgtggtgccttgggcaagcggcgcagctgaagaatcacagggtgggtctggctacctggcaactctgcacgatcccacccgtgtccaagctcagtctcactgtgtcaatacccgctgtgggaagaaggtggtgggctggagcccgggcatgttggctctggttttacaactctgaaggtgcccagctcttgagcacagctggtgacactgactgtgcagctgccacgtggggatctctgtcaccaaaagtcaggaagcactagatcatttgttcttgtttggttttttaggtaggatggtttggattttaggtaggatttggcattggctcctgaatgacaagtataaaccaaaaccctcgtccagtctagcacttcctggccttggcacaagaactgagggctcctgtaggctcatcccagccgacagtagcacagtctccccagcgaggcagcggacagcggtgcccctctgcagcccatggcttaagcctacctctgccttctcctagacctccccgacctccccctcaatccccatagcccagattacagagacaagtctacaacaggcttttggctgccagagggaggcttttaaatcccagatcagatcctgccattcccacttgtgacactgtctccacagcctccagcgcaaaagctaagccctctgcaggatacacaagtcctcgcatgtctgtccagaccgttccccgagttccaggacccagtacctgagtctgcctccccctttctcctgggatgctcagagccacctggaacgagctcttgaccaccccacccacacctgctcctccttccagccctggtgtgcaaatgacactaggatagcgggggtctggctcacaccaaatttctagaaggcagtctttccctcacctctctcctgcctaccccatcccacccatcagtgagtcctgtggttctcaacacagagctcaaacccacccaactttctccacatgctgctcctccccagcctgagcccccatcccctctgatggggacaacggtgacagctccctagcgggtctgcatccaccgggcccctcctagatccactgtccacagagcagccccgttcttcctcccttctcgtccctgccatgaaagtaatactactgaccccacgagactcagacaaagctgaaggatccgacgtaaaggtttagcactgcgctggggccctggaagcctggctatgttgactggcattagctgttattcccagccagtcttctcattgcctgggctcaggcaccatggccctccctttctggtaacttcacccctcacatcaatcactcctctttccagtaacttcctggctacttctctgcctcaccactggagtaaatgaatgaaggtcagggacacattcaggggccagctcttatcttggagcctacaggggtgagcacaggcaggtgcactggaacgcgtggcagctatgtgaaaaggagagaatggcaacattcgctgatctcctccatcaacgtaggggactcctagtggtacatttcataaacggctgcacctgcgtgcttggaaaacatgctcagggtgctgagggatgaggataagttcacaaatgacatcgatgagggaagaaccctagctaggggtctggggggaagagcctcttggggtagagtgcacactttctcttcatgagtgattggctctcccagggcccaggttcactgtcaagttcaggggaaagaaacccctgtatgagacccaccatccactctagccccagagatgccaaggtcacccaaagaaaaagtgacatggggcaagtccaggggactcagaccagggcagaaccgttacagtaccttccgcggggagtcccttcaccttgcagggagtatggagggagccccaaggaagagaattattttgctgcctggtctgcactgcccccatgtggaagactgcgccattacagctgacctgggcgcacaggagacaacagctcctggggccggtgatttatccttaatcttggacatgattaatgactgcccatgctcaggctgtccttgaacagacttccccttgtgggtcttgttggccccccatcatcctggacaaacagacagcgatgagtcaaggcaactgtgtctcactgcagtcaccatgtattagctgtacttttattattataacttgcgtttactgacctccaatagcttaatttttttttaatatttaaaaataagtaagaacaatccattttctttcattccttttttttttttttaagacatggtctcactctgttatccaggctagagtgcagtggtgtgatctcagctcacttcaacctctggctcaagtgatcctcccacctcagcctccccaagtagctgggactacaggcacacgccaccaggcccagataattttttgtattttcagtaaaaacagggtctcgccatgttgcccagactggtcttaaactcctgagctcaagcgatgtgcctgccttggcctccccaagtgctgggattagaggcataagccaccatgtctggcccccagtggcttctaatccgccctatctatccatcaagcctgggtggggtgggcttgctcagtgtccttcagattccttcatcaattaactcttttgtgtacgagggtgtcccaaaagcagcagccgcgagtagaatttgccttgggtcattgctgtagtctcccgcatccaggaaagatctaggccgctcgctttccacaaaccttctggctgaaacaagccacttacctggctgcagtgaagacactgatgccgctactgaagctggagtcacaggaaccatctggacctcctgggagaggaagaggaacaaggggtcatgaaaggctgttggctctcttgaataaacaagacccctgtgacaagcacacacagaactctccagagccccataccttgattcaggctcttcaaaaggaccatggctctggagccctgaggacccaaccaacgcccagtcattctcgatagtccccaagcttgtaagtctgtagtcacagtgatctcacaaggaggggacaccagtgctaaacacatctgtcaaatctcagaagggatcactggcctgaggggaatggatgtttaaaatgacagataatacccagcatccttagctatcaggaaaatgcaaatccaaaccacaagatactactgtacacccatcaggatggctaaaataaaagacaaataatagcaagtgttgatgagaatgtggagaaactggaaccctcgtacattgctggtgggaatgtaaaatggtgcaagctgctttggagaacagtctggccattcctccaaaggctaaacatagtcaccacatgactcagcagctccactcctaggtatatgccaaagagaaatgaaaacttatggccacatgaaaccttgtatatcaatcatgttcacatcagcattatctacaatagccaaaaagcagaagcaacccaaatatctatcaacagatgaatggataaatgaggtgtggtatagccatacaatggactattatttggcaataaaaagggatgaagtactgatgcacgccataaaaatgaactttaaaaacattgtgttaagtgaaagaagccagtcataaaagactacatattgtatccctttctcgaaagtgtttagaacaggcaaacctatggagacggaaaatggactggaggttgcctaggactggaggagacgggggaatagggtataatggctaatggattctttcaagggcacggaaaatattctaaaattgattgtggtgatggttacataaccctgtgaatctacaaagtcactgaattgtacacttgatgttgggtgaattgtgtggtacatgaattctatctcaataaagggcttaaaaaatga

SEQ ID NO: 5573 - DNA, 1815 bp, Homo sapiens
ttttttttttctcttttctagtggcatgtgtattctttttctaaactcttgaatactaaatttaggtgtattattgccttttaaaatatttatttgagatgaggtctcactgtgttgcccggactggtctcaaaaactcctgggcgcaagtgatccttccgcctcagcctcctgagtagctagaatgactttttctttttctctttttgagatggagtcttgctctgtcacccagcctggagtgcagtggtgcgatctcggctcactgcaacctccgcctcctggattcaagcaattctctgtctcagcctcccaagtggctgggattacaggtacctgccaccacacctggctaatttttgtttctgtttttttgagatggagtctagctctgtcgccaggctggaatgcagtggcacgatcttggctcactgcaacctctacctcctgggttcaagcaattcgcctgcctcagcctcccaagtagctgggattacaagcatgcgctgccacgcccagctaatttttgtatttttagtagagatggggtttcaccatgttggccaggacggtctcaatctcctgacctcgtgatccacccacctcagcctctcaaagtgctgggattacaggcgtgagccattgtgcccggccctaatttttgcatttttattagagacagggtttcaccatcttggccaggctgttcttgaactcccacctcggcctcccaaagtgctgggattacaggcgtgagccactgcgcccagccctgggatgaccttttcttgactgacttggttggatttgatttgtagaggtgcggctacacgattttctcccattcattttattttatttatttttgagacggagtttcactcttcttgcccaggcccgagtgcaatggcatgatgtcggctcactgcaacgtccgcctttgggttcaagcgattctcctaccccagcctcctgagtagctgggattacaggcatgtgccaccatgcccagctaattttgtatttttagtagagatggggtttctccatgttggtcaggctggtctcgaacttccgacctcacgtgatccgcccgcctcggcctcccaaagtgctgagattacaggcatgagccactgtgcccagccttccccttttttattgtgttcttaatttctcccttggcctcgttttcatttcgaggtcagcatggcttgggatgggacaaggtaacctgaaatgctgcaggtgggcaagaatatgtgtagacacacacagacacacacagcccacatgctctgctgccctgtatcgctaaggctgtggccatggcattgccccatggagcagcaaacatgaaaagcaatctgatggccgggcatggtggctcacatctgtaatcccggcactttgggaggccaagacgggcagagtgcctgaggtcaggagttcgagaccgacctggccaatatagtgaaaccctgtctctagtaaaaacacaaaaattagccggctgtggtggtgggcacctgtaataccagctactcaggaggctgaggcaggacaatcgcttgaacctgggagaggaaagctgcagtgagccaagatcgcgccactgcaccccaacctgggcgccagagcgagactccatctcaaaaaaagcaatctgcctactgctgggtggaaaacctgctggagtcatcaggacctttgaaaacagggagctagtccaagccacacacacaaagggtgaagggcgggaagtcactcacatctcctgggctcagacccaggcctgggcgctgataatggcag

SEQ ID NO: 5574 - DNA, 7722 bp, Homo sapiens
agacgcggggtcagcggctcagagcgcggctgtgtggggctgcggggctcccgccatgcccgctggggtaggtcctgcggaccccggccactggagccactcatcatttccgacggatgggccggaggggccgccggccgccccagccagggtctcggtagcctgcaaggagagaaagaggtgggagcagcccgcgcggggccctgcgtcttgcataggcgcttctgggcgcggaattggaagcagtcgtcacccggaggcctgggcgtgcaagcaccgaagctctggctggccctgagcctccccaccccacccgctcttttcgctggaacgcgtgtactttgggcagttgctgacgtggagacaggacgtatgtcttcatattttagtaaaacccaatgccctctgcctctctgattatgttctttaagttatcgccagttccaatttgtatttcttggaaacggttgggtcttccctcacttttcagtattttcatgtagactcaaatactctggattaatatttgtatttgcccaaaccatcacgagcacctcttaccctgatgggcaatacttcagtgtgctgcgttctggccacagagcaaacagggtgctcccaggcactgccctctcggatttcttgccttgttatttaatcattaagatcgtgacctatgagcaggactgtttccagccagcacatacacatgtcctctcctggccagcatccatgctgattagacggtgcccctgccatactagctgcctaatatttcagataccccaccccgtgtgtgtgtgtaaatcatgtcactgccctctttgtagctaatgacaaaattccaagagtcaccattagcctagcacattatgcctgtctcatttctgcccactttggagcactcggcttctctgctgttttcctccagagcacactgaaacactgccatagcacagcagggcatagaagacaggctcatgctcccctggacgctcaggccttcacctcgggcacactaggtcttgtcattccatgtcaagaatagctcttcactgccctcacccacccaagaatggctaaaattaaaaggactgacaatacctagtttgtcgaggatgtcacagctggaaccctcatacatggctcatgaaattgataaaaccacattggcaaactggtagtatttacaaaacctaaacatatgaatacctgatgaccaactaattcctcaactcacccaagagaaatgagagcttatgtgtaccagaagacatgaacaaaactacccacagcagctttcttcctgatggccccaaactggaaatgatccagatgtccatccataggaaaaaaagattttaaaaagaaagtatggcatgttcacagagaggaaattctgtacaacaatggaaatgggcacacaaccacaacccacaacaatgtggatgaagtgtacaatgaagtcagaccccagaatgtacagacaattccatgtgtgtgatgttcaaaaccaggaaagcaaatccatcatgacacaggctggggatgtgaaggaaactccagccaccctgcccctgtgctctgagtaacaaggcctagatcccaatccttgctctgcctcttatcagagacaggtatcagacaagttgcctaacttttctgagcttcagttttatgtctaaaataatgataaccatagaaccaatcccaaggaagtttcagaagatcaaatatgaaagagcatgaaaggtgctcaaaaaccagggactgtcatggtagctcacatctgtaatcccagcactttgggaggccaaggtgggaagatctcttgagcccaggagtttgagaccagccttggcaacgtagtgagacctcatctctgcaaaaaatttaaaaattaggcatggtggcacatgcctgtggtcccagctacttgggagtttgaggtgggaggatcacttaagcccagggggttgaggatgtaatgagccatgattccatccagcccgggtgacagggccagaccctgtctcaaggaaaaaaaaaaaaaaagccagacagagtccagcacacgtcagtttgtgacgtgagtgtgcttcaggctggaagtttggccactaccactgcctgttttaggcttttgtttccaaagcccccaagtagagggaaagaggagcagaatgagatctttgtgaacccaaggtaatgggtacccaagccaaacccacagaacctccttgatcccagggagagagttgcaggttcctcccagatcacacctccccaggcagcctatacccagacagaagcagggttcctgggcacagttgtgtggtttcttcactaatcaagggtcccttgccaagaacacaagtgaggcttgcatttatcctgtgctcagctaaccaagtcatgcaccccagcctgggccttagcctgctccaaagcagcgccatatgtgaacttacacaggagcaccctgggctagtggtggccctgcagagaggcctgacacctgagcagcagaagctaccaccagaccagaggggaccatcaacctggctagacagggcagagaagcagtgggccactgaggcaaacagcctcactttcacctgctaatggctccttccaactgcgagagttgcttgacccatgtgtggggacagccatcagcagtgacagggtggggtgaatgttccagccactccactctgcagtcaggacaacttcaggacatgttctgcactggctcctggcatcccccgcaggatggctccagccgcctgtgtcctgaccttcttggtcatgcctgtagttccgcctcctgttgttcgaggccatcctgactaacacggtgaaaccccgtctctactgaaaatacaaaaaattagccgggcatggtggtgcatgcctgtagtcccagctactggggaggctgaggcaggagaatcacttgaacccgggaggcagaggttgcagtgggctgagatcaggccactgcattccagcctgggcaacagagcgagaccccgtctcaaaaaaagaacactgagtacaccgtaagggatggcgaggatgtggcacagggggactccttcatccgctctggaaaatgtggcagtttctcctctgatgcaacatgtgcttaacatgtgacacagcagtcccacttttaggtatttaaaggaatgaaaacttatgtccacacaaaaaatcacacagatgtttatagtgattttattgataaagtgtccaactggaaactgcaagtattctttctggggacacagatacattgtggtgcctccaccctgtgaatcctgctcagcaatccgagggatgagcggttgattcaggcaacaccgcggatggatctcagggcatcgtgctgaagtcccacattctagcaaggtgctgcttcctgcagatgggcaaacactggtccttggcaggtagggggaaacacatcttgcctttttttggagacagggtgtcccactgtcacccaggctggagtgcaggggtgtgatagtggctcactgcagcctcaacctcctgggctcaagcaatcctcctgcctcctcctgagtagctggaactgtcttcctctcttgaagtaggaagcacaggtatacacacagtacacaaacagtatgtctgtggtggtagaatttcacgagggtattggaaaaacgtctgatgaggctccttggaggagcaataattgtgcattattagaggagcaataatgcacaaaggctgagccgcaccctgccaaaggagaaaggcagacagactccctgctgggagagcccactccccagacgttctggttgaggctgaactacggggtggagagcagatcaggggcgccaggggctggagatctggggaggcagagactgcagcgtcagcatgaagggattttgatgggggctggagcactccatgtcctgatggtgcttatttacaaccatctgtcatctcagaactgcacacacggtaaaatttcactataaatagcttacacctcaaaaacctaaccaaaccctttttattttttttaatttcttttttttcggggcggggggtgggggaatggaatctctcattatcgcccagaccggagtgcagtggtgcgatctctactcactgcaacctctgcttcccggattcaagtgatcctcctgcctcagcctcccacgtagctgggataacaggcaccccccatcaccaccaccaccacacccagctatttatctttttgagacaacgtctcattttgtcgcgcaggctggagtgcagtggcacaatctcggctgactgcaacctctgcctctcaggtttaagcaattctcccacctcagtctcccgagtagctgggattacaggcgtgcaccaccacactcggctaatttttgtattttttggtagagacagagcttcaccatgttggccaggctggtcttaaactcctgacctcaagtgatccccctgcctcggcctcccaaaatgctgggattacaggggtgaggcactgctccagcccaaatgctttttaaaaggaaggaaaaagaaggacagctcaaccctttctcactaaagggcaaaggactgctagctgggcatgtaaaagtgtgcattttcctgaagtgtgttctctggaatcctcttccccagagatgttgaaacggaggtgctttgtttagtgcagtggcggcagatgacagccacaggacagctgctctgggggccttggaaactacaaatgctcaaaccccctccccaggccacatctcagcgtgcgggaactggggtgtgcatctctcccaacagcttcctggtgacgccaagcttcacacccacccaatccatgggagcaaaccgactggactgcatggcagacggtggcccactggccattgcctctttgctttgctcaggaactgggtggaatgtgcccggggaaggtagccccagaactgcaggggagccacgacagactcaagcctcacggaaacccctttccctgggccagagttggttcctgggtggcgtggggctggctctggccagtgaggagtcagcccctgctgaggtttctgggaattatgtgtctcccaggaggagaggaagacagctgaggacacagcatctcactagcccctcctcacccaccaggtgccaggccaggtgtcacctgagccaagcagcacacgaccgcccctgcccacttccacctcagccctgaccctccctgcacctgggagtccaccgcctcctgatgtgtctgtgatcggggcagccccaagagcacgtatcccgggacatgatgtgttgtggtctgtgtggggtcagagccgtcagtgttcactgccgcgtgcccagtgcttagcactgtttgccgcatgggagatgcaggtcacaacccggtagcgcctagtggcccgggggacacctggcttgtctgggcctgttggctgacaggtaggagggactgccatccattgttggggcaaaggatgctgctcaacctcccacaacgcatggagcggcccggcgcacgactcacccggccccaaacaccaactgtgccgaggtgatgccctgccctgaggcgagcgtacaaggcttgagcgtcgagaacactgcaagggtctcagccagtgaggggctgcctgggccccgccgcaggcctgactcctagagccaagccgttttctcccttcaggcagtgggtagggctctcacatgacgaccctgggtttgcagctcggctgtgcacacaggtggaccctccgtgctttgtcagttcctactgcttggccctggggccggaagctgcttctcaggcctcactctgagaagcatcttcacaacctgggtaggtccattgcctctttccaccgactctgctccttgacaagggcatgttcatcagcagagccaggcagggagagctcaggacagccagacctggggccagtggcataggtacgtgtgggaaggggcaccaggtgcctgtcctccctgcgggcagagccgtctgtcctctgcagacctgcagtttctgtaaacatcctgtaaggagccaggaagcagcaactccagatgcccagaggagccccagccaaggcagatgcagccagggcatcaggccgtggggctgggcaaggtgagccacaggctggaaaggcaggggcgcacggcagatggggatgcggaagccagatgctgacccagctctacccacatttgtgaggggcatgggggctgcgccgtcagaggccttagctggctccgggcttgaaatgtgagtcccaagagcccaagttttattcccacgtggccgcagcatgccaggcttagcctccctgtgtttctgtaaaacagcaccctcgtgtttttatatgagaaccgaattcaaggtactagaagtcctcatatgggaagggaaaagtcgtggttttataagcaatacactctggctgagcccaagttaagatttccagtccaagttcatcagcgcctagcttcagccgggactgctctggccccactgctgtgtgagctggcgcttctgattccaccccacactcggtgaaagggtcccagagcaactgacactgagcgtcaccggcggcggctcttcctagaggagcatgttcaggagaggtgaggctgcggggctggggccctgggctaatactccctggctgtgtgaccctgggcaaattactcagcctctctgagctgctgcttcctctcctgtggagtgggctgatcccagccacaccagcactcctggttgttccgtggttaatgtctgccaaacacggtgccatggagaacacccagcagagcccagctgcttgtttgctggggagggacagcgctgcaggggcgcctccccctggccctccagcacctttccaccttgcttccaggacctccgcggctcagaggcagtgcaggtgggcttcagggacggcagggagggcccacgccggcacacaaggaagaagggaaggcgccagggatcgcacccctcaggaagaagagggacggaggcaaagataggaaggacacgcattgtgccttctgtcacttggggattttcaagtcaaaatggggagggggccggggtaggtttggaaactatccaaatggcattttgtttcacattgctggctgggggcaagccctctgcagtgaccctacatgcccactagaggtcacaccacaaaaggggacctcccctaaggaggggggacaaacggaggaccctgggcaccgtgcctcctgcaaggggaggaaggatgaagccccgccatccatcgggtggggaaagcgccatgcctccggcagcacagccaagcggcccccacagggaggagtgagctccatatgggcccaggtgacccggccacaacaccctctcggcctccgcctcacctgctggtgttgggcatggccagcctgggcagccaccagccctcgctgcccatctgctgtcccctcaaccccagcagcagacagaaaagtgcagggtctgagcccccggggggatgctggtgtcggacagatccctggagaacaaagcctgtgcccttgtgtctaggtgaggctgcggcacccaggcccggagcaggtccccccagctgggccatccccactcttggagcaagaggggaactgcagcaggaagcagccttc

SEQ ID NO: 5575 - DNA, 493 bp, Homo sapiens
ggagccagtcaagttctgtccttccttcccctcccacatactttgtcaagtcccaggacctactgatatgggctcagcaatgacaaatgccagagtgctcagaggacacacccatcccttttcagggtgtgaacccagactggaaaggagaaccaaaggatgggaaaggcaggcccgggacggcttgctgctgctcctgctttcacaggaatcctggtcatgccaggaacactgccgcccacttggggtgggactatgtggaagtctagctagtgctcggcaccccttaacccaatggtgagaaacaggacaaacatgctgggggttcagagggtggaccgcagggatggcccccaaacaggtcccagtgaggtaatgcaaggcctcctctcgggggctgatgaggtcttctaggccacagactaaacgcactgcccagcctttagtttggagtgtgacttgcactgactgaaataaatctgacctgtcaccc

SEQ ID NO: 5576 - DNA, 1408 bp, Homo sapiens
gcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcag

SEQ ID NO: 5577 - DNA, 6503 bp, Homo sapiens
gctttcctcaggctctaaggcccgcggtgtggagcgcggcgtaggcagcggggagtgggcggcgcggggtgggtggagtgggtcggcggcggggatcctgccgagcccgcagctgccctcttttagcgccgtgtctcctccccggccctggctcgtcccacctcagccacagcccggccccctggccggccgaggtctcgccgccggcgccctggggacctcgtgggtgtggccggcggcgacctcggcaggcgacagcccagcagacgggcaccaggtggacgtgccagtctccagacccccgtcccggtgcagggaaggtgggcgtttggacccctgaggcagaaacaggtgcggccccgccggcgcatcccccggaagggacgctgacttcgttcccctggagcctgcgtcggggcccgcgctgggctgagaattacgggaacgccgtgagagtttgcattccgaggatttggtctgagaacctcaccagcgaaatagagaactgcccccgggagagccggcccacgtgccgcccaccggcgccttgacggcagggagaggtcgagcttccagggagcgggcgcccggcgcggggctcccagcctgtctgtacctggtcgagacaccccgtgccagaggcggaacatgtatgaaatgccaggtgcccagaggacccaggcagtccgtcattcacataccaacccacgtgcaggcttcaattcaaccttgaagccatttgggcctgggcttttttgatgacttatttgattcatagttttttggttactaattgagtctcttcacttgttataggtctgttgagattgtctattttttcttgagtcagccgtctgaaaagaacacgaggtggacagggcagagcggtcaaggaaagccataggaggagggcacttatttgagcaaagaccggcgggacgtgggcgtcgagggtaaggatatctgcagaagtactgtcttgagcaaggagcacggcagacagagcctctgagacacgagagcctggagtgtaagaaacacagtagaggccactaagtcgagaacgcaggagctggaaggactggtaggaaatgggaggtggggacatggagggatgcagacaggtcctgcacagtcagaactgtggccccttctctgcaggaaatgggcagccttcggaagactgagcacacggaaggatatgactaaccctttaaaagggtcattctgactcctgggtgaagaacagactaggaagggctgaggaggaggcaggaggccatctactgttatatgggatgtggagtgtgacccggaaaggtcaagtgtgactctaagggctttttgtgtactgatcttttatcctgcaaccttgctaaacccatttattagttcttcttgtcttttagtggcatttattagttgttctagtgttttagtggattccttgggattttatacaaaagcgtgtcatttgtgaatagagatcagtttatctcttcctttctaatctggatgccttttatttcttctccttgcctagctgccctatctagaagctccagtacaatattgactagaagcagcaagagtggacatccttgtcttgctcctgatttcagggaggaggcatccagtctttcacctttgggtatgatgatagctgtgggtgcttaaaaaataggttttatcaggctgggcacagtggctcacgcctgtaatcccaaccctttgggaggtcgaggcgggcggatcacgtggggtccagagtttgagaccagcctggccaacatggagaaatcccatctctactaaaaatacaaaaagttagctgaggttggtggccggtgcctgtaatcccagctaaaaaagggaaactgtctaaaaatcattaaaaaaaagggtacttcctcaacctgataaaacctattttttgtttgtttgagatagtgtctcactctgtcacccaggctggagtacagtggctggatcttggctcactgcaacctctgcctcccaggttcaagcgattttcctgcctcagcctcctgagtagctgggattgcaggcacaggccgccacgcccagctagttttgtatttttagtagagatggggttttaccatgttggccaggctggtcttgaactcctgacctccagtaatccacccccctgggcctcccaaaatgctgggattataggcgtgagctaccacgcccagccgaggaagtatcttctatttctagtttgttgagtgtgtttatcatgaaaacgtgtcagatttggttaaatgatttttccacatccattgagatgatgatcatgggtttttttccttgttctagtaatgtggtgtgttacattaattgactttcagatattgaaaagacacttatcccctgcgttcagataaattccagttggtcatggagtatctgtcttcctggattcagtttaatacaattttgttgagtgattttttttatccatattcatcatagatactggtctgaagttttcttgtggtgtctgtgtctggttttggtatcggtatcagtgtcctactgggcctcataaaatgagttggaagtgttcctctttttttttttttttttttttttaagatggctgttcactgtatcatccaggctggtcaccaattcctggcttcaactgatcctcccacctcaagcctcctgagtagctgggatcacaggcacaagccactggacccagctttaattgtttaagtgtttcatagaattcattattgaagccatttgggtctgggcttttttgattacttattttgattattaattcaatctctatttgttgtaggtctattcagatcatctgtttgtgtctttagaggaatttgtccgttttatttaagttacagtgttttgggcgtaagcaattttaaggagaaagttatccttaaccaagatgggaaaggtcgaggcagggtggtacagggattttacctcccaccaggtatctcccacaaactccccctaatataataccggcggagtttgggctgtggctttggctgtgttgagtctcagatgcctgttgggcctcctcatggaaacgctggtgggcgattggatgagcaagtcaccggcgtggcccaggttggagactgggaattgtcaccacagagagagcctttagagctgtgagacaggaggaggcgccaaggagccattgctcaggtggaggggaagtcgaggcatggtgcttgggcctaggggcagcacttgggagtagtcagcctgaaaggtgagaagccaggagaggggtccccagcttatggcctgggagctaactcagatttggcgagtgcaggttttgtggaatggtggtgtattagtccgttttcacggtgctaataaagacacacccgacactgggcaatttacaaaagacagaggtttagtgacttacagttccacatggctggggaggcctcacaatcatggtggaaggcaaggaggagcaagtcacatcttacgtggatggcggcaggcaaagagcgagattgggcagggaaactccccctaatatgatactgtcagatctcgtgagacttactcactatcacgagaacagcatgggaaagacctgccccatgattcaattacctcccaccgggtccctcccacagcatgtgcaaattcaagatgagatatgggtggggacaaaagacaggcaggagttccgaggatgagtatttgcattctgtccctgagtttgctgtaaaggagagcagcgagacagaggcatggggtgcggaatggcgtgtttaagatggagtgatgacaggtgcccgttggagtgatgcagtagacaggatctgatgatggggagcaggtgtcgtgtgcccttgagcaggagcccagcagagagaccctttttcctcctgtagcagcagaagagaaggcagcagggtgcaggactgaaggagggctgggctgggctgggatgggagcctggctggttttcccctggtggccctatgactggttaagggcagggcagaggcacggcaggttggaggcacagaaggcccaagatagttatctgggctggatgtggggcggtattctcgcctctctggggacatcccttaagtggacaggaagactgggtggttcaggtgtatgtccactcaccaagaacacaggatgaaggtggggcctagacagtggctgttttgaccagggcagaacagttgagggcatgtgagagggcccatgctgacgccagacctcagtggggagaggggagagtccagggaccagaggtccccctaggcttaaaggacaaaccacaaggagaagaggaagaagtctctatgtcattaaagtttcattatcagggctgctataatgcttctcattgcttattataaaacccaattctgcaagaccagcctagccaacatggtgaaactctgtctactaaaaatacaaaaattagctgggcgtggtggcatgtgcctgtaatctcagctactcaggaggctgaggcaggagaattgcttaaacctgggaggcagaggttgcagtgagccaagatcgtgccactgtactccagcctgggagacagagggagactccatctcaaaaacgaaacaaaacaaaaaaaaaaactaattctggcccagcgtggtagttcacacctgtaatctcagcactttgggaggccaaggcagaaggatcgcttgagcgcaggagttcaagaccattctgggcaacaaaataagaccccacctctacaaaaaataaaaaaaatagaaggaagcaatagtgtgcacctggggtcccagctactcaggaggctgaggtaggaggatcacttgagcccagaaggtcgaggctacagtgagccgggattgtgccactgtacttcagcctgggtgacaaaacaagaccctctgactcaaaaaaaagaaaaagagaaaaatatttttgttagagcaaaacaggctgacctttttttcgggttttttttggtttgtttttgtttttttgagatggagtctcgctctgtcgcccaggctggagtgcagtggcacgatttcggctcactgcaagctctgcctcccgagttcacgccattctcctgcctcagcctcccaagtagctgggactacaggcgcccaccaccacgcccggctaattttttgtatttttagtagagacggggtttcaccgtgttagcaggatggtctcgatctcctgacctcgtgatccacccgtcttggcctcccaaagtgctaggattacaggcatgagccactgcgcccagccctttttttcgtttttaatgttgagactaggttacagcattattagatacaatgaaggtagagggaaggtgctcagaactctcctacaagcatagcagctgctcaggcacagctccagtgactccagggcccagccttctggggaggagttggatgggcatattccttgaggggctcccacctgcccacagagagcacaagaggagaactcatcctgtttgccctgcttttcccatcttgttcctagacatcctgaggttcccaccaagtggacattggcttattctacaagcaacaggatgaggcccctggactcctcactagcaaaatagtgcagtgacagcaacacccccccccacacacacacacacaaagatgtccacatcttaattcctggaacctgtgaatgtgtgaccttacctggtgtcttagttcatttgtgccactgtaacaaaataccacagactgggtaatttataaacaatataaatttgtttctcatggttctgaaggctgggaagtccaagatcaaggcactggcatgtcctgtgtctggtgagagcacttcgttactgtttcctctggagggaagaatgctgtgtcctcacaaggtgggatggacagaggggcaagaaaaggccaaactccacaggaagcctcttttataagaggagccctcgtgacctagtccgaaatggccccacctcttctttcaccacaatggggaccaagtttgttgttagttaacctaaatgacagaggagctctctaaagagatatttattcaggaatagggccttgcaacgggaacacgtatattacggtaactgcatgttcaaggaagacaaaagttttaaaggaagaaaggaagattacataatcattttgaaatgatactcttgactgcaaagattaatagcaagggagacaccggtccaagtttggaaggtagctgctgggcaggtatccttgcagaagtattttcttgtgtaagatttcagcggccttggccaggtgtggtggctcacgcctataatcctagtagtttgggaggctgaggtgggttaatcacttgaagtcaggagttcaagaccagcctggctaacatagtgaaactctgtcttcactaaaaatacaaaaattagccgggcatggtgatgcatacctctaatcccagctact

SEQ ID NO: 5578 - DNA, 704 bp, Homo sapiens
gattgtcttgcatggatacatttgagcctgcatgttgcgatctgtatccaatgattgtaacttctgtattgtatccttcaatgagaaaggacagctctggtgtgaggagtccctctcccttctcctaaactcttctacaaaacaggggtttccaacttccgggataaggacctgtaccaactcatggcctgttaggaaatgggccacacagcagaagctctccaggaacacatctttgaagacaaaatgcctccaagatccccagtactgtagctcttctcctgaaggtaagcacctctccactttctcctgaatcttgagagcttgctttgacctagggtatctgtggaatgaaacaatgactgctaaagcttttacctgtagctcaaggcagagaggccttagacaaaccactcagtgggatccaaggcatgatgatagaagaggtggccatattaccacctgccagaagcaatctgggccttttggctaagataaagtatagcagcttagtggcctagaatctcccactccatcccatgagttattcacccaggtaagacaataaggttgacagaatccttaaggttcatccttttggcctcctttgttttgcattatttcattggccaagcccatcacctggagctttgtagtggctccacagttgtttgtttaatggatacataagtgcatgaacaagt

SEQ ID NO: 5579 - DNA, 757 bp, Homo sapiens
gttgctgctgcgacgccgaggacgagccggcggtcaggccgtccagcaccttcctgatgttgaatttcctcatggtctcggaggggctcccccgcagcccgggaggggaggcacagggggtccccgggcgggggagaccacccggggccgaaggcagcttcgaccgcggaaacggaggagtgggagtgtgaggagaaatatgcaatgatgacatttccaagaagtgatggcatctggcgctaaggacaaagaatgggattttgccacagggatcttattctcccacatgttctgtctgaaggagaaagttatctgaggccttatatgatgcaaaactttggactcaaagaaattaaatcacttgcccaaggttacatagctggtgaaatgttggtgccaaatgaacttttctggttcttctgaatatgccactgttgctggagaaatgtcactgctagagaacagaagactattattccaaagggtatttgagactgactgaatcaggtctggaacattattgaaatgagacccacaaaagaagagatactgagaggatgaagagatcctcctagcttggcggaatactctgctctgatggaagtaccatcctggtccaaacatgaaagaattcccaacatcaagattgattgaaacatattcaatgggtatgtgtgatcttcacatatgtatctattggaagtataacaaaattcttccatttgtgtggtggtgaatgtaaaatttgtatagcggt

SEQ ID NO: 5580 - DNA, 4123 bp, Homo sapiens
ttcaaatcgggggcattggggctgagcccgaagcaggagggcagcaagggtcctgacattgtggacttggccagggaggggccagtccctctcagccacccacagctacctgtcccgagagtgtgaggattcgggtctttggtgggctctggggaaggggctgcaaggaagcgggcccagaacctggtgctgaggcccaggacccatgcagggacgtggggcaggacagagaggggcagggcaggggcagggacaggggcagggatgcgggataggacaggggtacggacagggatggggcagggacgcagggcaggacaggggcagggacggggcgggacacgggacaggacaggcgcaggggcagggcagggatgcagggcaggacagggatgagggcagggacgtggggcagggacagggacgtggggcagggacagggacatggggcaagacagggacggggcagggacgtggggcagggcagggagaggggcagggacgtggggcaggacagagaggggcagggcaggggcagggacaggggcagggacacggacagggcagggatgcggggcaagacagggagggggcagggatacgaggcaggacaaggagggggcagggactcagggcaggacagggcaggggcagaggcaggacagggacggtgcagcctccgctgctgccctctcggggagcctggctcccaccctcacccagccactgctcctgggcacagagctgaaggggaactggaggctgcggcgttcctctctccgttcccctctctctggtgactcgtgataacgaaccgaccttttggagacattctgtgccctcaacaaaagcggcccctgtctggaaacccccccgagggagactgacttcctcccctgctgcctgggctgcggtagctcttccggcacctgctcttcaggcacctgccctgtgctggcccctcctgcaacaatcgggtaaggggacccaggaccacagggaggctccagggagccccgtgggtgcctccagcagccgtcgggggtctctgtccctcacacctcatctgtgagggtcccttggcaaggcagcccctcccgcttgcccagggtggcaggccggctgcccgcatgcagaggctgctgggagggtcccctcatgctctcccctccccgtcccctgcctacccagccagggctctcgctcccagcagccaacggtacagcccgcctcggtctctggggtgctagatacactctgcctggagcccaggtactggaacctctgtgcctgggccatggggggcaggttaagggaggccctgcccctggagcgcaggtactggaacctctgtgccagggccatagggggtgggttaagggaggccctgccctgcccctcacctgtcccctcatctgcacatccctccttcgtgtcacctgcacaggagccctcacctcagtcggcgctgcagaaccagcccaggagagcagctggcctgtcatctgctgaggagcggaggcgtgcggggatccggaggggaagggggtctggagtgctccgggggagaccctcagggactgccctgctgctggcagcgcctgggcccacggctgatggaggcgtctcctggcccccagggctgtgcccaggactgcaatggcctcccacactacctcactaccctggtccaggctcactgacagatgaggaaactgaggcaggggccccggtctcacggccattggtgcagagctgggatccacgaccagattctaccaattaaaaaaaggaaatgtgggccgggcgtggtggctcatgcctgtgatcccagcactttgggaggccgaggcaggtggatcacccaaggtcaggagttcaagagcagcctggccaacagggtgaaatcccatctctcctaaaaaaacaaaacaaaacaaaacaaaacaaaacaaaaacagaattagccgggcatggtggtgggcacctgtagtcccagctactggggaggctgaggcagaagaatcacataaacccaggaggccggaggttccaacgaactaggatcgcaccactgcactccagcctgggcaacaaagtgagactctgtctcaaaaaaaaaaaaaaaaagaaaaaaaaaggaaaagagaaagaaaaagaaaaaaagtgacaattcacatagacccctgaaaacctctgggcttagggacagcaagagccttcctggggcctcctggaccatgtcagggcctccgaggcctctgggacgccatccctgctcagcttcctcactctccttttgcccgagaacaagctctgttctggccacggcgttgtctacacaacacagctaactgctttgccatcagccctcatacagatttaaaacacacacacacacacacacaaaagataaggttatgggctgcactgcgtcccccaaattcacagagtgaagtcccgacttcaggatccgcctgtattcagacacagggtctttacagaggcgacaaaggtgaaacaaggttaccagggtgggctctgacctgacctaccggcgtccttaaaagaggaggacacagacacgcaggaggggcggccacgcaaggacacagggaggtggtgccgcctgcctgcaaggagaggcctcgtaacagccacgccgcacctcaacccgggacgcccccaggactggagagaacccacatctgctgtgggagcacctggccacggtgtgtgcgaggcggccccggcaaactcacgtagacaggacccagctcccccaggccatctttcaatgggagagggtgacccagtgttttcccaaaacccagcacggtccccaggacgcgttccccaccagggtgggctgggccggatcacagcccaggctcccagagacttccggtgccacatcagctcacagagcttcctgtttcagcccagatcagaaacaccatgagacgcccaaggaggaatattttaatacttctgctattggcctcacccaaaaccagaaagtgcagggagtcgtgaaaatgaagaaaatgatcagaacctgagggaccaggccgtgccatccgaagacaatcctgagatctctctccgggccctgccctgcccctccctctctgcccccagcaggagcccccttttcccctggggccaagaacccaggccacacagggtgcagaagacccgccagggaggccacagcaggggacagaaaagaaggcccgtcgctggcatgaggggtggcttccatgtggggaaactgagtcagtagcaattccagattggaggtcctaaccaggtcaggtatgcgggcaccgcaccgtcagccaagaccacagccccacctcctcaacagctgggcccacgccatcgggggggcgttccaagagacttaaaaaaaccataacccaaccccgaggaggtgccctctgaggtggggtgtcccatactagagtcagggtgacctgaggacaggccaggcacacagggccaccctgagtaaagacgggggacccaggagggcctgggactagccaggatggtggctgctgtgttgagagggcatctgggaccccaacccgcagcccctcgtctccttatgagccatggggcctcaggaaatgcaccccatttcgtgcctcagtttccctcctgggctgaactgtgtcccccacagccatgtgttgaggtcctgaccccagacctgtgagtgtgaccttatttggaggcagggtctgcacagaggtaacgaggttaaagcaaggtcagctgggtgggccctgacccacccagacacacagagagagaacaggccacatgacacggggccgaggccgtggcagtgcttccgccagccaagaagcacggaagacctcaggccacaaagccaggagcggcctgggacagaccccactcacggcctcgggggccagccctgctcacaccttgaccttggacttctggcaccataactgtgggagggtgaatctctggtggtttgggggcgtggggtgaatctctgctggtttgggggcgtggggtgaatctctgctggtttgggggcgtggggtgaatctctgctggtttgggggcgtggggtgaatctctg

SEQ ID NO: 5581 - DNA, 600 bp, Homo sapiens
gaaatgtgtcggtgacattgaatggggagaccgagcgcgagcgaggcgcgcgcgcgcacacgcgcactcacggccccgctcgctccgagatccccggccacgacgagatccagttctccagcgggaaaggggcaaaggaacgccgcgcgttggaagggccagggacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttggcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagg

SEQ ID NO: 5582 - DNA, 3533 bp, Homo sapiens
aatatccagtcagtgtaaactcgtttataatttggtcctttgatttcaaggagctatgatgcagttcgttgtggggatgtgttgtctccatgtcatacatgtgactttgtccatgtttgcacccagttcaaggaagacacaaccctagggaaagacaaccctccccgccaagcctctcttcccattcttaaacatagggtggcgttattcaggttggaccagtttaaaaagactaacgcatttgtcctcgttgttgggtgttttttttctttaaatttgtaaaacaggaataattgtgttaggatgaagtatgatactaggagaacagggaaaactaacccatcgtgttaaaagtcagaatagtgcttaactctggcaggaggtgagatggttagtaattcagaagggggtgccaggagagcttccagagccattgaaatgttcagtagcttgatctgggtgatgatttacatacataaaaacatattaaactttgaacttaagatttatgccttttactgtttgcaccctataactccaaaagaaaagtagaggggaaaaagagtccctgcaaaaggcagtcttgaaagaaagcaagtctgtgatgtggagaatgcattggacagctctcagcaatttgctgtagcttgggcagagagataaaagctaatgccagcatcaggttgcccaggcgagagaaggcctgaaagaagacagcgtggagaaagtgtcagcaagcttcagcaacagcaggaggcagatggtaggagagtgggcctcaggtgtggtgtggcagagcagagtagccacacttaggccccagagacagtgtcttctcaccctcagttgaaggggcaggaaatcaatcgctctagtcacccctaagctggaggacggacctaaagttgccacagctttgagaggcaaagaagtttgctcagtggcttttagagacttctagggccctgggaccctgacactgaggaggagcaaactgaaggggagagtgggcacattccttgttggctgctgtggtgagcagcagctggtcgttgtcagtcaagctccggaccactctgatgatgctcactgcattttgatggagtaagccagggacattaccactgtgtttgagccatctgaagtattcctgggtgggtctgcagttggcagcccgtgatcctttttccattcaaggatgatgcaaaggtaaggggccaaggctgagctctgtagatgcctgtgagagcctcctggtctcaagaggtcataccaagggccttggccaccaaggtttcgtgaggaccttgaggtggtttcgccatcacaatgtcagacgtgtcacacaccatctggtatgtcctcactgtatagaggaagaagggcccaagtggtgaattatctacaagtttgtagcaaagctaatactcagactccctctacagccttgctactcagtgtagtctgtggtccggcagtgtcacaccactggggtacttagcagaaatgcagcttctcaggctccactccagctctcctcaatcacagtctgtttttttgtttgtttgtttgtttgttttgagatggagtttcgctcttgttgcctaggctggagagcagtggtgcgatcttggctcactgcaacctccacctccctggttcaagtgattctgctgcctcagcctcccaagtagctgggattacaggcgcccgccaccatgcccggtggcgtgcatggtaatttttgtatttttagtagaaacaggatctcgccatgttggccaggctggtcttgaactcctgacctcaggtgatccacccgccttggcctcccaaagtactggggattacagatgtgagccaccacgcctggcccacagtctgtattttaacaagatccccacctcagtcttaggcacatggattctcctcaacccccaataccacagagtctattaatttttacccaatagggaaggggaaaaagtcaagaaagaataatgaattaagtaatctttccccctccaggaagctctttatttaatttcgctcccatgaaacacaatttgaagagtctctcaaataaacaaattccattttctgataattatttaattgccccacttttgaaatttttgtcaaagacgactgtcactccctgtcagaacttctattcagcacagtataccaagcgtttctccatcgagttgttataatatgatcaaaaagcagggagagatgctgcttggttaccctgtggggccttatcggggctcagtgcagtctttccatgtaggcattctcaaatactcaattgaaacctgattgaggatcatttgatctctgttggccctagtgcagtaggctgctgagaaccactgatgcaatagactgagagactaactgcctgcttccctgtcagcccaggctctgctaaggccgtcttagttacagaagaaagtggggcagagagccctgcaaggattacattccattcctaacggagacaggcaagcgttcagtgcccgaagcagggcaggcctttgtatggctcacttttccctgtaccagcctcagccccgtacattcagaaagccctgtcgggaacgtgcgggatcacagcacaagacagtcattcactgattgattgacgacgtcaacattgcggaatacctatgttaagctgagtacgagggatataaaaagtaggccctggagagtgcctctgggatgcacataaccagacaagataaagaaaaggcagatcacgagatcaagagatcgagatcatcctggccaacatggtgaaaccccatctctactaaaattacaaaaatcagctagacgtggtggcgggcgcctgtagtcccagctactcaggaggctgaggcaggagaatcgcttgaacccgggaggcagagattgcactgagctgaggtcatgccactgcactccagcctggcaacagggcaagactccatctcaaaaaaaaaaaaaaagaaaaaaaagaaaaattagggcagcttttagacatgaggccccaaagtgccaactagtgcacctaaacttcaactctcttttgagtgttttatgtatctactcagcatccagttgtaaatatgcaaaaatcaatgcctactgtatttaaaaattactaaattcacaataaccacacagaatctataataaatagaatcaatgtaataatgactcagatccaggggaagaaaattataaaattttggaaaaaatgatgagctattaattaagaaaatagtttgttccttggtgagaagactcaatgtaaatatgtcagttttctcctgacttaagtcttcaacacaggcctaataatattgcagtggcaaatgattgccaggggcaggaggggatttggggaagtggtaaaaatgatctgtgtcttggtagtggtcgctgcacaactgcatacatctgtgaaaactcactgaactgcgcactttaaaagggtgaattgtaatatacatacctcaataaaccttacttaaaaatta

SEQ ID NO: 5583 - DNA, 1729 bp, Homo sapiens
gtcaaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtaaggcttcaccaggatccacctctgatgttcagtgaagaggaccggaaaagtctgctagagcagtaccatctgggtctggatcaaaaacgcagaaaatacgtggttggagagctcatctggaattttgccgatttcatgactaaccagtccaaggatgaaggaaaaactggacctcattatggatttacttttgggatacactcattattccagaggagggtaaaaggctgagaagcttaaggtatttcagtctgttttatgttactcatttgcgaaaagcaggctcatcgaatacaggtgagtttcaacgcgtcttgaatatggcagcatttaaaagtcttcagaccaggcatggtggctcatgcctgtcatcccagcactttgggaggccaaggtgggaggattgcttgaggccaggagttcgagaccagcctgttcagcatagcaggacccccatctctacaaaaactaaacagattagctaggtgtggtggtgtgtgcctgtagtcctagctgcttgggaggctgaggcaggcggatagcctgagcacaggagttggaggctgcagtaagccatgattacaccactgcacttgagcctgggcagcagagtgagacctgtctttaaaaaaaaaaaaggagctgggcacggtggctcatgcctgtaatcccagcactttgggaggccgaggcaggcagatcacgaggtcaggagatcgagaccatcctggctaacagtgaaaccctgtctctactgaaaatacaaaaaaaatcagccgggcgtggtggcgggtgcctgtagtcccagctgctcgggaggctgaggcaggagaatggcatgaacccaggagttggagcttgcagtgagccgagattgtgccactgcactccagcctgggcgacagtgagactgcttctc

SEQ ID NO: 5584 - DNA, 926 bp, Homo sapiens
cagcctgcaaggaggcgccaccggacctgcacactcaggagcagactcagctagattggaagagaggatgggaagacaatggatgacctacctgtggagagaaactacccattccagaacctcctctctgctgaaagctgaacactcaatgggaagacctgtttgcagagaggagccagccactccagggtctccgttctgctagaagctgaacactcgttgggacacccttgctgtggaaaggacatccttactgtggaaatgagctactaactgcaggtctccttcctcttcatcttccttatccttctgttccattgctcagtaatgctcctcttcatctgtctcattctccacttgtctgcttgatgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacag

SEQ ID NO: 5585 - DNA, 1309 bp, Homo sapiens
agaaacgaataaatctctgacccttctcaggtgcagccagagagacactagcccactgatggacggacagacgtgggcagggtccgtgtcactaaaccacccaccactgccacagctgcctacaacagacacatcagatgacactccgggcatataaatgattttcactgaggacttactggttttaataataggtcctggtgtagagaagtccctcaacctattgtgcaatgagttttgagaagcgggtaagctgtatgttttgtggttttgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcatggcttttaaggtaaattgtgccatgatccactgccattcgaattgctttaacaagtcattaccacactactgttacatcttaattatgcatacagacaggtagacttattttacatatgtgaactaactagttgtcaaagcaaatgcagattgtattctgcaagtaaagtctttttctctctgtaatttctagggatgttctttaagtgaaattcatattcaaactgaagattttagttacaagaactgagtgcagattaaagtcttttgtgattcaaacatagtcaagagtacaactgtgatatttcatggaagttatgcaataaaatgtctctaacctgtgaacaaatctatcaagcagacggcacagtactgaatttgaaaccagaaatactgggtttttatataaatgcttcatagatttgttttatgataaagggcacataactctcctaaacctcacaccacctcttgaataggtataataagtccacatcaatgctgatgccttagctattattaaactcttacagtatgatgtaaagtgaaagtacaatgtaagatcattcctaggccaactttgaccagttttatacagaaacatgtgccaacttttctgtttgcaaggataatatcaaagcaaacaccagaaagttatatctttgatgcattttttcaaaatcatacacataatacacaaaccaaagacaaatgatgaatattatgtcagaaaatataaagtcttctcctttcttcttttgccaagaaagtccaatattttcaccatttttatgcacacaatcaactttatttaagctggaagttaatgtctcattgttttcattgttctaaataaacaccttttcccttgagtattgctctaaaa

SEQ ID NO: 5586 - DNA, 2528 bp, Homo sapiens
tcgtccttcctaaaatatagttccagtcccctgaatactcatgagatgatagatttcatttcagtcttggaccgaataaatgaatttagaaaagtttgcaggattcaaaatcgatgatcaaaaatcagttgcattttctatacattaacaagaccaatctggaaagaaaattaagaaaataattctgttaacaatagcctcaagaaggattaaatacttaggaaaaaacttaacccaggagataaaagacttatacactgagaactacaaaacattgcaaaaagaaatcaaagaagatacaagtaaatggaaagacatcccatgctcatgggttgaaagacttaatattgtaaagttgtccataatacccaaagcaacctacagatacaatgcaaactctataaaaattccaatgacactttttgcataaacagaaaaataattataaaattctacaggatcttaaggggcccaaaagagccaaaacaatcttgaaaaagaacaaagtcagaggcatcacacttcttgatttcaaaacctactgcaaagaaacagtaattaagacagtgtggtatggcctaaagtaagatacataaaccaacggagtaaaatagagagcccagaaataaaccactgcatatatgaccaaatgattttcagcaagagtgccaagaccacacaacagagaaaagacagcctcttcaacaagtagtgttggaaaaataggatattcaaatgcaaaaagagtgaatttgggcccttgccttgtaccatacataaaaattaactcaaaatgaattaaagacctaaaaattagacttaaaactgttaaactcctagaaagaaacataggggtaaagcctcaggactttgaatttagcaatgatttcttaaatatgacaccaaaagcacagacaacgaaatcaaaaataaacaaatggaatgacacaaaaactttttcatgtcaaaggaaacaatcaacagagtgaaattgcaacctataaaatgggagaaaataattgcaaataatatatctgaaaaggggttaatatccaaaatatataagaaactttaacaacaacaaaaaaattgattctaaaataggcaaagaacttaaactgacatttctccaaagaagatatacaaatggcccataagcacttgaaaagatgataacattactaatcattagaagagtgcaaataaaaaccacaatgaaatatcacctcatactcatcaggatggtcaccatcaaaagagcgtaaaataccaagcattggtgaagatgtagagaagatggaacccttgtgtattattggtgggaatgtaaaatgatgcagccattacagaaaatagcatggaggttcctccaaaaattcaaaatagaattactatatgatccaacaatcccatttgtgggtatatatccaaaagaattcagaaaaggatcttgaagagatacttggacacccattccttgtggcattattctcaatagccaagagatagaagcagtccaaatgtccatcaacagatgaataagtaaggaaaatgtaaatatatacaatgggatattatgcagccttaaaaaaaaaaaagaaaatcttgtcacatgctacaataagaatgaaactcgaggacattacgttaagtgaaatagtcacaaaatgacaaacactgtatgattccattcatatgaagtatctaaagtggtcaaattcatagaaacagaaagtagaatggtaatttccagggtctgaggagaaggagaaatggggagttgtttcatgagtagagagtttcagtgtaacaagacgaaaaagttgtagcaatctgctgcacaacaatgtgagtatatttaacactactgaaccctacacttaaaaatggttgagatggtaaatttaatgttatgtgctttttaccataatttttaaaaatctaaaaccaagcccaaagaattacttaagcacatgcaatatagtatgaaaaaaattggaagagttcattgtgattttaagtcaaactttacatttctggaggtaataagacttgaggtgatcactaacatatctctaacaatctcaacgtggaatagggagtagtaaaagtaaacaatgaaataatgatcatgttatgttactggagtccctttttgccttggctgctgggaggcttagaaataattattagtactcgctttcaatgaatgtattagcctaggtttgggtggcatatttatttccctctccctgtaaaagcattcaaattattatctaattgcatatatctttccttataaacattatatcttttatggagacagtcagggtgtaaattatagataaattgagaaatatcaatggttgtggagcaagagagctggaatctgaacaaatgcttaatgaaacacagacctgactatatccaagtcctaaaatgcatgttttttgaagagggtttatgatgaagttgatgtaactgacccataaaagagagggttaacattctactaatacaatgacatc

SEQ ID NO: 5587 - DNA, 8902 bp, Homo sapiens
gagacacagcggagatagcgcgcctgctaaaggctgccgccgccaacaccttaggctggctgctctaagttgatctggtgccttggtcactcgtggcttctttcttctatgccagctctgtcttctctacacttcctctggaggagtaggccttgacacaattacaagaagtcagggaccctgaacagagggaccagctgaagtcacagcagaagaacataaattgtgaagatttcatggacatttattagttccccaaattaatacttttataatttcttatgcctgtctttactgcaatctctgaacataaattgtgaagatttcatggacatttatcacttccccaatcaatactcttataatttcctatgcctgtctttaatctcttaatcccatcatcttcctaaactgaggatgtatgtcgcctcaggaccctgtgatgattgcattatctgcacaagttgtttgtaaagcgtgtgtgtttgaacaatatgaaatctgggcaccttgaaaggaacaggataacagtgattttcagagaacaagggagataaccataaggtctgactgcctgcaggaccgggcagaacagagtcgtatttctcttcttacagaaagcgaataggagaaatattgcgaattcttttctcagcaaggaatagccctgggaaaggaaagcattcccagggggaggtctctaaaatggctgctctgggagtgtctgtcttatgtggttgaagataagggatgaaatacaccctggtctcctgcagcgccctcaggcttgctaggattaggaaattccagcctggcgaattctaatcagaccagttgtctgctctcgaaccctatttcctgctaagatgtttatcaagacaatgcgtgcccagtgggacatggaacctcatcagtaattctaatttcaccctggccctgtgatctcgctctgcccttctgcgcttgtaatcttttattgcctcttgaagcatgtgatctgtgtgatttactccctgttcatacccccttccccttttcaaatccctaataaaaacttgttggttttgcggctcaaggggcatcacggaacctgccgacatgtgatgtcacccctggaggcccagatgtagaatttctctctttgtactctttctctttatttctcagactggccgacacttagggaaaatagaaaagaacctacattgaaatattgggggctggttcccccaatactttggttttgtttttctttttgttttattttctgtatgcgaaagcttcaagtattgatccaacatgttttctaatataagcatttagtgctataaatttccctcacagctcttgggtattggtataccacacatttttatatgctgtattttcatttgattctgggtagatacttttgttattctttgtttgtttgtttctatttcccatgagatgagacttcttctttgacccatggattatttagaagggagttgtttagtttctaagtgtttggaaattttcctgttacctttttcctgttgatttctaatttgattctattttggttagaaagcatattctgtatgatttcagtttttttaatgtcacaggacataattccaaaagtccctgtggacctttctcttctgtttttgtctcccttctctctgttggtcagggtagtttctctttccaggttcactggttctctcctctctcctttccactctgttgtagagcctgtctactgagctatttatttcaattctttcattttgtttgaaattttatttgagatggaatctgactctgtcacccaggctggagtgcagtggcatgatctctgctcactgcagcctccacctcccaggctcaagtgattctcctgcctcagcctcctgagtagctgggattgtaggtgcctaccaccacacctggctaatttttatatttttagtagagacaaggcttcattatgttggctaggctggtctcaaactcctgacctcaggtgatctgcccaccttggcctctcaaattgctgggattacaggcgcaattattccatgtttttattcttttcttttcttttttttttttttttagacagagtctcgcactgtcacccaggctggaatgcagtggcgcggtctcggctcactgcaagctctgcctcccgggttcacaccattctcctgcctcagcctcctgagcagccaggactacaggcactggccaccacgcccggctaatttttttgtatttttagtagagacagggtttcactgtattagccagaatggtctcgatctcctgaacttgtgatccccccgcctcggcctctgaaagtactgggattacaggcatgagccactgtgcccggcctcatgtttttattcttaaaatttttatttgatttttctgtgtgtcttctattttacttctatttttctaccttttcttttgattcaagcatttatgtaattgctcactggggccttttcatgggatgtgctttaaaaatctctttttagagagccctgggtggtggggtgagcatggaagtctgcctccctgccccctccttagctgaaggtggtggggatggagccacatttttttcctgtggtgttttcctagagttgggtggttactgtctaaaagttttctggcttgttaggctgatcctttagtggggcttttttttttttcctctatttccattaccatttccaggttgattcttcttcagctccaactatagaatacatgagatgacaaaaccacccaagtcccaggggccttagccagcctgcttttctctacctttcatattcatcttatgtttgttttaaatataacttccagcattgttatctacacttaataggagaagcagagaaaggtgtttactccattttgtctggaagtggaagtccattgtttttattttttaaagtattttattttacttagcaatcagcagtacatagtagtttgacaaagcagaaagtgcatgcatttccctttcagtgttaactgtgaacacctggctgtctctcttcatgaatatttatggagataagtgttgggcattgtagtaaggcgaaaagagagatgaaaagatgaatggatgaagagacagaaagaaaactggcattgtttagtaataaataggtttaataacaaaaaaattaatgttactcaaatttaaaaagaaaaagtaactagagaactaaagaaattgctgttcttcaagagaactatattgaacaagaggaaatccttgttttgtaatatttctctatgagtgaaagaaagaaggtaagacagttatgagagactcagtatgtttgtgtccacatgattagacattcaaccttgcttacatttcttctccctctcttttgtcctctatggactgttttttaaattgttgtaaaattatttttactttgtcaagatttacttatttaaatttttgttccggacccatatttattcctgtaactgtttttctcaatttaacatttaaattctcattataccatgtgttctacattgatcaattaaatggttccaaccaccctcttacaaggacaaaaaagaaaaaaatatgtctggtcttaacaacaatgtagtaagccaagaaagaaaaataaaatgtataaagattggggtaaaaaaacagccctcattaccattcattctgtagtaattttattccctagttcttcattgtgatcctcccttttttcttgggtaggggggtggatttaagtatcaagtagttaaaatgttctcctctcaacctgtatcttgaataatgagaagaaaaatgttcttctctttgtctttgcacgtttgagaatccctactaaatttattagctccataatacatttttgttctcagagtaattcatagcttttcatctctctttttaaaaaaatcatgttgggtggtgtgtatttcattaaattcatgtccttattgaattactctatagcacaagcatttttagaagatttcttgtattccttggatcttagttttcccagaatgtgttcttccttggatgtttttcataccatgttctttctctcctgtattggtgttatttctgtgcataatgataatgacaggatcctttttaaaaaatattattgatcctaacgtggctggttttagccagacctctaattggctgtgattagtacagatgggttcttgtagacactcctccaaaaatatttgtgacatctgtcttctaagctgcatctaatgcatttgatgttgcattctctgttcctttttaatagcagaggccttggggtaggggatgggagaacctgtctaagaaaacctttagctctttgttgtaggcctgaagactgttctttcccctctcaactttgaataaatactcctggggtctcattctcccaactctacatattgcctcaaaaattggcaagcccctggcagcccctcccagtgtctgcagaagagtagtgtataagggcttctgctcttgatggtgtatttccttgatttttcctctcaagctgcctactctacctgcatctccccatcttttaacagtgcctattaaatgatggcccatcaatattgttactgtaattcctaaactgattttcaaagcattcttatttttttctatcagagataaataaatcatttaggaagagattcatttgaacattcttgtttataagccaaagggtttccaaagaggaatagtttgaagattgacaaaaatggggataatttgtgagagtgaatgcctggagagtatcagggaacatctagaacatacaataagaggatacatggaagggcaacttttcctttgagacaggaagggaaagacatatggatgaaatgagtgaaattatacagagttgggatttcctcttgatggcttcttcttcaggtaaccacagagtctgagcactatcaaaaattcttcctgggccaggcatggactcctagtggattgcctgagctcaggagttcaagaccagcctgggtaacatggtgaaaccccatctctactaaaaatacaaaaaaattagccaggcctggtggcatgtgcctgtaatcccatctacttgggaggctgaggcacaagaaccacttgaacctgggcggcggaggctgcagtgaactgagatcgtgccactgcactctagcctgcgtgacagagcaagactctgtctccagaaaaaaaaaaagggggggcatggtggccggtgcctgtaattccagcactttgggaggccgaggcaggtggatcacctgaggttaggagttcaagaccatactggccaacatggtgaaaagttgtctctactaaaaatacaaaaaagttagctgggtgtggtggtgggcacctgtaatcccagctactcaggaggctgaggcaggagaatcacttgaacccaggaggtggaggtggcagtgagccgagattgcgccactgcacaccagcctaggcaacgagagtgaaactccatctcaaaaacaaaacaaaacaaaacaaaacaaaacaaaacaaaacaaaacaaaacaaaaaaactttctgtacatctcctccacctttcctgtgactatcagctttacacattatgtcaggaacattttctggatagctaaaagggggtgaatatgcttatattttaggagccagtgacattcaagaatgttgttgtagactttactgagggggagtggagataactgagccctccacagaggaatctgtacagagaagtgacactggagaactgtaggaatctaatctatgtgcgtaagagccgttttcttttgttactgaaaatcttcctatttgagggtctttgcgtcctcagttattaacagccatgagtcttcatagcattttactctgctgggcttatatggtcctcaaaaccaaaggttataaaatctagttggcccccaagacacaagatgttcctaatacattttccccaggtaaattgcctttatttttaaagagttgatgttaggagctttctatactactcctcccttaaacctcacagtagccatcattcagtgagccaaactttaaggggttagggctgaattttcagatatttgttatatctttctttccccatgggtgggctgtcatcccttcaaagccagtgttatctcccagctggagctagaagagttgtggatgatgggctgggcacccctaacagccacttgtccagctgagaaatagaagcatgatgttcttggaattggtcaatgaagaagacatttcttacagtgttgtctgaggaattcatctcatagtcatatctattttcacttattctttatctttctatcctattagtttctccttcatatttctgagaggaagatgtgttcttccttaactaagttcacatttccttttgttttcaaacttccttcccttcttttctcactcatctcttcccactcgtctctttactgtggcttgcaagcatgatgactccttctcactccagcattctcagctttgtctttcacagcctcctttctttagtcatttagcttttcatgactctttcacccaataaatagaaattcacgtactgtacattgtcagatctcactgcttcagagcaagatttggttaaaacttcctagaaaggagtttagccacatgtatcaagagttttaataatacccttttagtcattcttctgacaggacccctgtctagtagatatcatagaggtcaacaatgagtcatgaacagttctgttcccttggcattgtaagtaactgatttcaatatcatggcattgtttatgcaaattatgaaatatctacacattgaaaaattataatgttattagaaacatattcacagaaattttcaatgatgcggatagtgcattatgtaaagaaagtaaactatgaaattttaactacacttaaatttagcaatagaaatacttaaatcaaataacacttattacatgttgactctcctcccacctttaaatgcagttattatgatatgctattaagtgtaatttttctccttattttatacccaggcatttcctaagacttgctatttctgtccctccttcctacttcagtgtactgacatccctgtgtattttggttcttttgcccccatttgttcagcaaacatttattgggcaccatgcaggaaaggatctaaagggagcactccaggatgttgagggtagagattgctggtgttgaagttgcaagtcatttttctttccttctttattctctttcatttcttctaaactttccacaatgggcatattttcatttaaaaatctaacagaaagaaacactctgtatgatatatactgttaccatgtgcatttttccataattccttgctgattaaatttctttttgcttctcaaccatcattttggtttctaaatactgtccttctactgaaattacttattcagaggcaaccattagatttcttctaaaaaataggctaggctttttccagttttcttcatcttcagtttttctgacatactttgccattttgattattgactttgggtgtaataaaaatgtattgtggaaattttagaaaatacaaataagcaaaaaataaaatttgaaatcagtgatctcatgtcttggagagagatagctcatgggcatatgttatgttgtatttattatctactatctagaataatcattactcatcatataaaataactgataggcatttaattttatggatttgccattactgatgaaattaggtacctgggattgaacatttaggttattgccaatttctttcctttataaatgatacagatttaaacatccttgtaaatgtcttgcacatttgttccgtcagagcttagtataaaattcttagaaaatgaacttttttgcagcgaagattatgaataacaatcacttaaagcttttgttaacatgttgttgtttttttttcagaagggcaatactagtttgtttacctatccctcagttatacctgcatgtgacctggaacacgtggcagttcatggtttttcattatatttttattactgctgaatttttacatttttcaatgtagttactgaccctttactttttatattttataagctgtctgatcttctcattagcccatttttttcattaatgtgaaaatatgttttcaggatacagagctgcactgtacagtactaatgcatttggctcgtaaggcaactgaaacatggccagttctcactgggacatgctatgagtataaaatataccccagattttgtagacttagtaagaaaagaaagactgtaaaatatctcaatacctgttatgctgaatccctgtttaaatgataatattttggatatattgggttgaataaaatatattctttaattttacctgtattctcttacctttttaaatgtggctactggaaaacttaaaaataaatatgcgcatcacagcacttgtggctctcattatatttctgttgaaaagcactgatacaaatagtcaattcctgtatattttgactacttttgtcttttagctttttttgagttcattattattacaaaaataaaacatgcttgattaaaacattcaaaccatatagaaattcaaaaaaatacaaatctgctataaaaaatctttcatccctctgcagttccaatgatagccagtattaagccattgagtacagaatctgggatatgttttgcttatcataaggtttatgtgtgaagtcacattatccctaattttctaccctccagaggactaaaaacccagccctatcttctgaattattccttccctccacctaagttgt

SEQ ID NO: 5588 - DNA, 1049 bp, Homo sapiens
cagttttttgagtgggctttagagatcatgctgaggaagaaagaaaatagcgtgcacggatgtgttgctgtggttggatttcactggctgtttttcatatacctgtcttttccctgtgagagaaaacagccatgacagtaagcaggggaagctcatttgagagtaggggacgtggagggatgagggcagttctccggggcacccctgaaaatgaatttcctcctccagagccagggtgaccgggtccctcacagggccaccgtctgcaggcatcaacactcttttgggtctaaatccaattattcctcaagttcttcttggtggcttccttcactctctggccagggggagttttgcagaaatactgttctaacagcagagcatgtctgtgaccaaaccttgggcaaatacatatttaaagaaatcttattattaaaatagtcaaccttatggtttatgtagacaatctgataaacacagacaagggtaaagacagtacaaattgctccataatctcacaagctggaaattaccaacaccatttagtacttttgtgtatttcctcacagcctttttcattgcatatatgtaaatacactgtattttaaacatggttacaagcacattgaactttatatcatttttctttttcatttgacataacattatggcaaacaaaaactttaaaaaagcacatgggctttacaagtgagcatatgctttgcaaacatttctgtcagctaccagtaaccaactgcaaaaactcatattctacccaaaacagaaattgtgccagtcggggagtcctttgatcaccatgcagtaaacctcgccaaaatattgtaaatttaaacaaactaaaacccaaccacttgaaaaaatttaaagcacttaaattgctattggttcaaggaagaaataaagaatgtactgacaaatatttagaaagcattgaaaactagaatgccacatacccaaacctatgggagacagctggcactattctcatagccttaaatgcttttattattaaaaagggagagagaaaa

SEQ ID NO: 5589 - DNA, 1013 bp, Homo sapiens
gtaccaaaaagtctgaagtcacagctggaaagctgggaagatcaggaattcaaaatgcactctttggcataaaaattttaatcatttacttaaaatgtaaaatccaagattttttttttttttttttttgagacagaatcttgctctgtcgcccaggctggagtgcagtggtgcaatctcggctcaccacaagctctgcctcccgggttcacgccattctcctgcctcagtctcccgagtagctgggactacaggcgcctgatatctttcaatgggcagactttttggttttaagttgttttaatggtttgtgctttttgtaccctatttaagaaatctttgtctaatccatagtgataaagattatctgtgttttcttctgaaaatgtggtaattttagcttttatgtttagatctgagatccattttggttgggcgtggtggctcacgcctgtaatcccaacagttcgggaggctgaggtgagtggaacacctgaggtcaggagtttgagaccagcctggccaatatggtgaaaccctgtctctactaaaagtacaaaaattagccggatgtgatggtgcacgtatgtaatcccagcttcttgggagcctgaggcaggagaatcacttgaacctgggaggcggaggttgcaatgagctgagatcgcaccattgcactccagccactccagcctgtgtgacagagtgagactctgttctcaaaaaaaaaaaaaaaaaaaaaaaaaaaagatctgtgatccatttcgagttaatttttaatggaaagagctaaggattgaggttcattgttttacatgtagacttccgattgttctcacaccatttgttttaaagtaaacaacaacagcaagcctcttctttctccagtgaattatgttgataccatgtttgtaaagtaattgaccatatctgtgtgcctttgtttctggattctgttctgttccattatggcttattcctcataggtcccagtatcacactgtctctgtagt

SEQ ID NO: 5590 - DNA, 2671 bp, Homo sapiens
aacccatggccaattctgccctatccccattctctacccctttccatatttttcttctcccatattattttgaagcaaatcccaggcatcacataagatcaaaattttaacatgtttttacctctacttcaggttattgttgaaatgacctgaaattttaaggaagtagctgaaaatagcattaagattggaaagaaaggcagacagattatgagaggcctataatgccagccttgtggaggagccccagagttgtttcagtagacagacaaaatctggtctgtgctttagcaactttgtttcatgaatgaataattaacctagtgagagagagagtttcagaaagttgtaatgaaaggaatggtaatgtgaaagaggccctgaagcagcagaatttttatcactggatgattaattaaatgaggggatgagggaggctttgctaacctgaatttcaagcctgaatgaggttgatgatgacattaactaagacagcagacatggaaaagtaatgtgtggaacttagggttcttggattccaaagcagttgaaagggactttgtctagcttaagcaagaaggaaatttattaaaatattagtagggagaggagggacccctaggttgaaagggaagactgaagagccaggctaagaagtgtcagagtggcagtcagccagccggggcattgctgctagagtgagcgaatgccagctatctttagtgtttaggttgtattgcttatcatccattctctagggaggaagcattggatctccttcctcctatcccttcatttttactcttttgattagaggcaaacagggactttattaatgctctcttcaaactatattgaggggaaaaggtgattctgcagaaggaaatcaggttgctattgccgaaacaaagtagaatgttcagccaaagagtaacagttgtccactgtgtaacaaacctggctctgtacatgttgcatgtgtgttatctataaggcatgcaagtagaaatgtatagcagatagttggaaatgtggttctgaagtataagaagatagatttatatagtatactggattgattttccaagagtgactggattcttcttccctagagattttaagaaaaaaaaaaataaccctttatcttggttttgactgagtggtttaaagaaagtcagctctaaatccataacttactattggattgacttttgaagagcctttcctgtgctatggattcttaattcattttgaagatccaacagcagccgtgtagaccaccatcaagaaatgaacataaaagtcttttgattgaagccttaagatttttgcactggctcttctttctgcctgcaaccactagtctgctttatgtctctaagaatttgcctttactggacatttcatataaatggaatcatatggtatgtggccttttgtgactgacttcttttactcagcttaatgttatcaagggtcatccatgctaaagcatgtgtcagtacttcatttctttttattgctggataacatttcattgtatagatttgccacatcttatttattcattcatcaggtgatgggcatttgggtttgcactttttagctatttgaataatactgctgtgaccatttgtgtagaaatttttgtgtggacatttctcttgggtacatggaagtggaatttctgggttatatggtaactgtgtttaactgctgaggaactgccaaacttttccaaaatgactgccccattttacattcccaccagcagtctatgagtattctaatttcttcacatcctcagcaacacttgttattgtctctccttttgagtttagccatcctagtgagtatgaaggaatatcttgtttttattttcatttcattttcctactaatgatgttgaacattctttcatgcgctttttggttcatttgtttctttgttggggaaatgtctatcaagtcctttgcccatttttaagttggataattgtctttttattgttgagttacaagagttcttaatagtctagatgcgagttccttgtcagatatataatttgcaaatattctctcattctgtgggttgtcttttaactttcttaatggtatcttttgaaatgtaaaacttaaattttgatgaagtccagtttatctattttttgtcacttgtgcagtcatatctaagaaatcattgccttacccaaggtcacaaagatttactactgtctttagtaaagacagttttctgttactaaacagaataccacagactgggtaatttctaaagaaatttacttagctcatggttccggaggctgagaagtctaagaacatggtgcctggcatttggttagggccttcttgctgtgtcataatatggcagagggcatcacatggtgagagggcaagcaagaacaaacccactcccatgatagtgacattaatccaggtatgagggcaaagcttttattaattaatctgttcatgaaggcagagggactaagtttccaacatgtgattttttaagggatacattcaaactatagcaacccctatgttttcttctaatagtcttatagttgtagcattacataggtctgtgatctgttttgaactatttttattttattttataattattatttttttgagactccgcctcc

SEQ ID NO: 5591 - DNA, 729 bp, Homo sapiens
gataatcactttaagatggatgatgatgaaaatgagcactagctatctttaagaatgatcgtaggggcaaaggatgaattgtgcattgttgaagcagaggcaatgaatgatgaaggtagtccgattacggtaacactgatggctttgaaaacatctgtacagccaagggcttcccttgggctatgaaataccaccacctgtggcgttgtgggtgaagtgtggttcagggcccgtgtgtatcaatggatggcacttagtagctggggaggaagatgcagagtcagagacaggaggatgtgaaactcttcagaatatctggaaagcgatctccccctggaggtggcagcaaggttccacagaaaaaagtaaaatttgctgttgctgaagatgatgatgatgatgataaggaaactgaagacaaatctccagtgaagaaatctatacgagatactctacccaatcatgcacaacaatcaaaccagaatggaaaagactccaagtcaccaatgtcaagaaaaggtcaggaatccttcaaaaaataggaaaatactcctaaaacaccagaagaacctagttctgcagaagacattaaagcaaacatgcagccaagtatagcaaaaggtggttctcttttcagagtggaagccaagaaaatcaattatgtgaatggcttctggatgactgactagggggctattcaagatctctggcagggcaggaagtctcttt

SEQ ID NO: 5592 - DNA, 3085 bp, Homo sapiens
tcacgccattctcctgcctcagcctcccgagtagctgggactacaggcgcccgccaccacgcccagctaattttttctatttttagtagagacggggtttcaccgtgttagccaggatggtctcgatctcctgacctcgtgatctgcccgcctcggtaaataacaaacattggcgaagatgtggagaaactgaaacccttatgcactgctggtgagaatgtccaatggtacagctgctgggtgtatatcattttttcttacgtgcttcaaatagtaacatatctattccctcaccctatgacaaatctcaatacaatgctgatgtcaatctttagtcttctcctctccaggccaaacaatcctagttttctcatggcagtgtcttgatcattcactaccctaagtctcctctgggtgctttctaatttactcctaatgttctttctaaaatgctcacctaaattctgtataatctggacaacacatggtacagtagaactattttttgcccatgctcttactgctgtatattactcttactgctggatattaccataaaacctaacattgtattaggcttcaattagagttcacatcagagtgttgcttcatatatttaaaagcacagattttatagcaattaattaaatgaacataatttaaaagagttgctgttaactataaacttagaaaagtctatacataaaaatctttatgaagaaattcatcctcagataccgtataacagcagaatgtgttatatactattatgactgtaattcacagcatacatatactatgtggcattgatataattatggtcacagaaaaggtatatttgttaatacttattttatttggatataaaaacttaataaacatgtaaatgaattcaacctttaattgccaaacctggcattaaagaacttgatatgaaatgaacacataacttcagaaaagagatcttgagtactaaaaatccaatgtgaacacactttagatttaagcatttgaatgactgaattcatttcaattgacacttaccttgaacatttagcaccctttctacattaacatcagataatctcttttttcgaagttcagcacgtattctaaacacttgatcagcatatggagtcaccacaccaatactgccatcatctaacttcccccacgctactggccacttccttcttaactcttctacacgttccaccacttcaaacacctttaaaaacaaacacacacatacatattaaagttatcaccaatgtttggagaaaataatatcgtaactaaaactgatttataaaggatcccattttagcagatgtcatttaaaaaaaaaaaaaaactacccctaaatgggagtaatgctttgctgatgtgaactgaatgagaatataaatttttcatttacattttaaacagtaaaattctccaataatacaaccagtgaaaacatgaaaatcagggacaatgctattggcccccaagttcctgtgtagggaggaacaagctcaagttcctgtgtgggaaaaagacaggccatgattctagggaaggcaagttctcacagccccagtaattctcagtccactctctccagatcaggccaatgaaactaaccaaccaactagaagcttcctgtcatcagtgacatcactaagtcccagcagtacaaggtctaacattgtccccttcctcactgatataactaagcagaccagccaacagccaccaattgacaacaaaccacagctgggactaggccacatttggatcacagagaaagactttcagaattcactgcctgctagtggtacaagtccagccaagccatttcattaaccttgcaataaagcaatgccacagtttatgcaactgaatttttcagaccccaattactggattatgatagggtttttaggatagtttgttctattttaattcaatgaattgatcaaacagtttcaatgtctggcacagtggagaaggtacaaaagttaataaaacatgttccttgcccgctacttactgagaagaacttatggtttatttagaaaagagagtcataataaaaaaaatatataaggcaagcacaaatagagggtcagtcaagagtccaggggcatacagaggaaggaggtgtgttttcaaatgtctttaagtacatcgtttctttattatttactaacagtatctattttaatttataatattaaatatatttaataaaaattgacaattttcatcctttgaaaaacttgaggttactgactacgaagcagttcccatgtccagatacaaattcagtgaactacagaggtaaggactacagtcatcctatcgttattatgatacagcagcaagtgtatcacatacacagactacccagggaaggtgaagagcaaactggactaaagacatggcattctcactatcaggaaacagagtagacatactcagtctactgcaataaggaataagaaaaagttatctttacccatgtggttagatgtggggatagatgagttgggagacacctctgctgcgccctcccaccccacagagttcccacctctaagcaacacacaaccatttctgcactttatcctcctgtcatgtagtcaaaaaacagacttagaatgatgatatgagtcattctgggaaacctctctcccagaaaaacatcttctaagctggtcaaaattagcaaagacaatcattcaaagtctctaaagacagatcaaagaggttacaagaaattgagaagcatccatctattcaacaaaacctgtaaaaactcactgagaacagtggaaggttgaggcctacaagctatggactgccccctttcccccacagctcttacagaactgttttaacggccaaggggcaattcccatcgccctagctccctcctattccaggtacttttggcagctggtaaacattggcagatttcatttttcacagctttgtgctgcagaaggcctatgataagcagttggtagtagtcaggtggtacccaacccccatctcctgctacatagggagtgggacagtgggtggcagtgcagtc

SEQ ID NO: 5593 - DNA, 2084 bp, Homo sapiens
caaaattgccaaatagcacaaacaatgaatgttttctggttgttatatagatgccaaaatagcactttgatatttgcaaagtgctttatgctttttaataattgttagctgtttctcacatcattgtgagttagatcagtattatgaccgctgtcttagggaaggcctgggaacaggagtgtgcaggctgtcctgaagagaggctgaggacagtgtgaataattgtagcctgaccttttgcattctccagctcagctgctaggaagacttacttgtcatgatttatataataaaattaaggacactgaaaattcttatgcttgatgaaaaacttaaggctagcctagaagggccaaacatgtccttattgacaaagctggtctttgtcgcctaattagggtatcctagctatgttccatttctagtaaggggctgtagttagatgactcttgtatagatttcagttacttatgctgaagatccctgtgctaggttagcctttagaagttagagttgtggaaagcagtattgttttcttctctagtgattgttaccctacacatttcatggaagcatcttcacaaaatatcagacacagtggaagggggaaaaaaagctacgagattgtttttacacttttagcaaagtttctgtggatgctagtaatttatacttgatcagttgtattctagtaaagaacctctttggggactgtaggaaagcatgtttttgtggttataaaaacacttaaaaatcctgataattctgggcttgtataatgcctgttgatcttgccctcttaatcagtttattgttattcacaaatgcaaataggttttcaaactacagacagttttgaaagacattaattctcattttcttctagtcaggagtaatacaagcaaacaagtgtccgttttgaattctgatttgtaatctgaatactaaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttacaattcttcagggaacttacctgcattaagtgaggttaaatgcattcaggaggttgtttgtttcttctatctagttttagaataatatttcttcggcaaaccctgctaactgcggttcacccttgaaaacgttaatctgaggactttttccaccaactcattaatgatggtggaagcaagtgtattatttgtttcctggagaatttgatgaagagcagtcttcctctgctgccctttactaagcaaaacctggagcaatttaaataggctaaatggttttgattaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtcttttaccatgtc

SEQ ID NO: 5594 - DNA, 1181 bp, Homo sapiens
gcagtatgcacagcaccagatttctaatcagaaaccatgaaggccagaaggaaatggcacaacattttttttaaaaactgtcaacccagaatcctatatccatcaaaaactatatttcaggaatgaaggggtagtcaagacattatcagatgaagcaaagctaagaggatttttagccaacagctctgctataaaacaatggctaagaaaattctctaaacagaaaggaaatgatagaaggattcttagaacatcaggaaggaaagaagaatatgaggctgtttcctattctgttgccaaaacaaaagcagaggatgagaattttgaaaaaggaaaacagtctgagtctcaagaagcctatgagaaggaagagaggaatgacttggtcatgcccatgacagaaaagtggcttagggatgtaatgagagaatacaatatgtagatgatacactagaattcttgtcctttgaattagtattgggttggcgcaaacatgattgtatttttgccattgaaagtaaggcaaaaactgcgattgcttttgcactaacctaatagaataaaatcatttgagctagaacagaaatgctaggccacccagcttcctcccttttttatatcaagctacatttgcacagcttctcttagatagttttatttactttatgccatgtagtttcctgcaagaacagagcctcaattagggaatgagttagaaaatgtggaaaagtaatatcaatcagttcaaaagtacctatctaaacccaatttcaatattggattaagcaattattataaaccccaaactatggaaaataatttgttttcataatggtcaaagattgagacatacttaactctaatagctatttttttgaaatgaatatttgctatagaaattgaattgaggctgtcaattaaacaaaactataaaataaggctaaaagtaatagctgatgtttatgagagtttacatctcaaggatctattacatttaaaatgacatttggtacgaatctatgagaaatcggagataacctgtgagtccatcagtaggggaatggcttatgctacattgagacaatgaaatctgttcaagaggataagcaactctgtatgtgttgatggggaatcgtagctgcgacacatggttgagtgaataaagcaagtcatgaataatg

SEQ ID NO: 5595 - DNA, 2390 bp, Homo sapiens
atggcctccctctccctctccctctccctctcgccacggtctccctctccctctctttccacggtctccctctgatgccaggccgaagctggactgtactgctgccatctcggctcactgcaacctccctgcctgattctcctgcctcagcctgccgagtgcctgccattgcaggcacacgccaccacgcctgactggtcttcgtatttttttggtggagacggggttttgctgtgttggccgggctggtctccagctcctaaccgcgagtgatctgccagcctcggcctccggaggtgccgggattgcagacggtgtctggttcactcagtgctcaatggtgcccaggctggagtgcagtggcgtgatcttggctcgctacaacctccacctcccagccacctgccttggcctcccaaagtgctgagagtgcagcctctgcccggccgccaccccgtctgggaagtgaggagcgtctctgcctggccgcccatcgcctgggacgtgaggagtccctctgcctggctgcccagtctggaaagtgaggagcgtctctgcccagccgccatcccatctaggaagtgaggagcgtctctgcccggccgcccatcatctgagatgtggggagcgcctttgccccgccgccccgtctgggatgtgaggagcgcctctgcccggctgcgagcccgtctgggaggtgaggagcgtctctgcccagctgccctgtctgagaagtgaggagaccctccgcctggcaaccgccctgtctgagaagtgaggagcccctccgcccggcagccaccccatctgagaagtgaggagcccctccgcctggcagccaccccatctgggaagtgaggagcgtctctgcccggcagccaccccatccgggagggaggtgggggtcagcccccgccaggccagccgccccatctgggagggaggtgggggggtcagtcccccacctggccagctgccccgtctgggaggtgagaggcgcctctgcccagctgcccctactgggaagtgaggagcccctctgcccggctagccgccccgtccaggagggaggtgggggggtcagccccccacccagccagccgccttgtccgggagggaggtggggtgatcagccccccacctggccagccaccccatccgggagggaggtggggtggttaaccccccgccaggccagccgccccctccaggagggaggtgggggggtcagccccccgcccagccagccgccccgtccgggaggtgaggggcgcctctgcccagccgcccctactgggaagtgaggagcccctctgcccggccagccaccccgtccgggaggtgggggggtcagccccccgcccggccagccgccccgtccgggaggtgaggggcgcctctgcccggccgcccctagtgggaagtgaggagcccctctgcccggccagccgccctgtccgcgagggaggtgggggggtcagccccccacccggccagccgcaccgtccgggagggaggtgggggtgtcagccccctgcccggctagctgcctcgtccgggaggtgaggggcgcctctccctggccacccctactgggaagtgaggagcccctctgcccggccagccgccctgcctgggagggaggtgggggggtcagccccccgtccggccagccgccccgtccaggagggaggtggggggtcagccccccacccggccagcctccccgtccgggagggaggtggaggggtcagccccccgcccggccagccgccctgtccgggagggaggtgggggggtcagccccccgcccggccagccgcccggtctgggaggtgaggggcgcctctgcccggccgcccctactgggaagtgaggagcccctctgcctggccaccaccaagtctgggaggtgtacccaacagctcattgagaacgggccatgatgacaatggcggttttgtggaatagaaaggggggaaaggtggggaaaagattgagaaatcggatggttgccgtgtctgtgtggaaagaagtagacatgggagacttttcattttgttctgtactaagaaaaattcttctgccttgggatcctgttgatctgtgaccttacccccaaacctgtgctctctgaaacatgtgctgtgtccactcagggttaaatggattaagggcggtgcaagatgtgctttgttaaacagatgcttgaaggcagcatgctccttgtttctttgttcacttgtttatctgctgaccttccctccgctattgtcctatgaccctgccaaatccccctctatgagaaacacccaagaataatcaataaaaaaaaaagaccctgtcccctccaaaataaataaataaataaataaataaataaataaata

SEQ ID NO: 5596 - DNA, 7611 bp, Homo sapiens
ctcgggagcccccacccaggcgcatggctccatgaagcaagaggaggaggcagagcgcgagaggtcccgtccgccccagccgcgtctgggccaggataaaagcaaaaccatattcctgctgctgtcagttatgatgcactgagaaaacttcagagacctaaactttttccagagaagagaagctttactggtgttccagccctaaggctcatatgacattaacagacaagacacttttcagaaagacaggcaacgtgttggaccttccggagcttctcagaagacagagggttttcttttgaggctgttgtacagtggcctgattatagctcactgtagcctcgaaattctgggctgaaatgatcctcctgcctcagcctccaaagtagctgagactagaggctggtcttgaactcttgggctgaagagattctcccacctcagcctcccaaggtgttgagattacaagcatgagccacctcacctggccaagagctagttgttaaaagagcctagcagtacccacctctttcttgtttcctctctcaccatgtgatctccacacacattggcttgccttccctttctgacatgagcggaagcagcctgaggccctcaccagatgtggatgccagtgccatgcttcttgtacaatctgcagaatcataagctaaatacacctcttttctttataaattacccagccttgggtattcctttatagcaacacaaacggagaaagacatatgcaatttgccattttaatcatttttaactgtacaatttggtggtattaattatatttacaatgttgtgcaaccgttaccaccatctattaccaaagccctttcatcaccccaaatagaaactgtgcttattcagcaaaaactcccattttcctctccttccagcccctggtaacctctggtaacctctaatctacttcctgtctctatgaatttgcctattgtaaatatttcacataatggtatcatacactatccttttgtgtctagcttatttcacttagcataatgttttcaaggttcatccatcttatagcatgtatcagtattccattcttcttttctatggctgaataataattgtatgtatatactgcatcttgtttatccatttatctttttgtttgtttgttttttaaagacagggttttaccatgttggccaagctagtctcgaactcctgaactcaggtgatccgcccaccttggcctcacaaagtactgggattacaggcgtgagccatcgtgcctggcctatccgtttatcttttgatagacattttggttgtttctaccttttgtctattgtgaataatgctgctatgaacattagtgtacaagtcactgattaagttgttgttttcaattctttggggtattgtattaggccattcttgcattgatataaagaaatacctgagactgggtaagtgccaaagaaaaaagggtttagttggctcacatttctgcagtctgtacaggaagcatagcagcatctgcttccagggaggcttcaggaagcttccaatcatgatggaaggcaaagtgggtgcaggcatgtcacatggcaaaagccagagcaagagaggaagtggggaggtgctgcacacttttaaacaatcaaatcttgtgagaactcacaatcttgatgacagctagagatggtgaagccactcatgagaaaccactcccatgatccaatcacctcccaccaggccccaactctaacaccggagattaattacatttcaacatgagatttgcataggaacaaacagtcaaactatatccggtatatacttaagagtagaattactgggtgataattctgttttacgttttgaggaattgccaaactatcttcctcagcagttaaaccatttacattcccaccagaggtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtcttttgtccattaaaaatttgagttatttatcttttatttgttgagttgtaggattctttatgcattcaattcttttgggtattgtattaggccattcttgcattgccataaagaaatgcctgagtatattagttttttgtcagatgtatgatttgcaaacattttctccaattttttgtgttatcttttcactctctttatagtgtcacttgatacacaattttgatgaagtccaatttatcagttgtttcatcacttgtacttttgatgttatatttaagaaaccattgtcaaacccaaggtcatgaagatttttcagtatgttttcctctaagagttttatagcatttaatatttaagtgttttatagcattaaattttggtctttgatccattttgagttaatgtttgtacattgtgtaaaagtataggtccaacttcattcttttgcttgtggatatctagtttccccaacaccatttgttgaagagattgtccttttccccattgagtgatcctggaacccttgctgaaaattaattacccatagatgtgagtgttagttctggcctctcgattctattccattggtctatattgtctatctctgtgccaagtccatgctatttcaattattatagctatgtagtacattttaatatcagaaaatgtgagtcctacaactttgttcctcttcagattattttggctattttgggttccttgaaattttatatgaattttagaataggtttttccgtttctgccaaaagcgctgttgggatcttattagcgtgattacattgactctacatatcattttgagtagcgttgtcgttttaacaatattaagtcttccaacttatgaacacaggatctctttccatttatttaagtctgctttaatttctttccagaatgctttgtagttttcagtgtacaagtcttctgccttcctggttaaattgatttctaaatattttattcttttgggtactactgtaaataaaaaattcttaatttccttttcagattttttactgctagtgtgtagaaacacgactgatttttgtgtgttgattttgtattctgaagccttgctaaatttgtttattagctttaagaggctatttttggtattctttagggctttctacacttatatcacttgcaaatagagatagttttacttcttcctttctaatttggatttattttatttctttttcttgcctgatgggtctggctagaactgccaatactgtgttgaatagaagtggcaaacacaggcatccatggcttctgattttagtggaaaagcttgaaatttttccccattgagaatgatgttagtcgtgagttcttaatacatggtctttatcatgttgagacagttcctttctattcctggtttgttggacagttctatcataaaggaggaatggattttctcaaatgttcttctatatcaattgagatgatcatgagtttttcactccttccttctattacttggtgtattacatcgactgattttcatacgttaaaccactcttaaatttctgggataaatctcagttggtcatagtgtaaaattcttttaagggctgctgaatttaatttcctagtattttgttggggatttttgtatctataatgcattcataggggacatttggctatagttttcttgtattgtctgtctagctttggtatcagggtaatgttggcttcatagaatgactcagaaagggttctgtttctcaactttttggaggagttcgagaaggattagtgttaattcgtttctaaacgtttggtagaattcaccagcgaagtcatcagttcctgggcttttctttgttaggagagttttggttgctgattcaatcaaaattgaatatcattactttttatagatctattcagatttattctttgttcttgagtcaactttgttggtttgtatgtttctaggaatttgtctgtttcatctaggttatccaattttttgacatatagctcttatactaattctcttacaatcctttttattcctataaatcagtagtagtgtctttcatttctgattttagtagttgagtattctttttccttaatctagttaaagctttgtcaactttgttgatctcttcaaagaactaattttttgtttcattgattctattgtttttctattctctatttcatttatttttgctctaatccttattatttccttcctctttatggcttcaaactcaattgaacataaagtattaagaaatttgacttttttctcaaatgtctaaaatgtaacaagaaatatgtctagagtcatcaaaaagcagcctgtttgtcagatttactgtttaatccatgtaaacagctttcatataattcatgatagaatattactatgtgctttggaagacactgaaggaaagacaaaaggtcattgggcagaaccaccctagattgactgttaaggccatcttctagtttgcaggacttgtggtagacagacagaataatatcctggacctcttgggtgtatacaggacaaactgaaataaactctcatttttagatcataatgtcatcatgaaacatatcaattcggtctatttctgaagaaaacaagcacaatgataaagtttgaatgtttgtctcctccaaatctcatgctgacatttgatccccaatgttggaggtggggcgcactgggaggtgttttcgttacgggggcagatccctcatgaatggcttggtgctgtcttcatgggattaagttctcactcctacttcctgtgagatcttattgttaaaaagaatctgataccttcctcccctctcttgctctcttcctccctgatcatgtgacacacgggttcccctttgccttccaccacgatggaggcttcctgaggccctcaacagaagcagatgctggcgccatgcttctcgtacagcctgcagaattgtgtgagccaaataaacctcttttccttatatattacccagcctcaggtatttgtttatagcaataaaaacagactgagacacatgatgaagaccctttgatatcctataaatattgatttctctccctgagagaagagcatgaatctaagtgatgccattactctaatgtgaattccacaactcttctcaaagatgtggcccatatgttcctaataatggctttctaagaatctgttctgaaggggtaccttctctctgattttcatttgcatttcctgcttagcttacacacttcaccttgcctatccacctgtcctgaccccaataacctccatcatcagacatctcatcttacctacctactttctacttttcccagtccttcccgtgcttcataaaccatgatcatgagctagagacacaaggtcatagctaaggagttgggatcagaaaatcaccttctgtgattttccattattgtcaatacataacttcaacaaaatcaagaaaatcatgaaaggacatcctaaggggtcaggtgaggttgcagtggggttagtcggtcaatagtttctttatgccaattaggatttctgcagaaaacaatgaaatactggtttaaacagtaaaaatattttaattccttacagaagcccatggaacatacactccaggtttaattcatcagctcaatagcatcatcaatgacttaggttctttccactttctgcttgtcatctgtgttggctttattttcaagctagctcctccctggttgcaagataattgcagcaggtttagttatcatattcggacatgctaacgcccagggtagtgatcccttccttgcatttctttctcattttaagaacaaagtgtttaaaaaattatacttaaaattattggcatctctgtcaattgaaagatgtcaatctctttcatttttcctaatcactaataacatctactaaaaacaaaatgtctgtgtaaataatttatttgaataaaattaaagttgttgagtgagctcggcttttgaggagtgggaaaggaggggtgcatagattagtggaagatgagaagctagtggggctcaagtccagcaggagcaggagtttggagccaggacttcctagcctctcagggtttttttttaacttccttacctgaaatgatttgtgctatataacttgtcctggctaaactttcttaatctcaactgtttcatttaatcaataacaactactgcgccaccttcataatatcaattttcagcatttcatttactgaatatcatttcctttccttccagactattctactgtgtcaaattcaatattcctttgactcaataggatctccaatccagtgaccccattatttgtttgtttattagaacaagaaaaacaaactttcccagaaactccccagtagactgctcctcatgtctcattggctagaactgagttgcgtgcccattcctaaaacaaaactggcaagaaagatagttaccaagattggttcagaccaaatcaggattttttcctgaggagaggataaagtgagcttcctgggaggcaaatatttacacattccaaagattccaaagaaaaaaagagaataaatactgggtcgttaactaatagtaagtgctacggtattacaggtaaaatttatccttttagccctagcaacaagtgacaccttctgaagccattattcatttgtcaggaatagggcaagtatcaggaaaagaaacaccgaaataaactctgtttccatttattgcattctagcactggttctaccaaatatttgttggatgactttaggtaaagcatctagcctctctgtcttgattgccacacccacaatatgagataaatattattctgcatacttcctgggagagctgggaagataaaatcagatcattataccacataaagcaaagcaataacacttccatattttagcttcccacactgcctatctgtcctattttcatttattcatttatactttttaacaaacagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgttagtttacaggtgcctacattgcttttttggcttaggtattgtttgggttttaatactgactggtatataatacagacaaatcaactcaatcaaagaaaccaactcaatcaaagaaagatgggtctacatacaacaaaactgaacaaaatctgcaagaagagtgattcatacatgggctattgaggcaacatgaaatggacattaatcgactaagtaaaaaacagatttcttgaagaattaataaagaacttttgttttggaa

SEQ ID NO: 5597 - DNA, 1888 bp, Homo sapiens
gttttttccctacctttaaacttccctgttacttctgtgtagtttattcctaaatgtagctagccttggcatcagaagttttagtttcttgtctccagatacttgctagacattttcacttagctttttagttttcatttcaataatgaaattcctcatatttatcttttccccagaccacacaaaacattgacttttctccttggttttttattttgttaatagtggtatcatttccacctaattttcccaatatctaaaccctgatttctttactactctcccttcccttacctacctgtacccgagatgtacttagtcaccacataatgctgattttgtatttttccaatattttactatgacaatattcaaacattcatccaagttgaattttaaaatgaagtcatatctatcacttagattctatcattaacatttatactttatcacatatctatccatcttcccctccatccatctctattaatccatcttctttttgatacattaagtaaattgtagacatttgtacacttccccataaaaacttcaggatacatatcattaagtagttttttccttttgatgtgcagtttacatataatgaaatgtacaaaacttaaatgcacattagcttacttttaacatatgcatgcatgcacttgtgtaacccaaatccctatcaaagtataaagtattaacattgtcccacaaatttccctcatgctccttcccagtttttcccgtgctctccctagaggcaaccactgtttggacttttttctaccatagattagttttacctgttttagaattttatagaaatgtaatcatatagtatataatctttatggaaagcttcttaaacttggcataattttgagatttgtctgttgttgcatgtgtcagtagtccatttgttttcatggccgagtagcatttcattgtatgactgttccacagtttgtccattctcctgttggtgatagatagctggactgtttccagtttggggctgttacaaaaaaagctgctaacaaaaaaagctgctatgaacattcttgtagaagtctttgtaaacagatgtttttatttcccttgggcaaatacctagcagtggaattgctgggtcatagagagatatgtgtttacttttataagtaactgccaaacatttttccaaagttgtaccattttacacttccaccagcagcgtatgagaattccagtagtttctcttgctcaccaacgtttattgtcgccacactccttaactttatccattctggtgactgatcatgttgtaaaaaaatctattttatagagcagttttctgtttcttgccaaattgagaggaaggcatagggatttcccattttccaccggcccccacatgtccgtagccttccatattatcagtgtcccccaccataccagagtgtggaatatttgatacaatgatgaacctaccttggcacatcattatcatccagaggccatagtttatattagtgttcattcttgctcttgcactttcatgagtttggaaaaatgaatgatgacatgtatccttaattatagcatcacatggatgctataatggagcatttctaccccagaaatctgtgctctgcctattattattcatcccccaactcctgtcaatcactgattttttactgtctccatagttttgacttttccagaatggcatataggtgcagtcatgcaatatatagccttttcagaatggctcttagcaatatatatttaagtttcctcaccaaatcattatctgaatgtaccacagtttatagatccattcacctactgaataacatcttggttgctcccacttttggttacagttgccctaaacatccat

SEQ ID NO: 5598 - DNA, 3980 bp, Homo sapiens
ttcgagacaggatctcattctgttgcccagactggagtgcagtggcgcagtcatggctcagtgtagcctcaacctccctgggctcaagtgatccttgcacctcagcctcccaagtagctgggactacatgcgtgcaccaccacacctgggtaatttttctattttttggtggagacggggtcttactatgttgcccagtctggtctccaccttctgggctcaagctatctgcccaccttggcctcccaaagtgctggcattacaaacatgagccaccatgcctggcctaaaatctcctttaaaggtagcattacctcttattccaagcctaacttttttatattttcagtagaatgcgttccagtcttagcttttccaacaggtaagtgcaaaaaggagtcttactctgtcacctaggctggagtgcaatggcatgatctcggctcactgcaacctccacctcctgggttcaagccattctcctgcctcagcttccggagtagctgggactacaggcaggcgccatcatgcctagctaatttttttgtatttttagtagacacgggggtttcactatgttggccaggctggtctcgaactcctgaccttaggtgattcacccgcctcgggctcccaaagtgctgggattaaggcataagccaccactccccgtcctaaaaatgcagttctaaaaatgaataaaaaataacaattcattccagtagttcctgaggcccagggcatcaacaagagatcagaactatatggaataagcccacaatgttgaaaaatttaggctgaatggaagctggatccctgaagctaatctcagcgatttaaagtagagaataaggatggaatgcatcccctccattagtcttgaagtgaaaccacaggaactctattcatgagaagtaaaattagctgtatgttcagtccagcctggccaacatggtgaaaccccatctctactaaaaatacaaaaattagccaggtaatccccgttacttgggaggctgaggcacgaaaatcacttgaacccaggaggcaaaggttgcactgaactgagattgcgccactgcactccagcctgggtgacagactctgtctcaaaagaaaaatggcataaatgccatttaggcagagcaaaagctcggttgtttgccacagtcctcccccatttttactgtcttacatctagatcgcctgcttttttctgttgcctgcttacaggctttgagttcgcagtttatgcacacatttgctgatgctccccagattttcttacttttggtatgtattcaaatcaacccatttctttaagacttaattcaggtgtcccctcttccacaaagtccttccggccctctggtctcacctggccacgcctatcacccctattcagtgcccttcagttttagttcttacttgttctctaatttgttcaggagtaaccaagtggtaaacgcccagagggccaggttgtgattcactgttcttgtattttgacccaggagagtggtagctgcggtgtgggagctcaggttagctcacaacagttttttgacagatgggaatgcaggaatcagcaaagtgagggagtgtggaccctggcacagcccagtgggcttgcattggtttcaaaaggaaaatgaaaagttctgtaaagtcttcaggacacctatgacagaaatattctcttggaagttcaacattgatattttggttcttagtagaatagttaaaacacgtttctgcttaaaatctctaagtactgagggatgacaaactagtgtatcttttaattgtcatttaatagctacccaccacagctgccccccacccttccctttaatgacgacgtttgcaggcttcaggggaccagggaacaaagctggggcctggtagccccactacgctgccagccgggaagaacaagtcacaattacaaattatcacaacaattagcgcctgtacttgggggatctgcaaattgaggaggctccagctcctcattgtacaggggtctatttggcagtgaccttgctctgcagacgatgatattcccttcagcctgagggaattgatgttgatgaacccggtggcatcaattggctcataatcaccctacacgttcatgctcaccggctcctcgttgtagggagagagtggggactcccagccaaggatgtacacccggcccttgaggacggacacctgcgctttccctcccacttgcccctaggacttggcgatgcagtggcggacaaattcacactcagggctatgccagaaagcggtgtacaccagctcagcaaatttcaagcccaggccttgtttgattttgcacacctcccagtccatggtgaaggccttgatgtctaaatgagtgtggtaaaggatggtgcctgctggggtctcatagatacctcgggacttcattccagtgaagcggttctccacgatgtcagtacagcccacaccgtgtttgtccgcgacttcgttcaggtacatgaagaactccaaggaggtcgggtgggtggagccatcgttgacgttggtcacctttttttttttttgtttctgagtcacaagcaagtcatttttgaaagcactgtgctcagcaagacaggtttataaatgaatgctactcacaggtggaaactagaatgaacaaaaccactaaaagctacataaaaggtttcttatttttctgtactgcatgattaattagagccattgggtgaaaaagagaggaaaattgcttctctttgttgtatttagctgttaggtagtttttattagatatttatataggtataccttttgtcacgtgtataaatgagagccaagttcattatttgaggtctcactgattgggatttatgataagtcacatagagatggttttaagtttacctctgcttagcaaatgaaaaataaaggactgcgaagggcggattgaaaagatgaaccttctaaagcattttggaagctcaatatgcaaacaaccaagacactaattagaaatgcttcctgtttatccttaaagacaagaagcggcaatactttgttaccctgagcagctgtacatttttctttttctgtatattttaagagaaaagagttttatgtgtacttataaagaaatcatttatatgaatttcagaataagagtcctgcaatttctttgaatttatgaccattcattgtcaaacggagattacggtgaggcagcagagtgctgggagagggtgccctcaaagaaatgacgagggccgggtatggtggctcacgcctgtaatcctagcaatttgggaggccgaggcaggtggatcatgaattcaagagatcgagaccatcctggccaacatggtgaaaccccgtctctactaaaaacacaaaaaattagccgggcatggtggcgcgcatctgtagtcccaagtactcgggaggctgaggcaagagaatggcttgaactcgggaggtggaggttgcagtgagccgagatcgcgacactgcactccagcctggcgacagagcaagactccatcccagctacttgggaggctaaggcaggagaatggcgtgaacccgggaggcggagcttgctgcagtgagccgagatcgcgccgctgcactccaacctggacgacagagcgagactccgtctcaaaaaagaaaaaaaaaaaaaaattttttttttttttggttttttgactgaggatatttagccaaagtattgtgttcaaatgttacttggattaattcttttctttttcttccatgtagttgtgctattcatttgaaatacagttcattggtttctgtttgcattcaatttgcattttttctcatacttgtttatttaattttatttttgaatgtatagagaattggtaacgttttaaaacaaactacaaaaaggttttatatatatatatatttagtatattttacaaaagaaatgggagtgctac

SEQ ID NO: 5599 - DNA, 4371 bp, Homo sapiens
cttggagttaacattcaaagtttacttttccagttaactggaaatccctttcaaaatgtagattcagatcctttttatttctgataatttttcatggattataatgttaaatattctgttccattgttttttatttcttcttcaggggttccaattatatgtgagttatttatcttttgttcaactttctctttctgaccatttttccttcttttctgtatcgtatttatttgtttatttttgcatctatccagtgtctaagttttcattagtctgttttcctttggacaccttgtaatttagtcttcatttataattcccccccttccatttctttcttgaattcaataatctttaaatttactcgtggtttttttaatctatttctgttttttatattttgaatttccaattcacggtgctttttcatatccccaaatgcttatctgaggattttattcagtttgatatgttgtgttacaattttcttctgatttaatggttgctttttggtagagaattttcatcagccaatgcatgttaattattgtttgctgatttctcatactaccattatatagatttagtccatttccttccattcatttttttgaatttgaggggttataagattcctagttcagaaggactctctctgtcagcatagaaaatacaatttctttagggggtgttttttttaactttatagtagagggagggattatgtatgttccagttttttgttttttgtttttgtcttgcaggaccctgaatttctcctgttgcttcttttccccttcaccatccagttgccaaaaggcaccttgcctattctttttgctctctccactccctgaagctatcctgtaataagtgttgtgatactaagatactttatatttttgcacctaggatagaatttctatctctgctggtgattttagaccaattttaggcctgccactagatccgtttttctttattctgtatgttcttctttggcctgcccttgcttgctacaaaggcttatggtagaaatgtgaaagatcactcacttggatttggtgcttttaatttttttacttataagtatttgacatttggctatatttttcttcttgttaggctgagggtgtattttgtatagatttatttattcttcttgttctgtatcgtttatgacggacataggtagctgccattttattttattaccgcgaagtcctcacctattcactcttaaatctacctcattgaagacttcaataactatttgttgttggaagccataatgaaactgttgatcaaattacccaatccaaatcaaattaaccaaaaagactttcttcagtcttcatattaattaccttccctgcagaacagaacatggttgcccattatgtgaaattccttttacttctttggtggtcctgtctgttttcttatgcctaattgttgcttacggtatacttgctgtttgtttgtttgtttgtttgtttcttttatacactcattaagtgagttctccatctaaatatcccataaggcacttcagaatcaacatatccaaaaggaaacatattttactcatctccaaatcttttgtttctccagcaattcaagttttggtgaatgaagctatgaacaatccagtaatccaaaccagaaacttgagagtcatcttttttacacctcccactttgcatctctcacattgaataagcaatcatgccctgagccatatactttcttagcatctctgccatcctccctatcctctttggtatggcctctcttcagactgcctccttagctctcttctggatcactataacagcctaacaattgtatcaccttcagttttgctctttcttccatatgactatcagaattatttctctggaagatcatgtcaatcactccttctcagtggttcttcattgcctataggaagaaatccaaactccgtagcatgagagaaatgtttttcataatgactttatcctgcctttctattgtttctttcatatcatgcccagctcagccccccattcaatgaaaatcatactaaactactttaattccactaacatgttgtgctagttaagcctctttacctttgttcatgctgtttttactcagaccactccattccacaacatacacttgggggatacctactaattttgaagacccccttcagccctgatgttaaccttctttgtggaatcattattgacatgatggatagaattggtcagatgcttccttgttcatcagttgtactaggcacagcattctaatgtagcacctattacacattttaaaatttgtttacatgtctcccctcatgtaagtttgtaggactggtacctgaaatatactaggcttaccttactgacattttgaaatataagatagctttccaaggcttgcttttgcctcctgattcaggactctaccattggcatcatcaggaagaatttctaatagtattattgatcagagtcttctggaagtttctgcaggttacacatcaacttacttttccctgacaaaataattctgcatctagaaacacaaacaagtagtcaaagaagttatattggaactaagagatgaattaccaaaggaaaactgaaatcaagaaacatttgatgaaattcaggcaatgtcttcaggtgccagaggacacagaaatgtcccgagaaccattcacatgatcttaaagaaacttctgctggttgtcttgtacctttgaagcaggtgtgattgagatggataccttaatttttttaaagtaaaaattgttcattctcttatgtactttagcatactggtattcttatcaaaatatgaaacagcatcaagtttaatattaattataaaacacatggtatatttatatttctgctctttattttctaaagttaactcagttaactctccatataggtatttggacatgggctgtaaccactttttagaacaaatactgtgaagattgttttattacatgacattttatgatgtgagattaacacctttgtgttagtaaacatcctagattgttcacttcaatatagatttttaaaatgtatagttatacttgtgcaggatactagaaaatgaaaatgactgttcacacatgctttattattcagtaattttacaagaaaatattactgtttgaaagaaaatcatgcatgcctaaaactgattctgttccagttttataagttagtatactaattttaagacattgtgtatatttccttcacttaatttctattttctactgcatttctaccaatataaaaaacaaagaattcagttggttcctttctagagggaaaatttgttgtgagtatagtactgggcatcacatgctgcttccctttgtggctttgaataaacccttattttcttgtccattttgtctcaaagaattttaaatggcattgtctaaactcaggagtattgtgtggattgattagtatgagaagtttctttcatggtaagtatagagtttaagtatataaaatcaactcttggtcatatatgtaaaacacaattgagaagtaaaacttgccatcaactcttggttatatacaaaaaaattgagaagtaaaacttgccatacatattagtacaagtaattaaaaacggattatagcttgaaaggcattagatctcacattatttacattctcactccttttagctcctttgcttttttgttctcttgtttgcaaagattaaaaataatgttcctggcattttaatggaacattaccaaatgtacattcatgtgtattgatcaaagaccaactttcattagtgaaaaaatctaattttttctagaccaattaaaaggataaaattctcttatttgaataataagagaattaaagagtttattaagcaaaaacagttgctgaaaaagcgtagcaaagactgactagactggctagaatttcctcttcttccaggacagatggttctacgacattttaagccttctttgtaatggccgagtgactgggttctagctagtggaatgtgagtggaagccttttacctcagaaaagacacacaattctgcatgccctttccccttctgtggcatggtgcaaacatgcatggtgactttggaagccacattttgacgatggtggagccgcaagatgaaaagagcctaggttcctgaatcaccagttgtcgcctgaacctatatagaaattggtaccttgaaaagtggaggtttctgaacaaaaaaacctttaaggtatgtggcattggctttgtggttgggtagaaaaattaagttaaaattagttccattgtaataaagatgtattttagttttta

SEQ ID NO: 5600 - DNA, 497 bp, Homo sapiens
ggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatatcagctgttaaatacctttctggaaaaactggctgtaaaataaactcaaccaggaaaaaaaaaaaaaaa

SEQ ID NO: 5601 - DNA, 1624 bp, Homo sapiens
cttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatac

SEQ ID NO: 5602 - DNA, 2718 bp, Homo sapiens
atttcctggctgagaaggtcccgagataccaggctgactggaagctcccacacagcccatttctgggacctgagggcgcaaggctccacagaggaataccggcggggaatgcagtggagacccccaggaaggtgtctccaagcagaagggagagagaggccgtgtctcaaaactccagaggcttctgaagtccttctggagagttaagaaaatcggagctcatgtgaaagcattcttgtcatacaactgccttccaatggcatgaccacggaaggagaacagctcctcaccaaagcagccatgatggattctgacattttcgaagttattaaagaatgtgccacaccaaaaaaaaaaaaaaagtaaagagagagaatagcaaattaatggggacatttggaggagaaaggacatgtaaccataacacactgctgggcttgggagtcaacaatccttaagtgctccaggacattggtgtgcccagtggaagtttcctacaaggggtgacagctctggacagggcatcaggtgcctgtgtgctcactgcaagtctgcccctggtcggctatatgatcttggtcaagctgctctgtctctctgggtccagctagacaagatgctcactgagtcccctcctgactcatttgtgattttataagggttgcctggtacatgctttctgaaggggagagcaaggggaggaggaaccaatgcagagactcaccacggacctgagtcttggcagggaggagagagcagagggagcctggggctgaggaagactgggggcaggggtgctagagatgcctctcttctttcacaaacctcctgtgctggcctgctcccggagtgctgtccagaaagcctcttcaagaaacccattacaagtgaccacaaagaatgcccgttccaagacatgcattctgagggaggtgtgcaccaaagctttagtgggcaggaagctaccccaccacccagctccagcactgctgggagctgattccagcccagccactcctcatggcttttatatggccctgctgggccctggcgatctggtttgaaaatcatggttctatctcaatccaatcaatggaaaactgaatttcaagtgttatctcccctcaaacaaaaaacaaaacaaaaaaacaacaaaaaaaacagggtgaaaaagagcacacagtggctctcaacacagctttcaccttcctccctggattctgccattcctggatgtgcttacacagagctggctgctcggatttcccctagtgaatgcaaccagttaccggactgcgacaggtgcatggaccccagcaccttctctcaaacacccacgcttggaggaaaacgtggcagctctctccccagctggggcttggcctggggtgcccaccctctttctcattaagcagcccttcatctgagaggtaagaaactcaagttcatccagcgtgtgaacctgcaatgtggggtgtgctaagatccaggcgggctaatgatcactaacaatgctccctatccaacccagcaaggcacacaaggacaaaaccccacctacggatccagctgcatgcctgagttttgagtacacagccaaagaaaaaagcatgctcaggttgtccagaaaaaaaaggaaacctgaaaaaaaaaaaaaaaccacaatagcgagaaagggggtctaagtttcctcggaggtcctcaactgtctgtagaagtgccccacccagaacccaaaataaaatgaagtaaccccgcccctggtcagggtcctgtcttttttattatccagacacacgtatcagagcctgctaacatccagttgtgggaagagcagcaagcagtacaccaggagccacaggaagagaataaaatacatcatatccggctgctggacaagctgtgtcagggagtcactctgcgggctgtggctccccagtgacatggcttctcctgagctgttggccttcctacagaagaaacacagaggaaacgcagttaccaagcaggttcccaggaaagtggaccccacccagtgctacccgtctctccccggcccccactccccgcctgaagacccgaaggctccccagcaccatgtccaggtaggccccacactgtgtgtactggcccaaggcagtgcgtcgggccatccaggcagcccctcgagcttttgcacgtactccgttcatctccataacatcaggtgagaggaggtggcagccccattctgcagatggacacactgaggctttcggggtggagtgacttgcccaaggccatgcaattaacttggcgacagagagggcgcctaggccaggtctcctgggacacctttcttgatgccacagtgctctcagagagtgacacggagttagatactgatcgcttgctgctgtttgttagtaacgcaggggaccccataggtcatctaagggatgaagtgtccctaatagcagatcattttaaatcatctatcagaaagaaacaaagacctctcccattccccacagttttgttttggctttggaatattacctttaaaataattactagatttgatttcagtcagatttaccttcctgcttttattttataggtggtagtgttaaaatgtcatttcagttttgcctggcggatcatagggaagcccagaaggttttgcctggggctggggcctctgcttggagctgcatgtagagaagcctgcagtgtaag

SEQ ID NO: 5603 - DNA, 504 bp, Homo sapiens
cttaaattgggtcaagaagggaagtatcgcgtctaccacaatcaatactccactaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaaccgggcatcacatagggcaaactggatcaaggcagttcagatgtgtagcaaactcagagaatttgcattggctttagccattttggagtgtgcagttaaaccagttgtgatgctaccaatatggcgagaatctttaggacataccagctttctccctttgtctcataaccatgtccaccaatgagaatgctaatacacaagctgcccatcttcacagatctaagaacaagggaaaggacagtacagt

SEQ ID NO: 5604 - DNA, 7478 bp, Homo sapiens
atatcaacaaaggatttgaggtcacttgagaggctgaggcaggagaatcgcttgaacccaggaggcggaggttgcggtgagccgagatcacgccatagcactccagcctgggcaacaagagcgaaactccatctcaaaaaagaaaaagaaatttaggaattttaggaatcagttttgaaattttgtatatattctaagctcctattttatctgttaatagaagccaaatgttaatataagccttaactcttaaatatacaaaccaaaattttcagaaagttgaagattcttcaagatgaattgttaggtcttaacactattaaagctttggcagtcaaatatacaaaatcaaactttaagtatattggggattcacaaagttctattaagtatttagaaagttcagtcttactctatagtgtgttgattaattaccatagattaatcttgttatattgacttgaaaagataggttatatttgatataaaaattttcaagtatctcttcactttttaagtacattaatatgaaattttagccttattgaaattgtttattaagaaagaatggctagttttaaaaatatgttcataccaaaatacacatggcagaaaattcagtgatctctagaattttctagatgtagtaatctctaatggaagaaatgctgagttttttgagagaaatatatagcttactctgttgataggttgagtatttgaattattcaggtaactgaagcacacaggtgatttttatgaccatagtctgtctcatgaaaacaggtaagtcaaactgatgtttgttcaatacagatttcatgatcagcaagcaaatttaccgtatttttatttagaaataaattaaccagggaagtatgtggttctccctcccctacccaccacttttagttgcacagaaaaattcatccttgtcactacctgtgtccaggtggtctgcatcttcagaactgtggatatggataattggaataagattacttttgcaaatataaaactcatcagattacccacttgaaataatgtaatttgaaacacttgatagtaatttttgccccataaaaatcctacgtgtttgaaccttttgctgtttgccttgctcattttaaaaccaaagtttgtttagtcctatagctaatgtttgtcataggcagcatttgttacaaaatgattttactaatttttcacttgaatttttttctgaaatacagtctgtcctattggtgctagccgagaaacaattacatgcaaatttagtgtaatagaaagtcactgaccaaacaaattcagtttggtactctgttgactaagtggtcataaagttcctgtgtgttttgcatgatgatgtgagtaccaagccacccttcgtttttaagaccccaattgtatatggcttcactgctgagagtggtacggtgtacacaattatttttcttataagaattttgtaaattatttttactttaagagaatctccatttacccattcctctgtttcagtcattctgaatttctgaccaaatttatttgagctgtactccatgcacccctttccactctttctgaaacaagtctcaggcatcattttattttatccataaataggttatctttttttttttttttttttttttttgagacggagtcttgctctgtcgtccaggctggagtgcagtggccccatctcagctcactgcaagctccgcctcccatgttcacaccattctgcctcagcctcccgagtagctgggactacagaatcacttgaacccaggaggcggaggttgcagtgagccgagatttcgccattgcattccagcctggcgacacagcgaaactccgtctcaaaaaaaaaataaataagtagttgattctaaatggagagtctagttgttttctgatttttaatcagttttcttacctgaagttattgtaggcttgagagatattggatctctttcaaattcataagtagcttgagcctgtataactagaacagagtaccactacagaggtaatgaagtacggagataggtccacttttcaggaagatggtgataagcattgattaatcctttgatttggagttggcaaataaccaagcaggcagttggagatagagatttaaagtaaggaaatggaagctgaactagatgccagaggatgccctataatcagagttccttttgttggtcagtaattttgtaatacatactgcttgaaataagttgactgcaggctatgatttttttaatgatacagctttcagggtgttacagtttttgttgaatggaattttgcccttttgtgacttttttcagtcattgtttaaatctcaatcacatagaacttaaaatgaaaagttagtgttgctttatcaaaccctttacattgacctttcttctgctaagaaataccagagtaagcttttcttgattataacatgcctagaattgtaatttagccttaaccttactagatttaaatcctggagcaaagaacagaaaaaggttattatggtctaagtttgttataaaatttaaaccaataatggatctccaattccatagttttaaaaatatttatacagtcatatgagagatggcaaataatctgaagtttttaatcactttggaatttactaacccctttgagaatataatgaaagccgagaaatctctctccttagaaaatagaataagttcatattcagaattgtgcataaaatttcaaggggttcatggacatccccatcccatttccgtctttggcctatcttgggaatctatggaatgactacaggtttaagaaggtgaaattaaggctcaaagaggtgaattgatatcaccaagctgcatacctacttattgctagagtcaaaagcaaaactgggttcttatctcccataaggaagatttaaccttgggaagttcttattcagtctcctgttaagatctgaatgtaggctacttaatgactaaattttactgatttttttttctataccttttcaaaagatccacgttttgtgttctcagattttgtgatgcctaccatcctattaggtagaaaagggaaaatgtgatattttattgtgttttaattatttctacatcacctggcttgatgtagaagactaaaacttaggttagtgaaaaagagtattaactttgaagtcagaagacatagtcatagccatagacaaagccatgggtttctgaaacaagtgtgaaatgaaatgtaaacaaaatcacttagcttattttgtggaagcttatttaaagaaatctatacttaggttttgtgtagacacattagagagagagaatcagaatgctgggttaagtggggagatgggggatggaattctgaaagtgggagcagcatagtgagtagaggagctggcgtgcgtgtagtacaatgtcaaaagatgaagccatagaaaggagagataagtatgcaattttgataactttagtaatgtagtaatataatttgatcattttaatgtataggcagttgaagggctcaagggattgatgaacgatcactctgctacataggggaaagacaaggatgtcaagaagaggacactaatgcaatagtctcagaaatagagactgaactaggaggatgatggcagtagggatgaagattggagtgatctgcaaatgtatttaggaaataaaaacatcaggacaaggatagctatcagatttctttggcttaagtcaccaggttcaattttaaatatgttgatagtgcctgtgggacattcaggtgatggtgatgttcagaggtgggaatatacacaagcatgacacttgggtagccagggtggggaccctattggagtcaacagcatttaagctgtagagtaggagcagcacagagcaaggggaggatcttggaggctaccaacggctaagctataactacatagagtactgaaattctgagaagggaagctggggagggaagcaaataataaagcatttaaaatgtcacatttaggaatttggaagagctttaaatggggtaagataatactaagggctgtagttcagaaagatcagtaattggctacaatgtagagaaattgtggtgatgccaaactgcatgattgtattgtttttctccagtagtactcagctcccaacaaagaattgagtatggcatcaagccaggatgcggggatagctctagttgaagagctagattcagagaaaatggaagaatccaagctcagaagtctccatgaagtgggagagcaagtatgagtgtgagcagcagatgtggaataattggatgatatgatcagagaaagggatgtaagagattcctgagagcagttctgggtgcaaggtatagagtgtggccttgggaattaattagtaaagtgaagagttgcattgtggagatcaaggaatcacatggtacattctatactcctttcctgagctaaaacaatggcttattctttctttggtactgacactggtttattatctttagtttttgcagattccatcatttgacaagtatttgctgagtgcctactatgagctgtgctgcacccattggcagtaagtttgcattccagtagtggagacaggaaatgaccacaaagtacacaatttaataacaactgagatgtgtgcttgaaaggaaaagtaatagaagccaggagagtatgtagcactgacatagtctggatggttgagggagatcagaaaggcttccttctccaagtgaaacattctcagataaagcaggacatgcaacagacataacagataccaaataatgtctgaactattgagaaataggaaatgatttttgttttaaattgcaggctgggtgcagtggctcatgcctataatcccaacactttgggaggctacggcaggcagatcacttgagctcaggagttcaagaccagcctgagcaacatagcaaatctctttctctacaaaaaaaaatacaaaaattagctgggcatggtgatatgcacctgtggtcccatctactcaagaagctgaggtaggaagatcactggagccagagaggttgagtctgcagcgagctgtgatgtgccactgcactccagcctgtctcaaaaaaaaaaaaaaaattgctcccacattttattccttagggacatggtggttgagctttaaggtatgaaggggaaatagttgaagggagggggaagcaaggagagtgtcccaaacagatgaccaagcacttacaaaggccctggataaagtagcatgtggccctcagaagcttcacagttcctacgaatggcggagaacaaatgagagaatgatgaaggcaatgaaataggggctgattcatgcttctgtaggccgtgttaaggatgtcctatgaacaacagagcgccattaaagagattaagatacctggggctggaatagggatttgtatttgtagaattcaatttgtgtttctaaaagatcactgactacgacctatagaatgattggagcagggtcatagtgttccatgtgagagatgacaataacttgggctggggggtggtagtagtggagggagggtagtggcctcatttgtttggaaagttaagtcagtcacgtatctttggttattataatttaaattgtaataaggagataacaagtatgaacttccttagtaaaatcagatgagtgaagccagccttcctgggttgcatccacataggagaaaacatgacttactcctcgttcttctggagaatggcccatgagggaacaaccatcattttaagtgaagaatctaaatatattacattatccagaaaggagaaaagtagtctaggtggattcctgcataactgtaaaaagtcaactgaatctttaacattttgccatttataaaattcaaagtaatttcaagacaattaatgaaggttttaactcaataaagtttgttacttaatagtttgattttgctaattaaagaaagaataccttatcccatctctctccatctagtcctttgtagaggcaaccactttaaattcttagctctttctttgggtcatttatatttctaaagaatatactgttacaatttgttaaccctagaccttacatattgaattatattatgatctgttgacttttttatgataggtaaggacttggctctcatgtccttcccctctcctcccaatatggatatatttaatgagaatttatataatataaaacaactatgtaaatattgtttaatcagagccaacacttagtgtactataaatacatgttcctgtatatgatgttttcttgtgtactttaattcctttggaatgttcttttatatcattcgctctttggagtcttcccccaccctcttcctctatcccagcccctcctccccattagttttgtatcaatgtggattcgttttccagggctgctgcaaagttgttccagacttttccttccccatttctggctggatccagagtccatctctggcatccatacttttgtccttttagcttaaaattctcggtttgcttgagcatatcctgccataacttcctaagaataggtgcatggggacaaagttttcgaattattggatgtctgaaaacgtctttagtctcatgattgatagccgggtctagaattctaagttgaaaagtttccctttgaaagcttctcatagtctcctagcctgtgctgttgctgttaagtggactgatacaattatgatttttgttcttttgtatacgatctgtgtttcccctctctagaagactttaggatattttttgtatttctggtattctaaaatttcatagcgatgtcccttaatgtgaatcttttttaaaaaactcattttgcagctgggcaccatggctcacacctgttatcctagccctttgtgaggctgaggtgggaggattgcttgaagccaagagttcaaaaccagcctggacaacaaagcaagatcccatctctattgttttaataaaattaataaaattcattttgcagggtgtgttgtaggcttatttaatctgtgtccttagctctggagaattttctttactaactaactttctcccctttagtttatttgtcctcttaaatctgtagatactgttccttttagactaattttctcagctatgttttttgctcttccctgccccctttcctttttggctctgtcttctttgagaggagttttcctacattatcttatcttttaactctaatattaaataattcattacaactatatattttaaattttgaaggttttttcttgttctctgattgctcccttcatatagcaacttttattttatgaataaatataccaccttctcatatcatctatttgttagattagaaagtagaattttcagctgggtgtggtggctcacacccgtaatcccagcactttgggaggcc

SEQ ID NO: 5605 - DNA, 757 bp, Homo sapiens
ttgacaaggaaaggccatgttatgttcaccctgggttaagttttaagtgtatcttatttaatttttttcaatatgagtcatctccagatactgtgatgatttccaaataaccagaatctagatgactagaaatttactctagctggctttagacaggaagcgtgaggacagaatccagctgcttccactccagggtaggtctgaagccaaccgtcctcggtttcctggcctgtggcatcagtctggttggattacacacaaagccctgcagatctgctgcttttcctgattctcctgtcctgagtgagtgcaaggggctcccctgtcgtcgatgtgttctttgaagcagatgctgtgcctgatacctgctggagagtcccaccgccttgagcttctgggtcgagaaaggccaagttgcacactactgagagactgccatgcaccccctggaggcctcagaacattcgacatgcttcagtcatggccacggcagtgactgctgattgcctaaccccacatgtgttctcccccttccctgataatcaagcccctgattttcagctgggcacaaaataattcttcctagaacaactccatgtgtgttatcgcccttgcagctgggggtggccaccactggggagaggcagggtgaagaggtggaaggagcctgagttagcagggatgagcagtggccaggtaaccccagacccactatcctctggatttcttttatgtgaaacaataaaatgtcttgtat

SEQ ID NO: 5606 - DNA, 1344 bp, Homo sapiens
atattctggagcagctcatgggcctagcatttcacggaccatattttgggcagtgctgctacagcagaaaggaaatgggtgacctcttccttgctggtaatagtaaggttgtctgagagaagaaaggtttgaaggggggcccaaacaccaaactgcttttgagtcattcctggggaaggtcaaggtctatagtgtgccttgtttcactttagagtcaacatctcgctatttggggggaacggactttagaacagaaaaaaatagctgcttgggagaaagagtttcactgctatgagatgtcaagtccctaaagttaaatgttactgatggaagaatacagctgaagaagagctcttggcttgactgagtagctgatctctttacaagaagggatacaagccctgcagtggaactcactgctgatccttcagacttggttctctgtgtagcatattaatgcctgccacaagggtgctatcaaccagaatcttcagtgaatcttctttgtctgaattgcacatatctcagaggagaatagagaatgtgtaaggacaccgtggcccatgcattgacactgtcatagataaagcatagttactcgctatcagttctacccacagccaaagtccaggttccacctcctttagcaagccttctcgaaggactccatgcctcactgatcttcctcctcactgaacgccacagaccaagaacccataatgtcctcctcaggaaccagcacagtcccaaagtccacagaactcaaaagaacgctggtagattgatttgctctaccatcatctcaacagtgctttcctcgggtgtagcatgatgcattttaacacaattaaaatgacatgttagaaatgttgctgatggggttgctggggcaatgacttctttcaaagtcttccctctatttactgcactcatggaagtgagtctcatgggaagctatgtcttagctgaaagcctgtcttcaaagtcctttggcaaggaagttttctgttatgaataaattagtatcacaagtaactttttcaagtgtttttccatacaattgacacttctaataatgaaaaagaatcaagcttctgactctgcacacagtggcaaatattggcatgtgtaatctggggcctgttgggtgaagatccttaagttaccacaacctattggtagagtgtctctaaattttggatgtagccagtcccaaactgacttgtaaaagtgtcagcttggacagtgtttcacaaactgggattggagaaagaccacagttctgaaagatgctgctcggtattgctcagtgctactagatggacttggtgttgagagcatgag

SEQ ID NO: 5607 - DNA, 410 bp, Homo sapiens
tttatttgttaacgctggctgtggaaaccccagttcttggggggagaaacaggactttttacataaaataggagctgcaaaagcaaaaagaatatcttctaaagatttctttatatatttaaaaacccacaactaaaaatggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaag

SEQ ID NO: 5608 - DNA, 3157 bp, Homo sapiens
tgaagatatgtgtcatatttctttcaatggataattttaagtgatattaaattatgtcaatagtttgaatagcaatagcaaccattgagctaaaattatgcaacaaatagttgcttgttaacctaagatatttcaacatttttgaaagattagtaataaaacatgccatatttaaaaagccttaatgtgaatcttctctccactgtagttcaggggacactcaggatgctagagtaatgctataaaaaaagccactcagacaggtgcagtggctcacacatgtaatcccacctactcagaagactgaggccggaggatcacttgaagccaggagctcaagaacagcctgggcaaaatagcaataccctcctctctaaatatatataaatatatatatatagataattagttgggcatggtaatgtgccggtagccccagctactcgggaggctgaggtggaaagatggcccaggaatttgaggctacagtaaactatctcactgcactccagcctgagcgacagaatgagactccatcttttaaaaaaaaaggcactgaaatgaccccatcaaatccaaccagctatgccaggctctatttccatcctatttctgaggagtttttgtccttgctgggtttcctttggcttcatacccagattctgcttgccctatataacatggatggtctgtctgtcctttgttcagtacctgctcaagatgccacttgcccagagctagagcccacgaggcaaggggcatctcttctctcactggtcaaaggtaggtggttggaagtggatattctggattcatctctccaggcccttacttctaggaaaacaaacaaacaaaaacaagcagtttctctaaattaatatgttaatataattctaaaaattagcacagaaaaattacccatttaatttataatggttttttaagacatttggaaggaaatatttctttcataatactcaaacacttaaaggttgaacattataaagaagcatcagtattatcagagatttttcaagattctgttaaattctaaacatcatctagaaagttcttgtcttatatctaatacctaaccttaatgtcccctcctttgttaaaacttttcttgactctctctcttcccgtgcctgtacaaagacatgcatgtgcatgggaacacacacacacatacacaaacacacacacacactagtaatcacagcctcccttttgccagcatgtatataacataatttttagcattttcccacattaaagaaataattgaaagcttatatatttattccccaaagtagatatctaattatttaaaagaaaggcttatatttaatgcatctatgttttcagggcttgaataaaagtctgtttagcaaggttttctttgatggaattatttgattcatactggaatctctggttcatttttctgtttacagaagtaagttcagattgtagtatattgcacagattgtccaggtaaacctggttaagactttcaggggaacttatttttgctgctattgtgatgtggaaatgctgttactacttcagtaacactgatataatgtatgtacttattaacaagaaatgtgtagatagtagctccagtacttgaagcatcattaaatttgaatgaattttctatttgtaaatatactctgtcataaataccattgaatatatttcactatgtaataaattttaaaatcaaggaagtaataaatcataacatttaattttaagattaagaatattggcaaagatttgtttatttttacctgtctttattcaaatgttctaatatacattagttccaagttctctattacttctaaatagaatatacatgatcaaaagagtatgcctctttctaaatgagaaaaactttatattataaatccagtgatacggatactatccatcattttgttttgtatggcctaatgtatatcagtaaactaaatagacttaaatgtggctggattttgactgggaatatgggaagaacaaagcaggtgagatcatgtatgtgactaaatatagcgttgatgcttaacgatggcctctgagcatgttagtgtaacttatattttgcagccaaaaactgtatgtatcaagctccaaccatctataataaagtttatggttcagttctaagattgctaaccaagtgatttttttttcagagacgttaaagaaaaagtaccttcaaccaataaattcttaaacatttcatcaaatagttattgaacagcactgtgctaggcacgtgggatgtgaaaatcaaagaacacatgaccctacccatagcaactcagtgataacaatgataaaggactatgctagattccacatcgtacctggagtgggggcagaagtggtacataatccagttagggggtgaagtggaaaatccagggcaagtttcgtggaggaagtgatgcctgaaatgtatctcaaataagttagcagagctaaaaaaaaaaaaaaaaaaaagaaaaaaagagtagaagttaaagggaataaatggaaccgggtgtagaagggtattcagaacagaagaaattatataagcaaagacaaagaagcaagaaatagtatgcatgtttgggttcaggagaagatggtttgactagaaagtttaacattagaaataaaattattcctttacaaaaaaagaaatacttaaaagaatatgttggttttcaaaacagatatagtgatttttgcttagttgcttatacatcttgaaaccaaaactggagttcagctatttattgtgttcattttagcataagcattacaaagtccttctctagttaatcaggttcacactttgcaactaagaaaacagaagtgggccaggcacggtggctcacgcctgtaatcctagcactttgggaggccgaggcaggcggatcatgaggtcggaagatcgagaccatcctggctaacacctcatctctactaaaaatacaaaaaattagccgggcatggtggcaggcgcctatagtcccagctactcaggaggccgaggcaggagaattgcttgaacctgggaggcagaggttgcagtgagccgagatcgtgccactgcgctccagcctgggtggcagagagagactctgtctcaaac

SEQ ID NO: 5609 - DNA, 2271 bp, Homo sapiens
agtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagttt

SEQ ID NO: 5610 - DNA, 1541 bp, Homo sapiens
tcttgctatatatatggcccaggctggtcttgacccagcatcaagtcgtcctcctgccttgcgctcccaaagcactgggattacaggtgtgagccaccatgcccagccagatctttcttgtttttgatgtaggtgtttattactaaatacttccctcttaaaactgctcttgctgcatcccatacatttttatatgttgtgtttctgttttcactcattttaagacatttaaattttgtttcttaatttcttcattacccattggtcattcagaatcatgttatttaatttccatttatttgtgctgctttaaaagttcctcttgttattgatttctaggtttatttcattgtggtcagaaaggtacttgatgtgattttaattcttttaatttttgtgatttgttttgtggtttaacatgtggcctctccttgaaaatattgcatgtgcttatgaaaaaaaatatgtattctgtagctgttggatgaaaagatctgttagtgtcttttaagtccatttggtctaaagtcagtttaaacttggtgtttctttgttgattttctatgtatatgatctgtccattgctgaaagtagggtgttgaagtccacaagtattattgtattattgtattgtcttcccctttagatctaataatatttgccttacatatctgggtgctctgatattgggtgcatatatatttacaatttttgtatcctcttcctgatttcatccctactgtgtttgatacaaagtctcttatcaaatttggatatatcatcccattttttcctggcctgtgaggtttctgctgttattctaatgaagattcccttatatatgacttgatgcttttctactggtacttttggatttttctctttgtctttgacttttgtcagttcaaatataatgtgccttggaggtgacctttttggggatctttgagcttcctggatctgaatgtccatatctctcgcaagacttgggaggtttttagctattatttcattgtctttttcgttttcttttatttttaatcttgctgtgatctccttagcagctataatttcattaaatatgttttatttttttaatttttttttttttgagacagagtctcgcactgtcgcccgggctggagtgcaatgacgcagtcttggcttactgcaccctccgcctcctgggttcatgcgattctctggcctcagcctcccaaatagctgggattacaggtgcacaccaccacacccagctaatttttcgtacttttagtagagacggggtttcgccatgttggccagactggtcttgaactcctaacctcatgatccacctgccttggcctcccaaagtgctgggattacaggcgtgagccaccacgcctggcctgttttatttaaaaagttgtattaaatatatatttttttctttttttcttttttttttgagacggcattttcacccttcttgcccaggctggagtgcaacggtgcaatcttggttcactgcaacctctgcctctcaggttcaagtgatt

SEQ ID NO: 5611 - DNA, 717 bp, Homo sapiens
ccctctcaggagaagctgaaggactttcctgtgtgcgtgagcaccaagccggagcccgaggacgatgcagaagagggacttgggggtcttcccagcaacatcagctctgtcagctccttgctgctcttcaacaccaccgagaacctgtatggccagagggcagggccgaggggtgtgggcgggaggcccggcctggcttagtggggacccagggcatcagacacaggtacagcacataggccaggagccagggggtgacgggtggctcggctcgggaggcctgggaccccacagtgcacgctgtgcccctgatgatgtgggagaggaacatgggctcaggacagcgggtgtcagcttgcctgacccccatgtcgcctctgtaggtagaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaag

SEQ ID NO: 5612 - DNA, 2233 bp, Homo sapiens
tctttgaaaaaagatgtttattaaacaactttaattgtcataaaatgactaaaatgggttttaaaaattaaggctcttctctttctgtggattgccagaacaatgtaaaaataatatcaatcaaccctgctaaacgttttgttcctaaagttaaatttcatagattcctaaacattttatgattaagataaaaaattggactataaatgacaattcatggccatctgtgctgaacacacattgatcaggtgtacaatattctaattgagtagttaagcaaaaaatattccagttaaagcataaattttaatttcagcattttaaagtcattgtttccccacatggtcatgattttcctaaaattgaaatagtctaatacaggagcgctaaccttgggactctatatactcccaggaggatgactgacttggctggcaattagtttgattatatttttttaaatgctctaaggtaaattatcaaatgattcagaattacatggcatgcagtatccaaaattatggctctgatgcattgagatttacattaagaataagaagtgtcattcacattcattgtacaccccacccctcccacgaaaaagaaaaaagtcactacctattcaagttctagatctggtgcagcattaaggattaaaacttaccactttaccaggccttccccatgtgcaaataaatccctcctgacaagcagtgactatacagtcttcaagaaatattagtacagtcagtctctcatgtgctatctttttacatatcagcggctctaacaagggaacatcttccattcgaggacacaggggcgttcccagagttttagcagggtccgttttggttttggtaactagattcagtttgtcactgctcttgctagaaatgtgtcccatgctatgatttcgcttgtgatctttctcgtggtgcctctccttccggtcatgtagtgaaagtgttgcaaatttgctgaccccagaagcaatggccccgtccatgacactgcttttgctgccagcatttgagactgctgaatgtggaaggctgttggaccgtggcagaggaggcggcacagagttcccgggtgttgtaacactgttcccattgcttccagcaggaggactcgtggcattcatgacatttgtgtgtgtccttgctcttgagaggggttggtgagggaaaaggatatcttctgtaaggtcccataaacagagctgtgtgtcctggcccacggaaccaaaccgatacgtgacacttacggggcggctgtctgtagagttccgtttggagagcctggactgtgtactatttgctcgatctctgccaaaatgaagaaggtcttggaagtcctcatcgctgccactaaactccatagggtcaccttcttctacactagtggtataagggtcaaacgctacaacactgacccaggacttgtgcccgtggcctctggctattactcggcagtctacaaaggaccagactgtcaccaagtcgtcctccccacctgtcacgatgtacttgccatccgggctccagcacacacacagcaagcccccaaagtagcttttcatcgtaccgtgcagctccactgagtcaaagttgaacacccgcagaaacccgtcctggctcacgcacgctaagaacttgccatctggggagaaagcaaactcgttgagggccccctcgcccaccgtccacttaaggagagggttcctcgtggatttgctcttgcaagtgtgcacggcaaagctctctccctgcttcagaagctggtagtggggggctgtggtgccacaagtgtgctccacattatataagtacatgttcccactcgagtgggctactaggaaaaggctttccgaaccgggaacccatttgacacaggtaactcgtgacttgtctattagtctctggtcggtaccttgcggacccccttgtagatatagaagtacagctcccggcccacattgaagcagaggcggtcgccgttgccagactggtcgttgaggtttacgaaggagacgcggacagggttggatccctgcgagttgaagggcacccggttgggccggctgtactccgagtgcggcagcagcttgtacagaccttcccgggtggtgaattgggtcttaatctcgttcatctccttccctcctccctccgtcgccatcttggaaagcagcgttcatcctgccctaagtgcccggatcacgcccacc

SEQ ID NO: 5613 - DNA, 2529 bp, Homo sapiens
aggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcat

SEQ ID NO: 5614 - DNA, 2750 bp, Homo sapiens
ttttagtagagacggcgtttcactatattggccaggctggtctcaaactcctgacctcatgatctgcccacctcggtctcccaaagtgctgggattacaggggtgagctacagcgcccggcctacaaaattttctagttaaccatcaggcaatcaaagcaccccactctgccaagcgttctcagtgacaagggtttctgtgctgtcaggctgctcagccatgctccctgcactctgcgccaccttcccttgcactaggtgtgctacttactagctgtgcggcctcagtccatgccgagcaagggtgcagggaatgagctaaggcacaggaagcgctcggaacagagcccggggtaaaggtgcgcggtcacggtaagcactatgacagcccgaggtggcagggtactcaccagcggggcctctgactctgtagccgggccctcattctgtgcctcatccttgggctccttgaccacctcctctttgatggcttcttcctccttggtggcttcttccttggccgcctcctccttctcaggttcaggtggggacacgaccttttcaggaaggctcagtagcatcttataaactctatagccaaaatccctctggagcatctccagaaacagctcggccagcaccatcacctgatggggaggtgggagggtccatgagcatcaggaagaaagactgcttcaggcccacaaatcccagcccacagcctccccaagactcttgacacctgcctcaaaagagatcctttcctttggcctccgatcctccacaatcccatggagggacaggtttacacagccagggcgtgcgatgacagcaggttctagggggggtggaggggcctctgggagatcagtgtccgtttcctgctgtgtggtggcctctggagtttctgcgttccgtctagaagtgtctgctgcttgctccaaggcatcaggtgcctgttcagtaggctccgtttcctgtgacaacagctgaaatgagaccctctgggtcccgggattaggccacctatatcccccgctgctggctaaggcacagccttaccccttgtgcctcctgggttgggggagctgcctctgcagctttctgctggcacagggcctcccactcctccaaagtaggcatgatggtccagacatccggcaggtacaccaccactgtctgaagccgccgggggggtcccggctgcaggtactgaaactcggcaaagcgccacctgcacatggcaaaaggaggtactaacttctttagtgacaactccacgcagacaccacgttcacaggcaagggcttcagtttccagtcagcactcaatgagcacacactgcgaaccaagctttgaagacacaacaggaaagctacagaccaagtcctcaagaaatgatcagtcagtggggaggccgcaaccacacaagcaccctacaaggtgcaaggacaactccagggagtctcaagtgcagcctggtggctcagccagattttggcatacaccccaccctaccctgaggcaccagagggggaaggaacgggactagggggcagagagctaaccagcagaaaggggcagggaccgggccttcccaacaaaacctccccaacctggtgcgttggtgcagctgaggctcaggaagcccactcaccacttggtacagccgctcaaatcaatgccagtctgggcctgcgcacagcggatggcggtacgcaccagcacctgcgggtcagcctgggggtcgaggccatccagggaaggagaccattcacccccaaccagcactgcctcctcttctttcctgcccagcaaaaactgcaagaagagatcagggatacaaaacaaaaaactacattacctgggtctcccactgcagggcaaggctgccacccatcaggatgaaggcagccggaagtggggaagtccaccacacagtgaggtctctatctgcaaacatgaaccagccacctcgctctctctgactagtcgtaacagctctgagctgcaccttcctcctgggtgaaatgaggggtgttcggctctgagatgcctcgttttatgcattcaggaacaggagccgaacactcaaaacatgacaggttgtgcacattacccgtgaatgcatctcctcctgctctccagctcttaccttaatctgcttcagaggatgctctggcgtctcccttggctcagccatgtcatccacaaagagcatgcaacaacgatacaattcctccaaccccggggaagagagcagcagtacctgtgcaggaggagacactcagagctgccttcagcctccagaaatcagataagtgagagacgcctgtcagcttaccttcgaactataagcggggtcactgtctgcagtgatgggctcagcaccagcgtctggagctgcctccttttcagaagagacctggatccggcttggatgatggagggaaaagggctggctcagggggaaggctgatagccaactcagatgcacggacagaaaatctgaggggaccaggaggctgcggtaacggcgctggagttctaggaagtcacagatggggctacaggaagacagcaagggaatccagactgagcaaagactaaaacattcgaaatgaaaccatcaaagatttgaaaaaatgggcgaattttttttcagtctgagaacttttgaagtaaggcacctctcaaggaagctagatcagatctgaccacttaatttacaaactctagatggcaaaagtc

SEQ ID NO: 5615 - DNA, 4439 bp, Homo sapiens
tctaacagctttgttgaggtatatctgaaatatgataaaatgcacatatttaaagaacaccatttgataagttttgatataggtatccacctgtgaaaccagcagtcccctctcaaccatccccaggcagccactgtagacaaactacattttctagagtcttacaaagatggaatcatatgctatactcttctttttcttgttggcttctttcactccgcataattattttgaaattcgtccatgttgttgcatttattgacaagtcattcctttatatggctgttaactcttccatttaattcactctaacttaacttagctataatagagagctgtcaagatcaagagaattttagaataagcaggagcctcaactacttacatcttctttttcttcggcatccacctgggcagtatatttatcctctggcacgggaaccttcagcgcattaaactacaaacacaagggcacgggaaccttcagcgcattaaactacaaacacaaggacagtgagtcgtcgccaatacacccaggagctcaaagggctggaagctacgaatccttaaaggtcatactgaaagacattctgtgtcccaagcggaaacgaatacgcatctcaatactggagtagaaagaatattagactgggaacaggagctcaagggtcttctcagccctatcactaactcggaaccctggacaattctttatgatgataagcttcattttcttcatctgaaaaggacagctggacttgatgaccaaaaaatggcctcttagcaccttgaattgtaaagaaattctgatttctcttctgcatggaaccctagggagctgactggtggaaggagcactgcgtaatgaatggtctccttagaagactgcttagtgttagccgggtgcggtggctcatgcctgtaatcccagcactttgggaggctgaggcgggcggatcacctaaggtcgggagttcgagaccagcctgaccaacatggtgaaaccccgtctctactaaaaatacaaaaattagctgtgcaaggtggccagcacctgtagtcccagctacatgggaggctgaggcaagagaactgcttgaacctgggaggcggagattgcagtgagctgagatggccccactgcactccagcctgggcgacagagcaagactccgtctcaaaaaaaaaaaaaaaagactgcttagtgttatggctccagcacttaacactacctggcacagagtaggccctccatacacatctttgaatgaataagcaaatgaactctggatattgagacttgtgtaaatatcagaggaggatagatggatgagaaattacagctataagggacagttaaaaaaagcagaggctgggcatggtggctcacacctgtactcccagcactttgggaggccaaggagggtggatcacctgagctcaggagttcgagaccagtctgggcaacatggcgaaaccccgtctctaccaaaaatacaaaaaattagccaggcatggtggtgctgtggtcccagttactcggggggatgaggtgggaggaaggcttgagcccgggagaaagaggttgcagtgagctgagatggcgccactgcactccaacctgagtgacagagtgagactccaactcaaaaaaaaaaaaaaaagaagagcagagaggtggattgcctgagcccagagtttgagaccagcctgagcaatatgacaaaaacctgtctctaccaaaaaaaaaaaaaaaacaaaacgaaaatttatcaggtgtggtggtggcatgcacctgtagtcccagctactcaggaggctaagacagaaggatggcttgagcttgggaggcagaggctgcagtaagctgagattgcgccactgcactccaccctgggtgacagagcaaaactccgtctcaaaagaaaaaggacaggaaaagagtagaaaaaaagtcagtttgttccaaagggagacaggaaggaagctaaaaggaacccaggaggtgggcaaacatttaacttgaaagccccctggggcgtggtggcgcatgcctggctgaggcacgtggattgcttgagcccaagagttctgggctgtagcgcgttatgccgatcgggtgtcttcaccaagttcagcatcaatatggtgacctcccaggagcgggggaccaccaggttgcctaagaaggggtgaaccggcccaggtcagaaacagagcaggtcaaaactcctgtgctgatcagaaagccctctggctcccagattaaggctacactctactgctgaatgaacagagcctaaattcctgcacctatttacagttcaatcgaccacaaggcctttggccatacgcatccttcctaagcttccttagggatctggctgtcatgctgtgtatgtaattatccctgttcctgctccctacccacaggcatgttacaagctcagtgctttagaggtgtgaagtctcaccttcttctcaaagtcatccaccaagccagccttggccacattggccttgtagtaagcccagtcgatagctggtggattctcaggtaaagcagccaacctgcccacaaggaaaggcaaaagttaggattgttcataagcagtagaaaattcacatggtaattttcctatcccttcttcctatggcctggagggtcaccacactttcctctcctaagatcatcatgaaaatgcaaggatttctttatatgttgtcataagggcatcaagaattcatatgtaattccttaatactgttttgtttctagattcagtggcaagtatggggttccctctcagaaacatactgacctggaggtgagggtctcattccaggatttcagggaactagcaatggccttttggttctggggtatgatctctgcaaaagctacccagtcaatggtttttagagcaagttttcgcccagccattttgggatcctgaaaaataagtcaaataaaaacaaggcttttttatgaggtgaattttcagttgggaaaaatgataaataacaaaataagagctcttagagagaatcctttaaatcttagaaacatgcaagtcttcacaagaatcacttgaacccaggaggtggaggttgcagtgagtcgagactgcatcactgcactccagcctgggagacacagcaagactccaactcaaaaaaaaagaaaaaaagacagtgtagcttttcaaattcaaggtaattcaaggtgtgcggccaggcgcagtgggctcacgcctgtaatcccagcactttgggaggccaagacggttggatcacctgaggtcaggagttcgagaccagcatggccaacatggcaaaaccccatctctattaaaaatacaataattagccagccgtggtggcccgcgccataatcccagctactccagaggctgaggcataagaatcacttgaacccaggaggcagaggttgtaatgagctgagatggcatcagtgcaccctagcctgggcaacacagcaagagtccgtctcaaaaagaaaaggaaaggacagtgtagcttttcaaattcaaagtgtgcaatgtggcatacaaatacattctctcccaactcctatttagccttaaaagcccagctctcttggccgggcgcagtggctcatttctgtaatcccagcactttgggaggctgaggtgggtggatcgaaaaatacagaaaacgactacagccacttaaaaaaaaagtcagaatataggaaaatagtcctctttaagtaagatcagggtcagatattaaaagactgcaaagtcaaaaatctctataagcttggagtggaatgcaagggaggcggaagcagtctttctcaggatcttcctgatttcccgcaacatcagtggaaaatggaagtcacaaataactttgtgtgtgtgtgtgagtgagacggagtctcgcactgtcgcctgggctggagtgtagtggcgtggtctcggctcactgcaacctccgcctcccgggttcaagcgattctcctgcctcagcctcccgagcagctgggattataggggccttccaccacgcccagctaattttttgtatttttagtagagactccttcccacactgcgcccacctgcacccacgagaacgcactccacaccccttctccatattctctgcccctgacatcccactgagatctgcatgagttttccctggctcctcttcagtccccccactgccggtgccagatgcatccagaactgggtcagggttagctcaggcatccttgtagctttctcagactccctctcggacccctctgccaagttgggcttccacagctgcaggaagcgctccttgtgatatcacactgcttttctatagtcctggtcgcagaacttttatctgttaacagtcactggtttaggtccatatttagatcaaatgcgttttttgga

SEQ ID NO: 5616 - DNA, 1977 bp, Homo sapiens
agacgcaaaagcgtcgtctgtggcggcagctagacatcgggcgaccctcgtcccgccaggttttggggtcgcgcaaacgagcgacgggggctggggctccggattcaggtgttctttcttcagcgctcacgggtttctgtccgtacgcgatgcgagcgaacgtcgcggtcgaggctagggccccgaagcccgcagtaatccacgtctcccgcccgctccgggcccccagtgccgccgtcgcgggcggaggcgcgaggtctgggctttggcgccttcgcagccgcaggcgacatcctctttcctagctaaagccccaaacgcccaggtggcttcctgggagagcacggctgagcctccgccttcagatcagaacaggcagagcctccaagggcggcttgggcccagtgcctgcttatcctgcccgtctctccacacttcttctttccctgtccgttggagtccattccttcctggaaaagccaaagccgcgctcccctaagaggcctggatgtgaaggtgagtgagacgccctggcctctgggtgcaaaggccggcgcctgccgctttcaacactcaggaggcgcgtttcagccccgctggcccccggccgcagactcggagcgctgagctcccaccgttcccatcacccgactcccttcccaggaatgaggagcacccgggaagcttcagccactacacgaaggaggcgccaagcccaaactcctccccagctaccggcggggtcagtgcagagccgcggagggcacacatgaaccctggcacgcagcctcagggaggggcaggctggaaatgaccctgcctgcagctgggccatcagcctgaccacctgccccctgagcaaacgttgatgcaggtcgggcgcggtggctcatgcctgtaatcccagcactttaggagcccgaggcaggtggatcacctgaggttaggcgttcacgaccagcctggccaacatggtgaaacaccgtcgctactaaaaatacaaaaactagccaggcatggtaatggggtgcacctgtagtccagctactcgggaggctgaggcccgagaatcgcttgaacccaggaggcggagcttgcagtgagcggagatcaccactccagcctgggtgacagagtgagactccatctcaaaaaaattaattaaagaaaaaacgctgatgctttctgaaatacattttattatcgctgtaccattctggggcactggagatggcagctgagaagcagagaagctggagacctgaagcctccacccttggctgtggctgccgagagaggcccctgcagagggagccccaggccacacccagacaccacagccagctcacagtgcggccagagggcacaggctgcttggggggtgagggtccccattcctgccacctctcacagaccatgacccacagggctgggggcttcccctgggagaaagtccttccctccccatggcccagccctggggaaagaaagcagagactaactcagggactgcagtaggctgaggacaagggaggtgggcttggggtgaaggccccccctcactcgcagagaagggacactaccggcagtagaggacagggaggcaggacgacggcagttagagacgaggcgtttcaggtgaactgtatgtagtgttactccggacgtgagcatggcctgggtcagtcgaatgaaatgagctgggcctcgctgccctgtgccggcggcccctgtgcctgcggttgctgggccacggggggctgctgctgggggggaccgccagagggtgccatctgtgcaggaggaaagcaggcatggccctggtcctcccttccccagcccagggaggaaggcttttgtcccagcagagccacagacccacaagtgcttgtaatccatgtccacggactgcagctcatgcagccagctcatgcggcctttgcctttcaagtaaattcacggtttttcctgtctaca

SEQ ID NO: 5617 - DNA, 1766 bp, Homo sapiens
cttcataaatgttaacatgttactaaggatcagtgaatacagccctcctcctttcttaggtttcccaccattttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggaggcgggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaagtagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactctgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtggactttttcagcacttttaatccaggaatggagatagtaaaaactctcccatacttgaaatctcagttttcttcacctcctacatacctgctcccttgggggaaccatccagaaccatacccggtggactgcagcttgagaagaggtggggaagctcagcatgtcagccagatgaaccatggaaactggagaggaacacaggcgataaggaacagtgactgtgtccagggctgtagccaggatggcactgcagtggaagggcagagtggcctgtaagaagacaccaagatgggcacttggcctcaggcctggaaaagaatgtgtggaggcagaatattaacaccagagagacccaggggacgaatcaggggtatgtttgaccccaggctggacaagcataggacagtgtgatctgagaggccacatcacagctgagttcaagctcgggcctcaagaacagagccagtaacagacagcggctgactgggagcatgaggaggccctgtagcctgccgcagtcagaacaagagcaccgagacttacatcataatgcaggtaagggaagctgacaggtggctcgggtcgcaggcccaggctcccacccaaggacaaggggcagacaagagagctgtgagcagtcaggtgcacgagaccaaaagctgtgtttaatagacgatagatgtttctctg

SEQ ID NO: 5618 - DNA, 1466 bp, Homo sapiens
ttggtgggcagtggcctttcagacccttacctgtcctttgcagcagccatgaacgggctggcagggcctctccatggactggcaaatcaggaagtgcttgtctggctaacacagctgcagaaggaagttggcaaagatgtgtcagatgagaagttatgagactacatctggaacacactcaactcaggacgggctgttccaggctatggccatgcagtactaaggaagactgatccacgatatacctgtcagcgagagtttgctctgaaacacctgcctaatgaccccatgtttaagttggttgctcagctatgcaagattgtgcccaatgtcctcttagagcagggtaaggccaagaatccttggcccaatgtagatgctcacagtggggtgctgctccagtattatggcatgatggagatgaattactacacagtcctgtttggggtgtcacgagcattgggtgtactggcacagctcatctggagccgagccttaggcttccctctagaaaggcccaagtccatgagcacagagggtctgatgaagtttgtggactctaagtcagggtaaaactggagactgggggaaagtgactaccagaaagtgaggaagcctaaataaaaagtatacttttgtttcagggggcctttaaagacttaagattaaattatatctgaggcactgataatatgtttgaggttaaaatataaattaagactttaaaagatgaaaaatggtcccttcttccctaatcagctcctttcccctgcctggtatgagttgcccatcacaggcatggtcctggaggatgaccaggactaatgcatgtggtatgagtaggtttggccccctcactatctctagagtgagaatctggctcctgtttccatggctcaaagccggttgcagagaatctgcagtcacttcggagctttagcttcttctctgccaagccctcaataagccagcaaaccaggactctgccccttctgtttccataggaatcatgttggatagtcagctgtaccaagccccttggccttcccatgcacacaaacacctcctagcaagacctgttggttagctggacatgctttggcaatttttttatactgccaagtgaccataaaggcatggcatttgttgtgactggcacccaatgtttgattttttttttaaactatccaattaaaattaaggtctgggagtgttctgtttcccattactttaatactcacccccctcccagactttctacacctgtttcacctcaggctgaggatgttctggacctccccctcttagtccctactagagacctctcaacagatctgtgggcccagtcattgggttttatcagtgcttaatgtgaactaagttttttacttccaacagaatacaagccactaccttctgacctccccaccccccaccaacccccagcttttaatatgctgtggggc

SEQ ID NO: 5619 - DNA, 3598 bp, Homo sapiens
tgtgccttctctccagtgtttgtctgaagagacttccaaaagaggtaccaaaggaagccgaacccatcccctggcctcagaggggtcagaggttgggagggacacgctggtctgaggatggacgcaggagcgcactcccccggctccctctctggtgagacccctccccactggcaccccacccgcgggaagcagagccaacactatcacaccccactggtcccaggccagctgcccagcccgatgccctgcccttcctttctcagggctgacaggctttctgggctggagttcctcatctgtgaagtgggggttatgttaccaacctcagagggctgtgaaaatgggacggtgtctgtgaactccctcacatactgcctggcccttagcagagctcctcgaaatgtcagttctttgctgcccggagccaggctcctggtaatgaccagggagagagcctgcccttgaccaaggagtgaaaaactgacctcaaaatgtcagttctttgctgcccactccagcctccacccgcttctcacaatcattccctgagcgcgcagcagctcacacggaacagagttcacacggactcatcgaagtgcccgtcattgggcatccctctcctccttgcgtctgtttccttatgtgtaaagtgggggcaggaccacttctgaggacccagttctctgagcactggggatgaggtgggctcctggcccagccacccctctccctgccagtgatgccagagaccccaaaggcagagtgctctgttctgctgttcagctacaaacagccaatccctcccttcaccctgtgtgtcccacccccgctccccaaccacccaaggactcctgcacaaagaactgtggtccaaacccccaagtcagctgggaccaggtgattttggtagccctgcatcctggcttccatccaccccagcctctgtctcagcctttgcaccaccatcccagacaggcatccaccttctgtctctggccctgcttctacccccactccacctgccctcatgtctgccttccccttctgcacccctgctgggctcctgaggaacaggatggaaggagagtgtgtcccctacccccagcttccagtctcaggagggtcagaacagacaatacaggtcaaagcagcaaggctaagggtgacaggtacacaacgctgcagcccccagatctagagacaagattaggatttcggtcagagggggatgaagcacacaccatccccactcccacccagcaccaccatccttccccttcctcctcctgggtcagggtcgaaaagtggagaatccccagaaatcctttagagtcctctgatgaagcctcccgagtcctgccttcgagccagtggggagggggagaggaggatgattacagggcggcccccccaggggcatctcaagacactcccaggacagcatggacaggcatggaccctcctgccctgtggctcctgccaggacccctcccctgagctgcccagtgggtgaaagtgggcagtggagaaagaaagtccagggtcaaacgggaaggtggcaccccctaccagcagaagcccagaaacacgagcagagccaggggcccctgcagggctgctgtgccccttctctcttcccaaataggagtgagcacacctggacctctgagagggcaggagggtggctcctctccactccacggacaaacaggagtggcctggctacataaatgtgtgccatcctcactgctacctttggaatagcaacttcgaaagggaaccaccctttgggaaagaccaagggtcccaggcctgccccgcctatcactccaaagctcctccttggcagtacccgccccccacccctctgctacagtgggggtgacctcccactgtcagacagtggaaggggctgcttgtcagaaggacaggccttccgtctccactctttgcccctgactggaatacaagagttctgtggcccttcacattgtcacagggctatcgctgctgctcaggccctggggacccgccagagtgggacaccgtgctccaacacaggtatgtgtgtgcatgactaacacagaacttgcctgaagactggacggaaacttagaagccagccctgggtcctagagcgaggctaggactgggcacgtagagggaaacagcacatcccttcctgaagcccctttctaaggtaggcactggggtgcccacagctgtggaggcagaacgggctgaactctgtatcatccctcctttgcccctggacattcttgggcagtgtcaatggcactgaaaggccaccagctggggtttggcaagactaagggcctggaaagaaggaagggaaggggtgaggcgcttctccctccagtcctggtgctggcatcagtctgggagctgatgggatgaagaggtgacctctgaattcagcctcttgaatcagaaggcggttctcaaattgggctgagcgcattgctaaagagccagccctgagcacaggtcagagggaagagaatacgcactgccccaggccccttgcaggccttagcaccaaaagtctggcaccagctggccaacccccaaaatctcatacccccatccatcctggctgactggaatgggcagtgatggcagccagggacagcccaaagagaactggggccctgatacaggacagagattcaggccccagactaggccctggagtgggagtatgggaggaaaaagaggccttaggtcccaggctggggcattgtggggaggaggacgggcaaaatgcaaggcatgaaatggggagggtgtcccttccatccttcctcttgcaaagggacaaatggagagccaaaggacaggggcccatggaaggccccaacactgagaagaaagcagcaatttggccaacatctgggggttccaggggagcaggcctgctcctcggcagagggcagctgcaaggttccatgccaccccatggctgtcccaggccaagcctaagctagacctggctgtcctgctgccatccagtgctgggcagcggtgctgggactcatccccacagcacgacagagtgaccggtctatgacacaaaggagctcagggccccttgaggtgaagcgaagggcccagctcctgctagaagacatagatcttgtcccgctgcacagtatccaggtcgtcatccagtgtcagcaacacctggggtgtggacgccagatcagccacagagaaggaggcagctgctaccttcacgtacccacccggctcggccgggaggcccgcttaccaggaaggacccgaacatggcgatggaggagaggaagtgccagatgtcgtggtcgtcaaagaagtcgaggaggatgcagtcccggttgtgctccctcgactctgcaggggttttcttggggagcaacaagaaaaactgccgaatgaccctgctctggcagggcaagggccagacccatctgccatcttgctcctgggcacccctctctccagccccaggcaggacagcagcaattctgacctgtcccttgtccttgtccctaccccttcccgatctaacaaatggcctttggttacaaacttc

SEQ ID NO: 5620 - DNA, 2972 bp, Homo sapiens
cccttgccccgtccctgcacagatccaggctgtctcttgcggtgcgcatgcacctaccgtatcgttatcaacgtctccgaggcagattgcgtgcgggaagaggctcccgctgaactccagcgccacgcgctgcacgtagctaactgacctcatggcacctccaagagcagagggagcggagaggcccagtaaatattccctgaacccccgtcgcgacagccgccagagcggaaggccacctaaggcagcaagttacgtcactgcctgaacctccaatctctgcctcttcctcctttaaccttacagaggaggcgggtcttccgggcttggaggcgggcttcccaactctgatgtgagtgacaggcccacgggccactccttttctccacagggctgcagaccgtgggtaaaccaaccctgacgggggtcgatctgttcccttggcaacagggctcccaagggcttgacctaataaccttgacctttttcctttgtttccctggcaatgaagattcctagccatcagaccattcctgagaatcttactaatcttcgtaataactgataattgcatggttttgaaaagtgtttttaaaaaactacccattaggagtgaaaacaatgtagtgagttgcaatcagcatataaaaaattaaatacaatagtaatataccaagtgactcccaggtagtaaggatgcagagctggaagaaacctcaggaatgctttcgattttgcagatgaggacagaagcccaggacttgccaaaggaacctcatgggagagtctggattagttcagagacctcacctttccatttaacttctgagtcttggttttcttatctgtaaatagggttattaaagttataccttctttgtaggatggttgcaaggattcagtttcactcatgtgatgctgtcagtacagtgctaggcttactccataaatgcttgagttagtgattattgttggctgcaggcgtaagaatctactacttttgaaataccaagaggacccagacacaaaccacaaacacagggctgtgatgtgaggtaagcccagtaagaaagcagttacacagggacttttttaaaaaagagatggtctcactctcttgcccaggctggcgtgcagtggcacagtcacagttctctgcatccttggtgtcttgggctcaagggatactcacactgggagacttgtacaccccaattttaatcctggctccagcatcagctgtgttgtatgacttggtgaaaattttcacacagaaatacatcttccaccattatacatttcttctggaaggaactatacaggcatgtggctaagcagacaaccacatcgctgttgggaaaggactggagagctcacagtaggagagagggatgagggcagacacgggctctggcctggagccaggattatctggaggcagctcagcatgactggcttgtgctgcctggcttctcccagggccccatcatgccataggagttaagggtcaaagcatagttagaaaaaaagcacaagccttttcctgttaaggctgagaaggaagctggacgtgaacactctgctttactcttaaccttaatcatgtaagttatctgacaggaggaggtcagtgacaccaggagttttaccttgttaacaaaccaaaatgcagatacctctgccagatcagaggtaggcagaagaccaattccaacttcaaaatgaacatgcatggtgtcccagtcttctagatctttatactttcgtcttcctaagtgtcagggaagaaaaccagaggcactaaaactgccaggttgctggagggagggagtgctgggaaccttgggcgaagccatagacacaaatcccagcggcagcctgtgcagtgctcaggaagccatgcatggtggggctgcttcctgcccaactatggcatctacatgagatgctcacttatttaagctcaactggaactaagtgggtgaccccttgattgtgctactacccattatgtacccacccatacccaccactccaaggctgaacagaaagggttgtctgacacccaggttttattgtttccactttattgctcaagcatggaacttgaggcaagcctggaccttcagcaacgtgcagagaagaggctgaggggattttgggacacaacctggccgagaggggaaactgacaggggaaataccagaacagggaacagggggtggtcaccatgacaccagaagacatcatcagccacaccgtcgggggtgaggaagggaacagagagaagaaatggcatagcagtggtttttcccatgtccctagcacccacatggaggccacatttggaaatggactgggagagggaaaggatgaggaaaacggctgcccaggagtctccctctccaccctgggttcttatcagacctcatccctaccacttgcctcttctacccttagaaaatggacctaacagagggagcaaaataaattaacattctgatgaatatatatggatggacatatgttcatgtgcaatggaggaagggaagaggggctgacaccagctaaaatgattccccacctcaatcccccagcctacacctttcccccttcccctaaagccaccatccaaccagatagaaaaataaaggtctaattcactcaaaattcttcagtttttacaaaactaacagggtggagtggggagactggggggcaggcagccgcaggagtagggctggtggagaggggctatgcttctgtctccacctgagactggctccctgccgtgttgctcttctgctcctccttcatctctgtgtcagtgggatggtctcctgaggaagcctctgccttggcctgcaaggaagatgaacagcaaacgggctgacttcccaagtgaaaaaacacacacttaatttccagcagaattacacagatacacccattctcctacatctgtcctaaag

SEQ ID NO: 5621 - DNA, 595 bp, Homo sapiens
gtggccgggcagcgtccacgcagcctgaaaggggagattttcatattagtttagaggctcctcacttaaagatttcatcagcatttgcgagtgttcgccattcaaggactgtgcatttctggaaacaatgaaaagccaaaactgtgaaaaattaaggagtggccctgaagctggtgtctgtaactgcacattttaaagtgaacagactgatataaatattttaatcctgtgcctagatagatggataagataaaataaattagtcatgttctggcccagtctggagactatctgaaagcaagacaaatgtcagcatttgctgtttaggggttacaattaaaatctctccttctagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaaggaaaagaaagatcttttgaaaatgtgtacatctacttgcagcttgaaaattccaagtgccagacatttttcttggaggaaataaatgtcttcaatttat

SEQ ID NO: 5622 - DNA, 2648 bp, Homo sapiens
gccagcccctcgcagagctgctgcctgtggaagccagctgccggtatcagggcagggggagcagggggttcaggagggagggaggcagcctcctgcccctggatagaggtgcgcagcagcatgttggagggaaccttcagggtgggagggaagcgcctggctccacagccagccctagctctgtcccgaccccagctctgcactcgctgtgtctctggacttcagtttcctcatttgtaaaatgtccccacccacaggcctgtggcgaggcttgggctggcacacggaggaggcaccaccagcagggccaagaccgcctttgatgaggtgaggcctgcggcaccggttctgccctgaaggccggccacagccacgggggagcgaaaggcctgtggggcggtggcctcctgtgagttctcagctgtcagggtgctgccaggctgccccaccactcagggcactcacaggggactcctcaagggggtgtgcaggggccacagtggccctgaggcggtggcgcagcagcccagcgtggcacctgctggccccattatgaacccataatgggaaagagcttctcgtcactccagctcactgtggctgcctgcctcccggaccgccccccgaggcccaatgcctccggctagtgaagtgccgtcgggcgagtgccctcctgctgtctggccccggttcccccccggaggggccaccctgctctggcttcttggccaagggctcctgggcgcctaccgaggggccctgggatacctggggaaccgtcgcttgtcctcgcgccccagaggctgagcggggaggagtccttggtagcagggtttgagggtgcccgtcagcttgggtttcctggtcttgccccattctgtgttcgtccatgaacaggtctggtgaccccaagggcctgcctccttcaggagggcgtggaggagcttcagagcctggcaccatccttgggtttgcagatggcctttggggaagctgctgagtgcagcctggagactgtgggctttcctcagccccaggttcagcaccctcgggaccaggagcccaggccaggccaagtgccttcagcactttctccacatcgtttcagaaaagccttttgaatggggtcagcagtgagctatgccagaggacccctctcggccttccccaggaacaggcctcctccatccgccccagcctgcccccactctgctgccggccatgggccttccaccctcatcagggcaatgggctgtgaagaaagctctgggctgcgcggattacaacgattaccctggacggcgagatctccttctaccagtgaccacccagactctgactggtcgaaatagagaggactcactgtctggggcctcgttagaactgccgaggccacggctctcagcgctgctcctcaaatgccaagcccttctctctggtgtcatcagggtgacatatagccgaggaaaagggggtgggtgggccctggcccccaccaggagggctcagagaagctggtgtgtgatctgagatgtcagagggacaaggggaatctgactcctgcctgtcagggcctcagacacccatcttgtcacccagtgtctctcgagcacatcccagacagaagggtgactggaggccaggaggtctgcagccctgctcctccaccacggaggggcgtccaggcctctctgccgtccaagcagcattccaaagcggcgtcccggccaaggctccgcagatcttccccttgagtccgctgtctcgctgggtctcagtcccagctgggcacctcaaggctgctgcgaggaggccccctatgaggatcctgggactggcactgaatgagccaattcctctagctccgtaattgcagctgagctcccacatagataaaaatcagtcctgcagagcgggcagcccgctgggcacctccatgggcatctaggtaacgagaacagagcccggccttccgatatcccaagctcgggcattgttgctcccagctcccaccgggggctccccaccgcctggcctgcgagtcatgattcactccatgttcgggccagcactcctgattccagcctcttcaagacactccgctggggccccacccgagggccaggtgcggggctttgtggtggctcccactagctggggtcagcgccagcaactccggtggccacaggaggtcctcggtaatagctgatgcccaagtgtgagagagggtatgggggactcaatggtgggccccaaagacatccatcaccgaatttttgggacttgtaaatgacactttatagggcaaatgggattttgcagctgtgatgaaatgttggctcctgagatgggggcattatccaggtgggccccaacgtacccacaagagccctcatgacagggagcccgagagagaagggcacagaagaggggaagacgccaggctgacgcacaccagaggctgtggtgacacaaggcggggaccgaggaccgcgggtggcctctccattttccatggaaaacataaggaaacagattcgcccccagaacgtccagaaggcacctgcccgctgacaccttgacttagcccagcgagactgattttggacatctggcctccagaatcctcgagatctaagagagtaaac

SEQ ID NO: 5623 - DNA, 3214 bp, Homo sapiens
agatcaacattagtatgtatttatgcacaataaaaacatttacaagttgaactggaaatttaaacagaagtttaacagctcttattatattaaataaccaaaacaccttttattcccaaaattggtaaagaataaataatataatttacaatatggtacaaaaaataaccaggaaaggcaggcattctgctttatacatacactgtatatgcatatttataatctataaaacaaattcatatctgaaacgagcggaggcctcgctatggcttaaccgagtaagagagagaaggggagcggggcgcgggaggcagggccaggggctgggctccccacacctcacccaccccaaggacacgcagccactgtgacatcaggagagcgctgacagccgcgaagggtgtgctgtgggtttttttccttcgttgtaaattactctttccttgctttctttttttaacttgagacccagtttcgctcttcttgcccaggctggagtgcactggcgcgatctcgactcactgcaacctccgccgctgaggttcaagtgattctcctacctcaagtctcctcagtagctgggattatgggcatgcgccaccacgcccggctaattctgtacttttagtagagacagggtctctccatgttagtcagggtggtctcatactccccacctcaggtgatccgcccgcctcggcctcccaaagtgctgcgggggatgaaatgaggcaggaagggagagatggcggcacaggcatggcctgcccaacacctctgtagcagctccaggccacactggatgtggatggacggtgactcatgtgcctggaactcctgaggatgagaaggcaaaggggcccttgttagctctgtcctggggaaagactggatgttgggccgtctgcagtaggaacgctggccacccaagagggcgcaaggagggagaccaccacgaaggcatatatttggtgaggtctgaccacatccagatgtctgggccctcacctgggtgtcccaaatgggaaggagacacagaagtctcaaggcaaaggtatgcaagggactgaacacgtatgtcaggcacgcccacaccaatgcccgtgagagacactttccctgcaaaggcaggtttgtctcaagtgccaaacagtcacacatcgagtttgagaacttatcaggaaagtcttcgctgtaatcatattagcgcctaagggtcaccccaggagggagaaatgacaccttagatcgcctggaagcttgcaaagggacacaggaaggaaaccaactacagaggggactttgttcttcctcttccatgtctcctaattcttaaaacacaagaaaaacattttcaaccagcttagcagggtcccatgtaaagtccacacaacctgcatagtacaggactcttcctgcccccactccctgttaagagtacgaacaaaacctctagggaggggaggcaccagcccagggccccacgactccgcagcagccctgtgatcggtatccatgctcttgctgccttgggatgtgacaccaccaggcatgagcccaggccacacccaactgtcctgcccgttacagtccacagagggcacagctgatgcatagcacaggtttggcagaaagcaagcagcaggggctggggcctccctgcagagagggagatcacagctcctagtgcacagcaactacaccaaggcacacatactcccttgtctcagaaggaaatgccaccggaatgtccaacacaacaatcgaggcagagcacaggctgaaatgggatcattatgcagaccctaacatgggcccaggcgtggtgaagaacggctctagtaccacagtgatttctaacgctggcccttgccaagaactcatcctagtctccttggacgccgttgcctgctgctcgtggggaagcagctctgtgaccacgttcctgcccgttgcacagtcttgggtgcggagatgcctctgttcagaccatcttctggggctgctgggcttatctatttttctctagctcgaagagggcttcatccgccaccaggacgtgtggtcactgggacaggtcactgacagcggggccgcctccaccaccatcaaacagagcttctcggcggccaggctcagcgatggacagctcttgggccaggtcattgaaccgagaaatgtaatcaatgctgttttcgttcatcatgcacaccagctgggaatccacaacctgcaggaagaggagacaggaagaacaagtcaccgcgacctgctggcccttcagtggagggcgggtcctgaaacaggacgagaagctcctatcgactcccgctgcaggaagctaagctagggatggcagcccagggctctgtgcagaatcacaatcacctgtcgtctgcccgcacactctttagataagtgctcgcagagagcctatgatgtgcctggcacatctgatggctggggtgagggtgctggtccccccgcccgccatgagacctatgggggaagacacccaacaggtagacagactgtatgcagcagacacaggcactgggggcagcctgcagaaacagatgcagagtgaggggacagagagtgccgggaaaaggaggccagagagggtgctccaaggactgggacctgagcgggaggtggggtaaaacccgaggatacgtgggggacacgtttccatcatagacatgaggacaggtgggggacacattcccatcatagacatgaggacaggtgggggacacgttcccgtcacagacatgaggacaggtgggggacacgttcctgtcatagacatgaggacaggtgggggacacgttcccgtcaagagacatgaggacaggtggggggcacgttcccatcacagacatgaggacaggtgggggacacgttcccatcatagacatgaggacaggtgggggacacgttcccgtcatagacatgaggacagctgggggcacgttcccatcagagacatgaggagagctgggggcacgttcccgtcagagaaatgaggacaggtggagggcacgatcccgtcagaatcccaaggacatgtggtgagggcacgttcccatcagtcctgaggacatgtggggagcacgttcccgtcagagacatgaggacacatggggagtacgttcctttttaaagaagcaacaggcatgttccctgagacaggaagaggctttgactgaaa

SEQ ID NO: 5624 - DNA, 1036 bp, Homo sapiens
cgtcatctctcctgatctttggtatcctgggtagctcagagatgtctgttcttctgggcgctggcttcaggggaggccccggcaccacactgcgacatgggggcttagaatctctgcttgagatcttagacgcggcagaggcaaggggcaaggtgtgcttgttggtgccgttgaaccaggggctgtggctctgtctgaagccaggcacactcccatttgacaagttccgagcctgaaccgccccaggggctgctggcaagtccagcctcacaggcgcccccgcggtgcgggcgggggtgcgggacctgccttgacagctgagccctgtgctctgtggcctgtttcctgacgggccttgggccgggctcccggagggcagtgctcggggctgcaggcagcccttgaatccttcttcccctctggacagactgcctgagtttcgctgaaaagaaactggagctaaaaaacaaaaaagtcaatggcaatcatttcccacccactcttcttaaatgtcagtggtttaatttttatcacaactggttttctgtgaggtcgtgcgctttaaactcctgtctgcctgttgaggtggacacctcgcctttccacacccggagagctgcttcaacagccactctgtggatgacaaagtacagtgcctgaggccatcaggacacgatattaaccaggggcgggggcagtaccccatcaggacatgttcttatgaacatgaagctgtggggctgggtaagaactcggagctaactgagaaactgctcaagaagggaaatcaatgcagaaaaatggctgaggaatggtccccccaacttcagctacatcttccgtgactgagacatgggctgagtgcttgcgaacagcctgaggaccagcagcccacagaggaaggggccgtggcagggaaggcactcacccgccctcttggcgctgagggagccgtcgcggtggatgatgacatcactgctgcccagcatcaggaggctctggcccgacaggatgctgcccagcaggtcaggcactg

SEQ ID NO: 5625 - DNA, 535 bp, Homo sapiens
aaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttctctaccctggagttcatccagttcatcccagaaacactgacctgattactgtgacaaagtctgatggatagaccctttctgttgaccttgtggcgtttttctttcatgtggaagttggaagacaaggtgaaaggggccaaaagttacctgctttggtgaataggagtgctctacttggttctcagaacatgggccctcgtttaaagagacagggttttgccatgttgctcaggctggtcccaagctcttgagctcaagtgatcctcctgccttggcttccaaagtgctgggattacag

SEQ ID NO: 5626 - DNA, 2497 bp, Homo sapiens
cgagggggccgtcccgtcacccccggaagttcctcctccacgctttagggccgggccacttcttctgccacgtctgcatttcggggacccggatgccgcgcatgcgcctctttcatcttcccatcatggccgccgcctgtgcgcctctgctgagtcaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctactcgccaaattatctttaagaactctgatcctcaaatgctcagggagactaatttgtgtaataataaaactctggtctcccacacagctggctctgcgtgaattactctttctccattgcaattccctggtcttgataaatcagctttgtcaaggcagcaggcagggtgaacccactgagcgctgacattgtgtgccaagccatgttcttgggtctggaaatagagcagtgaacaaaagtgtttgttctcatattattgacagtaaatatcagttattctgaggcacagagtggtttattcactgaaaaatttgcactttaggctgtgctggaaactatatattaggcattgagcatgctttactaaacaagcagattgttcttgtcctctgttttgttttgtgacagtcttgctctgtctccaggccggagtgcagtggcccaatcttggctcactgcaacttccgcctcctggtttcaagcgattcttatgcctcagactcccgagtagctgggattacaggcatgcgccaccaccccagctaatctttgtatgtttggtatagacagggtttcactatattggccaggatggtcttgatctcctgacgttgtgatccgccccccttggcctcccaaagtgctgggattacaggtgtgagccactgcgcccagcctgttttgttttagagacgattttgctatgttgctcaggctgggctcaagtggtcctcctacctcagtaggagtagctgggtagttgagtagctagggctacaggtatgtgcccccacatctggctaattttttgtagaggtgaggtctccctgtgttgcccagggtggtctcaaattcctcccaccttagccttccaaattgctgagattacaggtgtgaagccaccacacctgacctatcagtttatagtcagtggttaagtgtgatcctcagatcagcagtatcagtaacacctggaaacttgcttgaaatgcaaatttcagacccgctttacatagataagagccagaaattctggaggtggggcccagcaagctatggtttaaggccctccaggtgattccattgctgattgagaaccactagtctagatgaataatttgccaaattcaactaagatatgttgagcacctgacctaaactggtcctctgctaagcattttcacatgattcatcccacttgactcatatcgatataggaaagtaaatatcctctgtcttgcttaaggttgcacccactagggccgggcatggtggctcatgcctgtaatcctagcactttgggaggccgagacaggcggatcacctgaagtcaggagtttgagagcagcctggccaaccctgtctctgctaaaaatacaaaaattagctggatgtcgtggcacatgcctgtaatcccaactactcaggaggctgaggaaggagaatcgcttgaacccaggggacggaggttgcagtgaaccaagattgcaccactgcactccagcctgggacacagggcaacactccatcttaaaaaaaaggttgcacccctgataagtggtagatcctagattcagtttctttcttccccctccccccacctttttttttttctatttgagacaaggtctctgtcacccaggctggagtgcagtagcatgatcttggctcacttcaccctctgcctcccaggctcaagtgatcctccccactcagcctccctagtagctgggactacaggcatgtgccaccactcttagctaactaagttttgtatttttgtagagatggggtttcaccatgttacccaggctggtctcaaactcctgggctcaagcaatctgcccgccttggccttccaaagtgctgggattacaggcataagccaccatgcccggaccatagttcatagtttctttcttttttttgttttttgagagtctcactctcaaaaggggtatggggcggctccagggccagggatgggacggccacagttgcggcagctccaggacgagcaagtggatcccgggaagcgctgtgagctcccgagccagccgggaggacgcttactacagctgctcagaagcactgctggaagctcagatgtgggcgccccagccagaaacctagaggggtacagggaaactaccgagaagcccctcctgatgccccag

SEQ ID NO: 5627 - DNA, 1014 bp, Homo sapiens
aggaagacaaagaaggtgttttccatcaggtaccggtgcacccagggcagccaggagaccctggggcctgccgcctccaggtggcgcacccacaccctgccggcctcgtacatggtgtccagggtccggaaggggccgcaggtgctcgagggcttcaccctggggaagatgccgaccaggaaccctcaccccgagcaacagttcacccggctccctcccagcccgtcctctgcacccctaagccttgggccccccaggcaccaccacccaacccccagatgacacagaagggtctccctccacccgccccactcactgccagacggcgtagcagaggaagacagcggcgcccaggaaggcggggaagcagagcagcgtgaggaagacggtgctcatgtgtgaggccagccagggccggcgcggcgcctggcagttggccagaaggctggtctgtggggaaaggctgcgctctgccaccatcctgctacccctcagcacccctccaagccctgggggagctcaagagggaagggcgaccagggctgtgcgtccaggcagagcctggaccctgctccctgcagcctcctcatttacagaggaagacagaagcctgccggtcacttgcacgcaaacgggtgatgccaacagcacctccatctgctgaaggtcgctgccatgccaggctctgcacacaacactgtacacaccacctccctcagtccccactggaacatggtccccactgcagggatgaggaaacaaaaggccagacgagacaggagccaggatggccaggtttggatacacccggagctaaacaaccagtatcagctccagcaccaaatgatgttttcatgtgcggccacacacctgcagatggccacgtacacctccagtaccggggagtcatgcggctccagggcggccaggacacggcacaggtagggggcccccaggttgaggaggccaaccaccaggggcaggaccagcagcacagcctcctggccagcagcc

SEQ ID NO: 5628 - DNA, 3413 bp, Homo sapiens
atctgagcattgataatgttctatctaaatttgtacagtgtgatttttttttttagaataaatattttataaaagggtttattgtcccttgtttatgttaaaatgcttgtttccatgaggggtttcttccctctcaatgtccctagccccttgggaaccagaggccccagagacagtgtgggctcctcagcgtagcctcttggtgacagcgtgcgctgcctgggcaggcacagtgctgctgtgatcacaggggaggccatgacttggcacctgggaagccagctcagagcatattcagtcaagttgatgaggaatggcggcccgacctcagcagcaggtcggcgtgcgggactctcagaatggcggcctgatctcagcagcgggtcggcatgccagactctcggagccctcagctatcttcatgtgtttcaggactgctgccatgtaacgtgtgtgtgtggagagtgtgcggagtgtacacgaagcatgcccggaggctcagcatgaagcactctgtacccagctctacctcctcattgtccttcatccagtgtgtaccttcagccaggcctgccctcgtgtgggaggggcagtccccaaggagcacacgccatgatgtcagaaacatcttcttcgaggaagatggccctttacaggccccaggggacgggggcagcacggagccctctctggacctctgccgcaggccacagaaccttctccagcccttgactctccttgcctttcatttaccctccattgttccaggctaccacggaatgatgattacagctgagtttacccaaatcccaccacagggtcaaatgaaagggccttgacaagatgtcccttggcagcttgagatcgcagttgtgttgctgggttatggcctgggtgcaggctggtttgcagtgggcggtactggcagctaccatcaaggtctctgtgctgggctccagccctcagcccagaggggtggttccccactttatagagagggggtttccagctcacagaaggtgagaagcttgtcccaggcctggagcagctgtggagaaactgggagggaagcccgtccagcctgattccaagcccacatgctgctcacaggtcaaggccgagggactgatttttgccggtctgactggactcaagttacttcccagttccttgcagagagctgtctttgtgagacagtgtcttgggttctggaatgatgggagccgtgctttgcaaatgaggagtgattgcgtgctcatctggcagctggtgggtgtcctgctggcatcaggcctgagcggtgaccgtgctcctctgattgtcctcactgcgtgtgacaaggcctgggccactgtgtgagtcgtcttgcgctccatgaagcctggtgtctgtgcagatgtgtgggtggcgttagggttgggggacatttgtctttcacactggagaatgggagtctggagctggtgctactggtgaggaagaggcccggcctgctgccaggttcgcccacaccttccccctggttgttgggaaaaccaaccttggaatggccaaggcaggagatagcacctccccggtgaagatccaggagctctcatgagctccacgtggaaagatcaaggatctggagtctggagcccttcaggcagcaactcagtgaccatgaacctcagctctgtccacccggcacagcattgctgggagctggacccgggaggctgccggctccagagtgaggagggtccagaccatgcagacaatatgccctttttctccaaacaccatttcaagcaaacccgcaggtctcctccacggctgtcagcagcttctcgtagagcttctcataggactcatatggtggaatgtcgatccggttaaagctgaaaaaggacaaaagagagtcaccgtgtgggcagtccagccctaggaccaacctcaaggccaaggacaggcaagacagggtctcgctaggttgcccaggctgctctcaaactcctggcctcaagtgaacctcctgccttgccctctcaacgtgctgggagccactgtgcccaatcaacacacagtaaaggggaagctcatttccagtatttgtgcaaagaaaaagacatcctttaagaagctatcgtagcaaaccaaaaaatacaaaattgtgacccagaggatgtacagtgacttctggctttctagggtgctgtggcttttgagttctgatgatgacaaaaatattttggcagagactccatctcaaaaaaaaacaacaaaaaaaaaacgtgaacgtcagcatcctctggggctcccaggacgccgtgacttcctggccgcggtgcttaccagcacacatctcagaaaaacatcccagccaccttccagctcttcctgcccacagcgcacatagacgcgtcatcgaatagccctgcctccacgtcagtcaccttgcaaagccttgaagccttggagcgggactcgcgtggacccagtcacaaactgcaggagcctggccctcctttcttcatcgaacgtctccaccgcttgccagaaccaccgcacgatgttgctgtcggccacacagtgcttcagccgcgtgttcgacttccagtcgttcaagtctattttatccaggccgcctatgatcagctgaggaggtgcagaaaggtgaattacttccaaaatgcataaacccacgtcaggatgcgcctcctaggtacccgacacacaacagtgaaaagtcgattcccaagcaaagcagcagctgtgtactaggcagatgttgagacaggaagaaagctacaaacaggaggcctgtggcacatgcttccgtccgcctcctccaaacgggtctccaaccccaaggaccgcggtgcacagctgttgatgggatgttattttataaccaaagcggggtttttgctctgcatcggtgaggagtatcaaagaaccaaccggtgacactgaacagagctaaccatgaataacggcacgtcccagggtctctccaggacactcaaggacatgtggagtttcaagtctgaagagaggagaattcagcaagagttaggtggggctggggccgatagggcatgtttccgcaattggcttaaaaagttcaacccctgctgggtgcagtggctcacgcctgtagtcccagcactttgtgggggccgaagttgggcagatcacttgagcccaggagttcaaggccagcctgggcaacatggcaaaaccccgtctctacaacaaatacaaaaattagccaggcatgatgacgtgcacctgtagcctcagctactcgggaggcggaggtgggaggatggcttcagcctgggaggtcgaggctgcagtgagccatgatcgcaccactgcactccagcctgagcaacagagcgagaccgtgtctcaaaaaaaaaaaaaaa

SEQ ID NO: 5629 - DNA, 5007 bp, Homo sapiens
aaaagagaaaactaatttgtggtattagaagcctggatagtggttatttttgagaagttagacatgctgatcaggtgaggcttcaagaggcacttaggaagtgctcataatgttctatttcttgattatgagtgctggttacgtgagttgatggactttgtggaaatttaatgagctatgattatgatttatttacttttctctatgactgttacactctagtaaaaagtttgcctaaaataagaaagtagcaaagaaagaaataatgagaagggttagacgaaataaaatttgctgattattggtaattattgaagctgggtgataagcgagggatctttatgtgttctctacttttgtgtatgtttgaaaagatccataatgataattaagataaactataggaatagaaagcagacaatttgttcctggatggggatgacagagaggagcaggagaaaggaaatatagagaataaaaggaaattttgtggtttaagataaatatattgtcttgattgtgatgatgctttcagaactaaccaaatagtcaaataatgcaaaaaacaaaaacaaacaaaaaaccccagaaaacttaggttcaacttattccaactgctgtcatctacctggaagaagaccagacactagtaacaacttaatacttgctaaataaattaatgactggggtgccatttggcatattattggtctacattttttttaactatagaaaatattgatcatgagtttcttacaggtaagttacagattatttgaaagaagtatgtacatgtaatcagaggtccacactcagggatgctctgagataagctatgtcagatgaataaggcactgaagcagcttttctggagatgaaaggcagccagccagcgttgattcccaggcttggtttattagcatcatgacctgggcaaaactttcatcacctggtgaggataatttattcctctccctagcctcatcaaggtataattgacaaatggaaattgtatatatttaaggtatacaacatgatatatgtatacattgtgaagtgattgccacagtcaaactaatgaacataaccatcacttcacataactatcttttgtgtgtgtggtgagaacgcttaagatttactctcaacaattccatgtttacaaattattaactataggtcccatgctatatatctccagaactaactcatcttacaactgaaagtttgtaacctttgaccaaaatcctcccattcccccttaccatagctcctggtgactattattctactctgtttttttaattctgcctctttagattccacctataaatgagatcatgcatgtttgtctctctgtgtctggcttatttcaactaatataatgtcctccagattcatccacattgtcacaaatgacaggctttccttttttaagctgaataatatttcattatgtacacacacaccccccacattttctttatccattcatccattgacagacgcttgggttgtttctatatcttggctattgtgaataatgctacagtgaatgttcagatatctctttaagataatgatttcagttcctttggatatatagccagaaatgaaattactggatcatatggtagttctatttttagtttttttttgtttttttaggaacctccatactgttttccataatggctctgtcagtttacaatctcggcagcagtgtgcagtggtttcttttcttcacagcttcaccaacacttgttatcatttgactttttgataatagccatcctaacaggtttgagatgacatctcatgcttttgacttgcatttccctgatgatttgtgatgttgagtacatttttatatgcctgttggaaaaatgtgtggtcttctttggaaaaatgtatattcaggtcctttgcccattttaaaagtaggctatttgtaggtttttgctattgagttgtatgagttccttttgcattttggatattagcttttcttgatgaatatatggcttgcaaatgttttttcccattccataggttatcttttcattttgttgagcatgttgaaacttttcagtttgacgtcctactcatttatttttgctttatttgcttatggttttgttgtcatatctacaaaatcattaccaagacccatgtcaaggagctttctcccatgctttcttcaaggatttttatggtttcaggtcttatgtttaagtctttaatcctttttgagttgttttttcgtgtatggtgtacaagaatagagatttaagctttaaagagagaaataagacaggtattctagattgaaatgcaaattacacctgcatttttaagatgacactttaagaaatagacctcttgcagcagaacacttcgtgttcctggaacctgtagtgcttgtttattctttttagatatttaattgacagccaaatccagaagagatagctgctgaatttgtcactaattctgagtctgattctctcgtttctttgcataaaagtagtgttaatgctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttctatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtatacttcctagatcaactctcagatctttaatttgtgcatagggcttcctgaggatgttgctcttactagaggtaattgatcagttttcattgatggctccctcataaagtggaagtttaaaacctaatctgtggaagccacgaaacagtttccctcagccagtcatggtggctcacacatgtaatcccagcactttgggagggcgagacaggcagatcacctgaggtcaggagtttgagaccagctgggcaacatggtgaaaccctgtctctactaaaaatacaaaaaaattagcctggcctggtggtacgtccctgtaatcccagctactcaggaggctgaggcatgagaatcgcttgaacctcaggaggcagaggttgtggtgagctgaggttgcgccactgcactctagcctggttgacagagtgagactctgtctcaaaaaaaaaagttttcctgctctcatttgctgtttcatcctaagaaacttgagaaatagactactttaaatattacagtgtatataaatgtgtaatttcataactctgcaaaagaaaacccagaaaaaataattttttaaactttctttttggggagggaggagttagtgaccccaatctgttattttacaaaatgggcaaacattgccaatctttctgaagtttgaaatgcagaatttgaagtttctcactgccctgcgttctagggaaagaaaaccattctatactagaaaggtgttatttaaaaagtttgatacccagaaaaattaattatttcattagttaccataatgcctgtgagttttttgccactttgatttaactgacattgacatgtctttgtgttagtgttgcagcttctcagtttttatattctacttcattggttgtaatttagtctcagatgatttcctataggatgtaatttcctgcatagtatatgggttctacttagcctgataaatgatctttccaacctcctggaagcactatatgccaaagatattctgatattttctaaagttttaaggaaaattattgggtatgtagttattagtccatggatttattttagtaattgtcattgtttcaccttttctcaagtttattgttcagcttaaggatattttcatttaggatatatagcccagacactgggttataattataatcaatatgtaagtatggttataattataatcagtatgtacgtataatcaatatgtaagtaatcatttgttatcaacctcctcattcctgttcttaatagctaacattttttgagctgttatactactgtgctaggcttctttcttaaattcctacttcacattaattatctcatttaacatttggctctgaggtatattctattatttccattttgcagatgagaatataaagtcgtagaagtttaaatacatgcttatttctcacagtaagaaatgctgagaccagcattaaaactcagctcatctggctgtagaacctgtactcttaagtactattttatgttgcatcacataatggtacatgatctttttttggttagtgtaatagttatgatgcttgaaaattttattgtctaccctttgtaatttattaaatatggatgtttcc

SEQ ID NO: 5630 - DNA, 5497 bp, Homo sapiens
ttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccaattcagagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtgctgctgtcctaagaagggtcaggcctagtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccacataagatgtgatttgctcttccttgccttccaccatgattgtgaggccttcccagcatgtggaaatagggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcccgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattactttagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagccaagacaaaactccaattcagctacttacctagtaatgagtctcaggctgaagtagatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacggtgagtcgagttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgcaggcagagacagtgtgtgcacttccatcctacagggaccagatctgaacagtctggagagaggagctgtggtggcagcagacagatctctgcttcaggggccaggtgtctagagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatcttaaaagaatattggcagagaaacagccttggtgttccagcaggagtgaagaggaacaggaaaacgagtggcagtagccctgaaacagccacttctggtggttgccact

SEQ ID NO: 5631 - DNA, 3044 bp, Homo sapiens
gctcgccgtagcagcgcgagtagggggcggagcccgccgcgtgcccggaagcgctcgattccccccgctgccttgatgtggcgcgtgcggagggctaggagcgcgcggctcaggggtgtctcgttggtcgctgggtccttttccccacccagagcctccccggccgccgccgcgagctgcgcgaggcagaacgagagcgagtccgtgagggttggcttcgcagccgccatcttggctcgggcctcagactccgccccgcttctcgccgctgatcccagggagcggaactggaagacagggaaatcgtcgggcaccgcctcgctgacgctgtttagcgccaccgcagtgatgcaagtcggaagttgtagttctcgaccccggaagtctgtccttgcacacgaggcgcggcagtaccttaatcgcagcgcatcctgggacgtgcgggcggtgcatgagggagatgtggtccgcgtcgagcttctcacgcctacctcgggaagcgctggaaactcttccagggccctccaggtgggccagggcctccgaacagcccagaagtccgaccacggagccttcgtgccgtgccccgcccccggcgtgcactcggcggggaccgccttttctcctctaggctcgcttcgctgccccccagcggtggtgcggcccggccttgggacggactccgagaaccccgagccgggccgaaagtgcggggtcctgaccgcgccgcagacggggagccctcgctcggtcagaggaagaagagggttaaacctaccgagaacgttcgctgccgcttcctagagtgacgggcttgtggaattttccgtttccggagctggaccccggtgtcccgagtgtcctccgctctggacgtgctcgtgagctcaggagctggcatctaggaaacggggagttcttcactcgcagcgcagtcggccgcgccagaagaggcgagggagaatccggacggggcggggcggcgggggagcgggacattcgcgtcccggggagcccccaggtcacccctggattgcgaggtggctccgcctgagcagcccttcctggtgtggtcggggcagctgcccgcccggaaaatggtcaggctctagccctggggaggaagaagcctttgccaagagcaaccgtctacaagccccaaaacctgcgagtgccggaaatgtggactgaccacagcctgcctccccggcttcattcaccaccaaggcagcccctctggtgacaagccttaccgttgtccgggttatggcagaagcttccgatgtggctctgatctggttaagcaccactgggtacacaccggtgaaaagccgtactcctgccccgagtgtgaccatcgcttcggccctatgcctgtgcctagtgtggtaagactttcagcgtcagctccaacctgatccagcaccagcgcgctcacaccgctaaaagccttaccgctgaggggactgcggcaagagtctcagccttggctccaccctgttgcagcacctgcgctccacatgggtgagaaggcctctaagtgccttgtttgtagtaagagttttgtgcacagttggaatctgctgcggcaccagcacagtcacaaagtccggaaacctgatgcttggtggtgagtgtggccagaccttcggccacagctcccacctgcccatccactaggcggcccacagcagcacccctgcgtctgcctgcagtgtggcagggccctagcgcaaagctccaacctgggccagcaccagcggacgcactagggcggcagcctctgcaaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctctactaaaaaaaaaatgctaggcgtgttggctctcgcctgtaatcccagctactcgggaggctgaggcaggagactcacttgaaccccgggaggcggaggctgcagtgagcgaagatcgtgccactgcactccagcctgggcgacagagagtgtctcaaaaaaataacaaatttaaaaattgtttttaacaaaggagccccagtctggaagaatcagaacactagatctgtgatcactgccttcaaagagcccagtcagctgagagggcttaggtttgttctttgaagttacaaagacagaacgtcgaccagctgaagggagagttttggaatggcgggagctatccagcgtggacccagctgcctgcagatctggcagtagctgacacagtcccttcacaggcctagggagtgatggggttaatcacacctagaacaacagctacctcttcccagaggaatgggaccagaaatcaggcaagcccctgtgaggagttccatggcagcgcgcaggcggggcattcctaacctccagagggaaccatgagggatcctgtgttctggcagatgggccagagaatttgaacttgggaccattgtgtgagccctgggtgtgtgagcccttcaaaagtcctctcagcacgtgagaactatcattatggatgatgctagggtggtgggggccccagaacagacctgtatgttgagttcaggggttgctttgttgcatttctgggcaggggcaagaggcccagggtttgtcatctgccccttcccctgccttatccccttcccttccaagttccccaggctccttttctgccagtctgtcaagagagggaagagtggcgaagagtcctttgtgcctggacattggggactgaacatggcccttttgcctgggcattgcccaaacatatatttctactggc

SEQ ID NO: 5632 - DNA, 383 bp, Homo sapiens
gaggaggccgtccagcagatggcggatgccctgcagtacctgcagaaggtctctggagacatcttcagcagcctcctggtttcctgtggtggctctgctctcacaactcatgcttttcctcccattggagggcctattccttcacgttttcctgcagccaacaaatatttacccagcagtgctcgtgtgcaaggcagtgtgggaatctctatatatccagccacggataaggcaacatacctctccacctggagcgcacattctggcaggagagaaagacctaaataagcaatagatgattagttcttcaataacagttgtgacaaggtctattgataatattttgtaatcactaatattcatataaaccgtgcacaaccatt

SEQ ID NO: 5633 - DNA, 1992 bp, Homo sapiens
ccttaacccgacttagcaaacaaggaggctcctgaaacggtgctgggacccggggggcaagcccagtccctgaccccgcgcgggggaggtgagccgcctacaagcccctcccgcgcaccttcctcctcctccaggggaattctgggcgtgcaggcaacagcaatgctgggaccggcgctgcccgctgggagggtctgagtccgggagggggcggcccttgccctccgctgccacctcccacggcccctcagtgtcgccctgctggcctgtgcctggatcactctccctgctgtggcctgcctgcccatctccttcttgcgtggggtctgtaccttcccttcctccctaccatccctctttccccaaaactccggtccttcctcccaccttccgggaaaatgcaaatgtcccacttcctcccgcaaaggggaccctccccccagcccgtcgccaccttcaggttcacagcaggcagctccatcccgactcaggccgagggcacctgcgccgcagccgcggggggctcctaggctccgaactcggggaacaaacttgcccggccccgccccgccccgcccgttgcggccactccaaccccagcgcagctcaagaccacgtgaaacgggctggagcgggtcacgtgaccgccgcttggttgctaggagacggcgtcggcagctcgcgccttcagccaagctccagactcccgccaccgcccaggcagtacttgggggccgctggcgaaagttggagtttctgtcgcccagggcgtatcctgcctggctaatattccaggaagcggactgttcggactgcctgcagccaggacaactgggggaccgtccaggcgcaaagtgctgatgtggcaacagcttgtgtctcatccttgggggcaccctctctccttcccacttccctgtgtaaatgggctatttaggctacctacctcatatgatccttatgaggattaaatgagctaactgctgttgttaaagaaaacgttattgggactgttgttaaaccagtactgttcaagacttgctgtagggttattgccatggagtgagagtttgggctcaacaccgaatacaacaaggaccaaggagggatttatagccagagcagaatgagggagcaggaatggaagattcctaggaggagacatcaaggatgggggagttcttgctaacttagcaggactcttgctgaaactggtttattatgcaggctcaggcccagcaaggacaggaagacacagaggtccaaggccgaggcctagtcaagatgaggactcagaggagtctaactacggtttgttctaggagagaacagtgcccggcacttagtaaatgggcaggacacacaagctattgttattaccaacacaagatgaggctgggcgcagtggctcacccctgttatcccagcactttgggaggccaaggagggtggatcacctgaactcagtagttcgagaccagcctggccaacatggtgaaaccccgtctctactaaaaataccaaaattagcagggcatggtggtgtgcacctgcagtcccagctactcaggaggctgaggcacgagaattgcttgaaccggggaggctgcagtgagccgagatcacgccactacactccagcctggacgacagggtgagaccttgtctgggaaaaacaaacaaacaaaaagcaacacctgaggagccaaattggtgggagcccactttaatcagcataccaaaagttttagaaaactctagctgaaaaaccataagaaattcctcccccaattgtacatgaggaaagaaagggctgtctcctgcctcacctggcacctcccttaaagattgttgaccaccacatccccccaccgcaacaagaacattaatccgctctacctccaggtcccttcctaacatcaactttcctttagagaacaccagcttttgtttagtgtcacctaggtatggaaaccttcagggtacacctga

SEQ ID NO: 5634 - DNA, 4477 bp, Homo sapiens
tcttgaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgatgaagaaaccaaggctttgtgactaactcaacccctcaagaaggacaaaactagcatcagagccccttgctcctgggtctggcaagaatgcctcttgtttgctgagaggtccacagatttacccggctcaagactgggagatgggaggtgaccagggtctcggtctgtcgcccaggctgagtgcagtggtgtgatcttggctcactgcaacctccacctcctgggcacaagcaatcctcctgcctcagcctcctggatagctcagactacaggggtgtgccaccatacccagctcattcttttgtatttttagtagagacagagttttgccatgttgcccaggctggtctcaaactcctgggctcaagtgatccacccgccttggcctcccacagggctgggattacaggagtgaactcccatgcctggccctcatgatcctttgtagactgagggacaaaagaagagggtgaggcctcccctctcctcagcgctgagtgcaaggaccctcaaggcaactcttggcaaagccccatgtttccactggctgtttaggtggaattgcgtccccccgcttccgtatgttgaagtcctaattttcgggccctccgcttgtgaccatatttggaagtagaggctttgcagatgtcatgagttaagatgggggcctcctggagcagggcaacatgactgtatcctcataagaagaggagagacagaaacagacacacacagggagatgccacgggactcccaaagccacaagaaagcctggaacagccccgccctcacagcctctgaaggaaccagccctgccttcacctggatctgggacttccagcctccaggactgggggagaatgaaactctgttgtttcggccactcaggctggggtgctttgttatggcagctgagtgggtgcctccctctctggggacggccaatccctgtaggggaggcagtggtcccggtccaggaaggtgagagaggctttctcagtgtcttcacttcgccagctcacgtggagactggtagcggctggagcccaagctcttctggggagccggtttactcaaggtcacccttgatccagcggagcccaaggtctaggtcaagcttcctctgggatgtccccaaggctcttcaaacaggtgtcgtcaagccatctgcccaagggcccgtcagcacctggcaggtgttagccaggctgatctgcaggcggggctgccccgagtggggctcccactgcccgggttgggactggagcagccaagtggctgagcaacaaggtgcttcatgtgtggtccctgtgagcccccctgaatagtctcatggacagacggatggacgggaggctcagtgggctctgggagcaaggggagcgcttgccgctctccacgtggctccattccaggaccaggacaatgatgtcttcctgtctgcagccagaagcagggcagctgacagcggcccagccctcctgagggacaggtgtccgctcccagaaacctcccttccacctgcccctggggttgagctggagaggctgagacatgctgggaagaggaggaccagcccagtgggcggccgcccaacagctcggcggtgagaagaggccacgtgtaagaaggaaacgccaccaccccactggatggtgggagcaggactccagggaggggggtcttgagtgtaggcaaccatgtcgatttggcacagtgtctcaacagggcagggcaagggtctgggattccagttcacggatgccccaggtaccatgggtggacagaggcccagaccctctgcaagacagcagtgatcatgtcagaccctcgcagcgcttgagggctgcagcaggagccctgagtcctctgttctgaccaggcagcagggaggactcgctgcccccagctgcacaacgcctgccccggccttggtcttggccctctacccggcaccagctggagcctcttggccattcctctgtgccatgggacactctcccactcctgcgctggcttctgcccacagtggcgcccctgctcacccactggcagtgtccccacctctcagaagagtttttcacagtggcaggccctgacccagagtctcctgcctacttggtggctaaaggccccaggcgatccccaaatcctgctgtctcagggagtttctcagagtcccacctcctccacagaaccaggggattggccaagactcaaagcttcgaagaacggaacatgcaggtgtgcagagaccatttattaccccacggctgttattgcctgggaagctgagtgccctgagaccccagccccctgaggctctgaccgggacaaatcccacaggcactccgcctcatcccaacacacccaaatcaccaatcgtgggctctcccagtcctgccccatctcccggagagtctagtgaggtggggagggcacgtgtgtgtacatgtttgagtgtgtgtgcacatgcacatagacgtgtgacatggggcagctcgtcccagaccccaaaccaaaggctggcgggggctggctgagaggtagttgtgcctactgaggaagggccacagggcggtgctcactataagtcagaactgttcatttctgctgcaatggaactaggcagccttgccagccatccggcggcagtgccggcccatgctggcggccacctccccgaggctctgactcttggaagggtagccccggagacctggccgtgtcgaaatggaaccatggctcttgttctgatgaaagccttccccgggagaggagtctcctctgagtgggctccgcgcggtgggatgcctgggggagtgtcctccggcccagtggcccccgctggacttctttggttctgattggacgcagatgtggaggacgcaccaagtgtgaggccaggccccgccctcccagactcctggctcctctgggggcaggagggacgccagctctcccggtgaggaccatccctcctacctgcgccgaccacgtgcctctcaggggcccgggcagcagccagactcctcatgccgcgccaggagggacatgcgggagaaggtcttggtgcagcgccggcaccggtacttcttggcgtctgagtgcgtttgcagatgggcccgaaggttggagcggtcggcaaaggccctgctgcagtgcgagcaggcatagggcttctcccctgtgggaggaaggcggcggccagtgacaccatggaagatggagtgaaggctaaagcacccaccctgcccatcaatggatactcccatcccttccccacaaatgctcacagccagagcacccaaggttgagctgtgtggggacggggtggcacgccacatcacctgaagcccctcccaggagcacaggcagccacaggtgctagatctcctagtgttgctgcagtagccctcccggggcccttggccactgggagaggacgggagaagcactgggggcctctggcagctgtttctggccactcacaggcaagtgggggggtctggccagctccagcagaatccagggcaggggcagagctgtggaccttgaggaggcagaatttaggaaccacctcccatcaggacaacaggggatctggacaaagtcctgctgggaccttggcccaacacctgtaaagggaagtgtgactgggaatcgtttgttcattcctgtagccccatagagtcctgagagacctcagcctgcagcccctgaggggcccagagcacctgcattcctgctggtgggacactgggcatgctcctggccaggccagcctcccgcagggcctccccacactcctcactcccaggctgagggcaccaagccccagggccctttggcacggaaagggggtgtgtggggggtgtcgtcatcaaagagttgagaaaaaccagaaaggatttcccagagacctggaaaaggccttccctctggcctgcacccaggtgtgactcagagggtcccagtcacaaaagtcatgacttagggggtagggaacctccagttagaaaaagtatgaactagcaggccgggcgcagtggctcacacctgtaatcccagcactttgggaggccgaggcgggtggatcacgaggtcaggagatcgagaccatcctggctaacatggtgaaaaccccatctctactaa

SEQ ID NO: 5635 - DNA, 420 bp, Homo sapiens
gttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgg

SEQ ID NO: 5636 - DNA, 1421 bp, Homo sapiens
gctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgc

SEQ ID NO: 5637 - DNA, 15145 bp, Homo sapiens
gccgccgcggagccggcgtccgcagcggctgcgcatctcgggcctgcagcggggcgcttggcgggcgggggccgggggagagcctgtttgcgcagtacccccggagggcggaaggccgccgagagaaacagcaagtgacagagcagaggaacggctggcccagccaatcctggagctgctgttgcagcacttgttccccaaacaagtgctcctacattctgatgactcagtgtatcgggagccgggagatggagctctcagcagagtggccaggatgttctgtcaacatgaaagctacaaaaacagctcggggctctgagctgatccttagcctggggtcattttcagggagggctggacagagaaggcggccaccgcccgggcatcaggatgggagcgacaccagaggactcaggagagtgcagcttgctctgtgagtgggtgacaacctcttggcgactcaggctcagctgaggatggtgccagtgtgccggagacagccgtcatactgccggatagagtggctcacttgcatgtatttggaacaaaaaaaggagatgcctggcagccccgctctctgcagtgctgttgagccaccaatttttgtggttttgtgaccacaagtgctgactgatgcgacatgaccccagtcttgtcagtgaatcatcaccaggctgcttactggaaactggatgcagcaaggaaataggatttaaccgctctctgcctcccaggtaagtccagtgtgggctgctccctccagccttcccccatcctccttccttcccacgaacaccattttccttattccgccggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagcctacagggatggactggggacatgggggcagatagagccacgtggggaggtggtatgtgtggttagatcacaggagcaagtccaggagggtgtgggaggacaagtccagtgctcagccagggctgcctgtcatggcccaggatggatgtgtgcatctcctgtgaaggatttgcgtctgagtgcctggtactgaaggtaggatggtgccccgatcagggtctataatgaggcatgaaggtatgagatgggcatcagagttgttggtccaagggaaactgacctttttaaagggctctcctctccttatctgatttcatcctcagaacaaccatatgacatagggatcacttcccttttatagttaaagaaacagattaagtgacttaacccaaggttatgcatttggtaagtgaggttgttgagatttaaatgcatgcacttcttattccaaagcctctacgttatctttactcttttgggctgaagtcagacatttttgtgaactaagattctcagaggactgatgtgaaccagagtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagggagttaggactgacacaaactaaccccctcttttttcctaataacttgggaaatccatccaaggtccccatggcttacaggaacttgtcgtgagtcagggatcaaggtggagtagatgtcaagcctttggtctccggcagactggttctctcctgtctgccatggttgctgttggccttctgcctcacaccctcccaggcaccagctgacttctttcctcagcctggtcactgtgccccacacttgtccatgcagcacagggaaacgtgcaggttaggtctttgccgagccattggtcaaatgttcctgcaggaggctggttctgaactcagcctgtcctgccagaacgagccgttcccagagctaatcgtctcacgatagggaagggatgggcaccaggcatagagaagtgacctgtgccagatgcttggttgagctgtgtcttgagaggcggaggcaggttggtggtgctggggacagggcaggcatgtgtcatgtgttcagcgcatgtagctccagggctcgggacttgtttacttggtggaagaggcagcggacctgcggagtcaggccatgtgattgttggctctttggctgatcatggacagctgacccgccggactgcacacactgccatctgctgccaggggtctgaagttgcacagggatgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaaaaaaataaaaaataaacaaaaatatctcagagccactggttccattttggctttttagtcttgagtcactcttaaaaagatagcaaaataaaacacatgcaggaaagccgaaggtcccaggcccagccagatgggggctaggagtggctgggactctggcctagcttctccatggcagcgttagtcccagacgtacaccacttctgcaaggctgtgtgggtaggagcccctggggctgagggggcacattgtgcaatctgctaagcagaatgtagagttttaaaatagctacctttctccaagacactatctgcttgccgctttgtgggatgtttacctgggattaataatagctgagtgccaccccactgccagtatggaatagcaaacagcgatctgggctaggactcaggcaggagaggaatggagtaataaccatcgtatcagctcacatagttcttttcatacttgctggctcatttggtcctcacacaaccctgagagggtaggtggtcttatccttgtcgttggtaaaactgaacctgagagtcaatcctgccaagatctgactgcttgtagccgcttctcgtgggtctcccatctaggtcctctgacttcagctgttatttctctgggttctgactagtggggcagggacaggagtaggggagtggagtctttggcagtttccttaatttctgaaggccttagagggcctagagatgccttttctatgtgttgaatgggaaacggaacctcagcatgtccaggttctccaactctctgattcttcagacttcttggagctcttgtgagaactggcttgcactttttggctgggaagccagccactcaccatgtgttcttggagaggtttcctgtatttggaagcttctggaatatgtgatgcatcaaaccactgtgacacatctgtatggcacctcatgcctatgcacacaggcatgcttctgctgagtgcagctcacttagagatgaggcccagtgtagggtttttgaaatttttccaacacatttgtaagagatgccctgagccttgcccagcatgcatgttgtgtgtatgctacctgtttgctggctaatgtacagcgcctgctggaagccttggctaatgtacaatgtaaagtaagggactagaaacactggctttagttctgagtgtctgcttcatgattgacttgaaaaagtagggcttacccacagagagaaaggtgggtaagagaactcgtgggtgtcagttttccttaaaggcagagcataatcccccactctttataagggctggtaaggcagagtattggacagcaggacttcttggccagttagccctcttgagtgacctttgtttaaatagacccagaacttgtatgaaggaggaaataatggtttatctttatttacagcggatttagccatgatggtttaggctttttctgggggtattcctttaggacagttgaggttggacaggggcagcatgcatatgtgtctctaaatgtctgtcctttggtatttcctgaatgcatccttggctcatactgaaaccctgtgatggggaatccacagcggaattgttttagtggataaagccttctgtagcttcatgtgtgaagatttgtcatgttggatccagttcattctgtccacttgaaggatggaaaagagagtgggcagaacttgcagcaaggagagtgatttgggctagacttctgggagaactgtgcatcacctctgctgagggttcctgaggaaagatgaagcctctttatttgaggtaggagactcggtgtcctccacaggatcctcccagtcccaagtctgtggcactttgagacagtccctggaacagcatgaggtttgggtgccaggatctagagcaggcatttctctccatctttcccatctgtcttcaagacaggcccaagctggatgcaattgaggggatgcatgggcagggtacaccaatgtggtcatcgaatctggaactttgaccttgtttccctttgcagagagaacttctggcactgatcttataggaactggtgttatttgcatataaaaaaagagaaaggcatgttgtccctcatcttttccaggaaagagtgctgagctgctctaatcctatggtggggagggaggagggccgtgtagaggacgcaaggccagacatggtttgctgggaagaaggtaggaggtgggagaggaacatcccagggcaggcccacaactctgggagccacagacattgcctgctatactaaaggcaaagggatgtgttcaaataggcctactatttagcggtaacccacagtctgaaataaatcagttaatggctaaatgagagttgtattaaatatggaaaatcatattttttgtgtgtcatcaccacctacagatttagcatcaacaggcctgaaaggctgaggatgctgaaatgggccctgtccgtaagatcatgcttattttataatgactttttgtctcttttcattactatttcccactcttattccttaggtctacgtgaatatttatttatgcagttgtgttatttccttggggtacagttcttccagtgtcattggcatcaatgaatatgtgactttgatttcaagtgtaaacaaaccactggttcacggcagggacaagccatctctgagacaagggctccagcagctgcctacagatgcccttcccccaatagccctggactgtttcggccagacgcctgagacgagagtcaagggtgttcttgcagggacctgcccaacgctatgtcatgtgtcctgcctggagggtggtgctcacacatgcatcttccagccttattagctggtactgcttttcagcttgacccgaggagtggtattggaagtttgagaccgtacatcccttgctaggtgagaagggggtcagagaggtcaggcacagacagagaagggaacgcaggctcctggccactagcctctctcaagacaggtgaactttgtgttaagcgaactcatttaatattttgggcctaatagaagttatttgtattttctctcctctcttttccctcctctctctcactcaccctccccccactccccagcctccaaagaatttaatctgctggacaacaaacaatactgttataaaactttgaaaacaagagggcgcggcctccctgacaaggagaagggcatgttgggtaacggcctgagggagcgtgccaggcctgagatggagccgggcgagagcccagttggctgggtacctgggcgcctgcccctgcatagcccactagccgcgccatccccaggccagaggggaaggaaccaaaacaaaatggggggcagagaaacgcttgaaaagggaagttgcacatgttcccctctctctgatctgatgggaatgcactagactgtgaaacttcctcctccacctcttctcccgagtccctccctccctcttaccctccttcctcctctctcctccctcctttctcctccttcctcctcctgctactcactgttcttgagtctggcagacagaggtcctgatagcagaatgaggctggaatagcaccataggtgcagctaccagctgggccagccaaagaggaaggagagaaagtgggcttgcagttggctttggattcaaatctaccctctgtctggcccagcctccctccattctattagggaagtggaactacatcacgccacagggtgtgcccagtccatgtgtgtggaccaggtgtgtgcccaggtactggggagaactgccactcagagattagttcaggaagcaccctgggcttcctggtgccccccttgggctgtgctctgctctggggagagtgtttgacttgttgaaatgctctctcctttgagatgctgtgctctccctccagggaggagcagaggctgtgctgcaagaggctggggcatgtctctggaggagctcttgggaacaggaacgtgcttctcccagcgagagcagccatgccgtcttgtgagtgtggtgcctggtaggatactgcatctgttagttacttcccagtggctgaaggaagtggtcaccagctctgcctgggggaggtgggggagctgggctttggggcgtctccctccctacctccagagttaggtttcacctgagactgtggtttcacttttgactccatcttcactgagtcaagcagatgatttaggaatgaccagggagcagcattggtggtttgcctttggatctgcattggtttggacccatgaactctgtggtgggcattgtgtttgtgtaatagaccattggtatgctcatttttcctcttgcagaaagcactagctttcttgaaagcagttcagggacatgcccatccttctgtgccagagctgagcccttctactgggggaacatggagacacgcgagctccagtcttcattccactcctcctccttccctttgccctccactgtctcctgctgtccccccagctcatcccaggggcagggtaaccttggtgcatcctcccatccagccagcagtcccgacccagggcccccgtgcctggactgagtctggggtttatgtcagtagtgttaagggagggatggaaaactgaacttttaggagtgcagctgcctaggaacatagacctccatacctctgacgcaggggaaaccagaaaaaccgatgctgggtccacgtaggcttggaaggctgttactttttgccttcttacctgaataggaatttgaggggcactgtgggtttggaggatgtgattcccacactggggctcagggcctgggaaatgcagtggtccctgggttctgagtcctcctttgaaggccaccctgccagaaaggaagagcctgatggaggtttctggggactttgggccagccggtaactccatgctccctctgctccacccttggcccctcatgtgtataccattccttttatcacccttccctctgattcacagcccccaccctgacagctaaagacagaatgcccaggctgctgcctagaatgacaggaagctggactgccctttcagtttatacatgcaatggcctgggactgtctcttgagggcaagacattccccttttacaaaagagccttccccaggcccctctctcaccaagatgagctcttccttgctgccaggagccctgaaatcagcattcccagaggaaagaagatggccatctgggcttggcttccggctccccccatctggctggaacacacatcagtcacgtaagtagctgtgactcagcacccagcactgccttggcagaaccttcccacgttctggatttgcacacactgtggtagcgcagcacaagcaagcagggttaggtaactggggaccagtgtctgtttgttcagtgggtttgcctatggatttcagaaagaaggattccctcaccttcccattttcctcccatgttattttttaggtaccatgctaggctttaaagacaaagcatcatttatagaatgaagtagaagctgtctttgcagtctccaaactatttttaaccaacagcctatagatggtatttaaccctcaggtgtgtttggcctgcacgggtttttgtttttgtttgagacagggtttcactctgtagcccaggctggagtgcagtggcacgatatcagcttgctgcaacctctgcctcccgggctcgagcagttctcatgcctcagcctcctgagtagctgggactacaggtgccaccacacctggctagggttattttaatgtatctgattttgcatgcatttagacaaaatatggcctctccagttcactgtatttctgctgcatgctgttgctgcttctctgtctcaggtttcctgcccaagccctccgagcatttgaatgtgctgtgagcagcctacctcagcctcctctctttacacatgaagacactgaggcccattcagggcaagtggcaggtccctgttctcagagttggggccaagcaggtattaaaaccattgtgttctgattcactgtgtgcccaagcagattaatgccctggtgtgaggtcgagaagcctccaggtagaatgtggggacagaagtggaccaggctagagtatagctcccacacctttcccatgcgtggcagcactcgtaagactgacatgcccacccttctggatgggtggttttcctccccagacagccctgccaaccctttcaccttcagccagtttgtttggagtcattaggctgaggtgggtaaaacccatcaccctccttggatggcagagctctcagcaggctgggattttcatgggctgccttcttacaggtctaggtggccttcaggcatggtgccagggaaagcaagccccttccagcccttaccaaactaactggctgcttcctagtagggaacagccaccagcttgtttcagcgaagagtcattgctcagctgattctgagaggagaaaactggttctgttgggagggctgagacctgaaggaccccttttatccagtggaattggaaaggcaaaggatttcaatactaacatgatttttttctccacttcttttagagtgtttaattaaagtgatgcattgttaatggcttcttatctcttcttccagagagtaaagagttaaattttagaatccaggagtggggacccagactgtggcttctgttaactccctcagtggcagtggcgtcctgctatgcacagcccctctgctgtactccgaatggtcccttacgggtagcaggagagacattaaataatcacactgatgaccaagtgagataagtggtttttgaaggaaagaacttgaggctggcgaggaccacttaaccttctagcaagggctggactcagggaggctttcctgagctgcggggaggatgacaggttccctggagtggtggtgggtgggggcggggctgaggggtggtagccaagggagggtgaaggagagtattccagaagagacaacagcttaggcaggcaggacctcgccatggaggaaggtgctttctgatcactgcgggacacctgtgtgatagctcatagggagggggtactggtaactaaaagttgataaggaagagtggctaaaatgaaaagcagaaaagtgagaatctcatcaaatcccctcatttgacaggatttggactcccagtagtaactgtccttaaacactcactcctgaccttacaaccctggctgttacctggttaacaagccccaggtgttggctacaggtgtcatcactgagagcccttgtgtgcagatctgccccagctctcccacctgtgactgaggctagcaagtcccccgtgggctgtagagcctagcgctggtgtcagaatcgcttgttgcaggttcatcttcagtgtctttcccacagccacatgctggggaaagacggcaaaggcgctagaggagcaggagaacaaagcaagctgccccagaccacccggctttcgcagaacccagatgatgctcctgtctccccctaagtataacgtgttatgtagtcagtatgatcccattcagtgcagaagtatcgcctaggaatttcctgccccacccaccctgttttgttcttaatgaagttcaagaacaaaatgagatgatagtcaagttatggagcaggctgcagtggatacaagggcagaaacacagtctttggagttagacctgggatctgcattgattggttgtgtgactgcagacaagttatttagcctcattaaggatgaatttcttcgcaaaaattggaataatacctgccccatacgactgttgtgagaattaaacaccgcaacttttgatgttcaaattctatttcttctccttctagcaacacatactgttagtgccaggaaccataaaaattataaggctgtatctagaggcctgaaaggaagctaaaatatacagtgtctactctgtctcttttctcttggttatggtatcagaggaaatacacatattttcttagcttcaaaccaccaaaaaagatgatgcagtaaggagatgggaaatctaatttggaatacagtgtgcaaatcttattttcaagcagactttgaaaataaaactcaattcttacgttagaggattatctgcttaatacaattatagggtaccagtttttgaagtcacatcggggttaaataagattgcaggttcatggggtcatatttgaatgttctgatacttacatatggggtgggaaggaggaatgcatgcttttctcaagttaagacacataaaagagttgtcctggcccaggtgagactcgcctttgtgtagcagctggagcttcattccacaggcagatagggtgcttgtgtcctgatgaagtaagagaatatatctggaaacactttgtgtactgtgaaatactatacaaatgcagggcagtacaaatgtaaatattaatgtattttagtaataattttagcttttatttcatcatatataataatttgtagtgactggtgtgaagttaaatagaattaacctagaattaatgagttttgtattgctctcatctatttgaagcatcagctgtgcctttcatgttgccttgtgcagccctgtgtaacctcctctgtgcctttcccatggagcactgtgtcatatcacaagtagaactacaagaagatatttctcctcagggcagaggctgggtcttccgattgaatctcccttctttcttcattgagatcctcttcttctggaagctggtttcacatggtggcttagatttttccatctttgtatctagcaccatttgaaatcagtgttttaggagtaagaattgcagcacagccaagggtggactgcagaggaactgctgctcatggaactggctcctctcctcttgccacttgagtctgttcgagaagtccagggaagaacttgaagagcaaaatacactcttgagtttgttgggttttgggagaggtgacagtagagaagggggttgtgtttaaaataaacacagtggcttgagcaggggcagaggttgtgatgctatttctgttgactcctagcagccatcaccagcatgaatgtgttcgtagggcctttgagtgtggcgattgtcatattctgttggataacaatgtattgggtgtcgattgtcatggggcaggggagagggcagtacacctggaggaccattttgtccacatcgacaccatcagtctgctcttagaggatgccctggagtattcggcgttgattgcggggcacccgaaatcagacttgccacctggactgtcgaggtgcagaccctgggagcaccactggcccatctcttacacaggctgaccgatttctcctggtgttcagagtctgtttttgtctagcaccatttgaaatcggttatgatgtagggggaaaagcagcagcctcgaagcctcatgccaactctgggcagcagcagcctgtggtttcctggaagatggatgggcagagaatagggaaggaagatcatgcttttccctactaacttctgtaactgcatgtatgatacattattgcagaggtaagagatagtttaatggatttttaaaaacaaattactataatttatctgatgttctctagttgcattttgctgaaatgtagtgctgttctaaattctgtaaattgattgctgttgaattatctttctgttgagaagagtctattcatgcatcctgaccttaataaatactatgttcagtttatca

SEQ ID NO: 5638 - DNA, 1905 bp, Homo sapiens
cctagtaaggcccaccttcaggccaagaagggcctgaaggctggggcctgggctgccagtcccggaaaccagagtggggacttgtggtgcctcttcctaacccacccatggccacccacagaacaactggcatgcacttcctcccttctgaggtccataaaagccctggactcagccagagcagggcagaggatagctagaggatgaagagggcagagagatgatgggacaaccagctgcagaaaggagtaccctctctgccgatagctggagatgatgggacaacccacagagaggagccacattctctgctgatagctgcagcgacaacctgctggcagagaggaaccaccctctccagggcttcctctctgctgagagctgcaaacatcaggatgaccagttgcagagaggagctacctctcctgggcctcctctctactgagaactgaacactcgacagatgacctgcctagaagaggagctacccaatgcaggtgtcctctgagctgttgtaacactcaatagagctcatcttcgtcttgctcacccttcacttgtctatgtcccttattcttcctggacgcaggacaagagctcatgcaaaggcaccgtgaccacagaggtttccagccagaaaattgacacctcaaaggtcctgtaacaaagagacagtcaccaaagctgggacagcagcaggcatggggcaccacaggaccccaaaaccagtcctaccatccaaaaagtgccttacaaggtggagggaagagcaggagacaagaaagaagaccagagggtgtagcagactggctgtccagtggcccacatatcctcacctctcagctgagtgtgcagaacctgtgacttgcctgtaaccaatggaaatggcaagtgtcacggatgacacctccatgatcatgctccttaagattgtaacatccacatggctgagagtctctctcccctgctggctgtgatggagccctggccctgtggtggaggcccacatggcaaggagctgtgggtaccttcagctggcaaccagcgggaaaccaagacccttggtcctgaagtgggacagaatgaatcctgccgatatccacttgagctccaaatcaaatctttctccagatgagccttgagacgaggccaccactgcagctaacaccttgaatgtaacatccagctgccctgcagctaccctcctgaccacagagcccaggagacatggagtgtgcatgctttacgcagctcagtttgtggtgacatggtgtcacggcaacagacaagaaagcttcaggctcctgggaatcccagagcagctgcagggctcctccctgccccacactgagcagcccagcactctccagcaggcccattgcctgcaccttgtcaatgacccagatggctgtgctctccagaacctacccgagctcctacaggcccccagggttggctgtttcctgctttgtgcctgtcagaaggggaacgctgtgctcctaggaacctggaacagattctccctcacagtctcagaaggaatcaaccctgccaacaccttgatgttggactcccagcctccagaactggaagacatacatttctgttgttgaagcccctagtctgtggtactttattatggcagccctcccaaacaaatccagagatgaggcccaggacctgcgggcagagctaacacagggaggctgacttccggccatgaggagccccaggccaggcctgtcatccaggcggcccccaccacatccactcaccaccctgcatgcccttgtggcccattatgctaactgttcctgggaactactgaaaatttgatgcagaaaatccactcattttcctaactgttcaaaaacatggtcctgaatgtctattttagcccaggta

SEQ ID NO: 5639 - DNA, 1844 bp, Homo sapiens
aagaggcagcaggcttcgtgagctggggaagtgccagaagcagccttcgaattagacagacctggacccaaaccctttctcttccccccacccattttggcatcttggcacgagactgtccccatttctggaaagggtgttcacaagaacagtctggctgggttgttgggatgaccgagtgtgatcatgcgtctctatggctggccatggtgtttattcgatggcaggtattaccaggatggagcgagtcccagtaggaagggcctttaggatgtcatctggttccacccaacagggatgggaactgtaattccccactctccctgtggagaatcagggcgggctccggatggatggccaaaggctgcacagaggtgagcctccagggttgggttctaagcgctgttcacactcctgtcccagtggtgtttggtctggggcacattgtgatatgtgtttccctcctttcttaaaattagctcttggcttcagggccttgtagtggactgatgtccctccttaactgaacagtcagtctgcttatttttttggggtggtttaggggtaaaaataagtagataactgaacaaagctggctggcaggaaccttcggctgaccgcagggctttggtggtggtcaagacctggaattggatttgaggcctggccagcgtgaaggatatgccataggagcccaggaggatgactctgccaggcctgcttttgacatgtctgtcatgcttcatgctttatgctgctctgggccattaagcaagaactaaatctgatgcccaatcaaggctgagctctttttttttttgagacactgtctcactctcttgcccaggctgtagtgcagtagtgtgatcatggctcactgcagcctcagtctcctggactcaagtgatcctcccacctcagccttctgagtagctgggagtacaggtgagtcagccacaggttgaagatgacagtagatcctaaggaacctcagttctatcccgaaatgcgaaggcctttttactcaaccacaaagaagtggtcagcagaaaactggtcatcccggcctctggggccatgcacagcactcaggaggagctactattttccctgcctgtttacatgcggcctggggccttgtgggctatttgaaaattaggacacgagaagtccaagcagcacctggtaattaaactgagtcctctatcagagagaggcgtgaccttgaagggcatccatacaggagccaggggcaaagcagaaggtgggagggattctccaggcttgaccctctcagcacatctcagtcaggggtgcctggcagcctagattccagccctgcccagtgccacccagagacctgagggaggtggacagctgctcagctgggtgatgggagcctctagaaatagttgtcaacctcatcaaaccagagatgagcccttaggacagccagggtgttgatttccagccaggcagggcattggttctccagtgggatgtggacaaggttcactgcagcctctcagcagatgaactaggggagagacactaccccaaccatgctcccccgacccttcggtgttaagtgaaagtatcttccttttttctctctgctctctccgctttacaacaaaatattatctttagtctgcaaaaccagggccaggaagaatcttcacagctagacagggccatggaaagatgatgaggcatatcaggaactatgtaatcttgtaatacttctgctgcaaaacctcctgacgttctgaatgaacagtcacatgcagcctcttcagtgcaaaactgagctcataagaaagtaaagcaaatctgtaggggcc

SEQ ID NO: 5640 - DNA, 1797 bp, Homo sapiens
ggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtctggaa

SEQ ID NO: 5641 - DNA, 630 bp, Homo sapiens
ccatcccatctcttggacagatgatgccagttaattactttgaatgcaagtttgaaaaccactgctttaaagaaaatggatactccccttaccaagcagaaagtaggattttggaaactgatgcaagggaagcaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaatttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaatggcactcatcataccttagtttttaaatctgcattgtggtcataatctgttatttaattaatttctcgtatttttaataaaaacgttgcctata

SEQ ID NO: 5642 - DNA, 4226 bp, Homo sapiens
actgaggaagaatataagttagcctcgtagtgaccatgtggaagtcctgacctcgcttgcagacttgacctctggatgtgacaaggtgaggttctgtgttcactgatacatccccttccttcaccgggctcatgaaaagaaatgctgaatcagcaaatagagtgaacgaacaatcaagatgagatggctgctgttgatgtgattctctaggttactacctttcttcctgctgcaaatgctgcatgacactaagcttacaggatctagaagcagactacaaaaaaagaagaaattcactctgaagactgaagaaacactaggctgatcttaagtttccgaaatacactctgtaacactacactgattctttgaatctcttgcaaaaagaatcaaaccaggacaaagttcaacagataactggtcaaatgcttaggaatgtctatgtccaccaagaatatggaaccattaatgccatgcttcaggtaaacttgttacaaaatttagtcttcgataaattagtctctgcaaatgatttaccattgctctacattagtaagctgaatgtttcactaacaaataagaaaataaaatatttcatgtttttacagctaacaacttagtaatacctactcagagtacatacttctttatgtacccatatgaacatacaatgctatggaatgtaaagaagtatgtatttttggtaggcaataaaccaccaagggagaattaaactgagctaaaagaagctcttgcttctttctacgtgaatgaccgtcatatggtaaattaacctagtcatgaacagatgacctttggcaatactaacaccaaaaaaaaaaggttatctactactgatagatagaaactatccctaaggtttttatttcatgaaggaaaagaagatccagtgaagtagatttcaattatcatgaaactccttttaaatcatctaagtttaaaacagacatcttacatttttaaattaggcactctcattattaaaatttgactgcaaaagggaaaatagtattactagcacaaaagaatgaggaatacacatgacctattttctgtctccacaatttaatcttaagtatatctcattagtagggctcactgatttgtacagaaaaataagatactaagagctggcttcattcacataataagctatttcttctcattttgataaatgtataattaatattagaggaatttctgaccaaaagttttgttgttttaaaaaggctttcttttttgacagctacaaacatagtggcccttgtccttccttctcaagtttatcagggtcttaacccaaatctctactttaaatgtgaagttaaaacttaaaattaattaaaatgtaagatttaagcatgaaaaatgacaaaattctggtccacagctgtaagtcagcagggtatattggtaacagactaccaaatatttaaaagaaattaatttatctgtattatcttcgaatttgctttctccaaagagggcatgtaaaatgaaagcactatagtcaagaaccaatttatacagatcgaagaactgtttttattgtactatgcaattacaattcaatttctctaaacttgatcaatccattgtttagaaatatcaaaatacttttatttcacacagtttgtatattatttataaaaaattccaaataatgctcttagcaaaatttataagcagtacctgttttaagctactaatgacaaagttagaaaataagagtaatattcacatattctaaccatttcttactaaaagtattatttcaactgaaatatttacacatgtataaaagcataatattttaaattttttgtatcagaaattgaatggaaatgactaagtttaactatagttcattttctgtttaataagactagttaatacaaagatgattttcattttatcagattataaagaatgagaatgacttacacatggcatcatatgtgttactgcatgtttactggaaattataaaaggcacataattttaaaattctacactttcaaagaaattagttcaaagcttaactcacataagcatagcccttctgatcatccacaaaacagaatggcaatgattcatgttctatttggtaagtttacctgtataggtcctaaataccaagaactcaaaatatatacctcaaaagtagaggttcttctataaaaatactcaaagcttattactctacttgtgttttataataaacagttatattggtcattctataggtatacaagttgtttaataatccttctcaaacatcctagcaactaagactctctttgctataatattaagactatataaataatccttagaaaataaaatgacaggctattcatttttaaaagtaaaattatatgctgattctggtgcttgcgagtttaacttatctaagagtattttcaatcactctaaaatgtcacatctatcacttagatcagctgttcatttttaactgagtacatattaaactctgggcatctgctgacactggtataactcaaacatttcaactgtctccctgacagggataacagatgctgacattatcaaatgctgtactatttttttcccatggcctctccttgccccgatatggccagtatatgaaactgaactgccatccaaaaacacacttgagcaactggatctgctaaacagctcccatataactagtaaaaatagaagccagtattattgctatcttcagcacttaagtttaggcagtttaacacctgtttcacttctactagaaaaaatgatgaaaaagaattgtagttaatttcaccagcagtatgatacttaccaaccaacagacgcagaatatacttagtgtaagagtcatttgcatactgcctgaattagcgttgacctctcagtttaaaatagtaactgtaaagaatatttctctactctatatttctctgagagcacttaactttataggcaaattataatttatcaaacttttattttatgcaagaagacacccctctcaagacattgaaatcaacagtaaaaccacattataacaaaaatttactctgatttttcaagtattatccacacaatagattttaatacttgtatccatggattgtaactaaccaccatgtattactaaggcgataatgagaagtaacttggcaatctgtacccaaaatgacaaagaacttagtcaaggaaatagacctttaaaagggttaaattactaagctatgattagtaacaccacgtaagcaaaaacaaagaaaaactggcatgcatggtagttcctttcgacacaagtccaagcaatacactgaatacacatgtgatctatttataaatcaaagggcagaggtactttcttaaggccactgatattcctacacccatcaacaatttgctattagccctcaactataatgctaaaagaagcagtggcagtagaagggggtgactaactgaactcttccccaaccttttagcttaactatttatctggtttgctgcctagagataaatggaaaacattactctaaaatacatcaaggtctatttgttcctttaaatactattggttttgaaatagcttattgtctacatgtaagaattaagcaaagacttcggctgtggacaagattagaaaaagaaaaagaagcaaagatgttgaaaacaaagacgtacattgatcattccttaatgcagtaatgtgttaaaaggaaaagatttttaaaccattaagcgcaggaaaacagtaggaaagtgacttcaaaatggaaaatttgacattcagtgactgaagcattggtatgataatttctaacacttgtagaaggtccatgactgtaattttaccaatgaaaagcatttaactgttttggattccaaactagcagcactacaatgctttgctagagctggtaaaatggaaccaaatcgcctcttcaatggatttggtccccttcaaccagctgtagctatgcattgattactacgggacaaccaacgttttcatttgtgaatatcaattacttgccaactaatttcaacttatttacattatgcagactgtgattataatcaaataacttgttactgttaattctacctggaaaagctagaatggttaaagatgtttataaaaagctttatgaaaaatgtatggatgacttaaggatttcaaataaaaattttactta

SEQ ID NO: 5643 - DNA, 11032 bp, Homo sapiens
ctccgtggccgcccaggcgccacagcggggagccgcggtcgacccctccgggatgggggccagggcagcctccgcggctatcccgggagtcctgctccgacaccacctccacaggggaagccgctcggagagacgcagggacccaggcaagggatgcgggcaaacgcgccaagggttcagcagaggggcgtgaccgccagttggccgggctgagcgaggcgccagagggaagcctgcaaggtacgtctgcgagagccgggtgcgggcgcggcaggggaaaaggggggcgctgactctcttaccgccaggtccggattgcggctgtccctgtgtgacacggctcggatgacccccgctcgccagcttcgccagccgcgtccgctctcccagcgctccgaacgtgcctcgtcgccgaccgccacacacaggaaccgcttacccaccagctctgcccgcgtctctaccgccatagctgtcgctgccgaagcggccgctgcctcctccagtgcgagggaaccgatgaaacctcactcctaccggccgctcatgctgaggagagcggaccgggacacagcagcggacccgaaagagcgcagactcgggacgaaccggccgctctgccccggacacagcgacctcgggccctccccgcaaacactcctttggactcccagattcgcagccttgtgctgcagcgccacacaagaaaactgaaacaaaacccaacgcggccgtcgaagaccccgaggcagcccagccgccgccaccgcgccgcggccagtactgctccgtctccctccccgggcagcggcggcgcgcagcgcgtctccttccgccggcgcgggcggggcagcagccgcgggagggtcggcggaaccaccgcagacggaaagtagtgcccggccctgcggaggcggcagcggccactgggtccgtccagatccagaggcggcggcggcggcggcagcgggagacgaaaaaatgaagagggccgcgggaaagtaggcgacagctattcaaagcttttgggggtctacctttgtattcgttgctccctcagaggtggaggtgaggggaaagtgaagtgtagtggttccactctgatcacaaaataaactcctgggttgacgcctcacccgcggtttgatgttcagagcacacagcgcccgccgcctgagttagcctgaattagcagtcccgcagtaacagcagcagagcaggacaacacttctactgaaaactaagccccaaagtcacagcagaaccaaccgttcatgacttcaagggaaaacgagggggaaaatgtgatcctttcattcttctcatttgtggtgatactaattacatgtttaagctattcacagatttaaattcgtcactgctttattataagaacagcaaatgctccgtggcgggcccttgtcaacgtcctgaaatttcacaaaccgtgtctgcgacagtcttagtacttttagtactggtacacagctcaaacacactggtcagataataaaagcagagaaaatccccagattcagttattagaaaataccatggaaagaaaaggattttagccaatcacaattcaagaaaaaaaatatttatttcccatccaattacaatcggactccctaacccacacaaagatctctaacttggaacaatcactcttctttgatcaacttatttgttataaatcaaacctccctacaaatgtcagtgagcagttcgatttcaggcaccctttatactgcttttttataggtagtccaatattctaaatttcagtttcttgagattttcctgaacctctatttaaaaaaaaaaagttaacagagtttacagtagtaatctgaatgtttaaaataactataaggcttttatctgttttctctagaacactcaagctgggcaatttgaagtggagaaacacaaccactgctaataggttagaaaccaaaattataaggaagatggattttaataatcatggtcaaattttgccaaagaccaaacatagaactgtaataaataggctgggcacggtgcctcacgcctgtaatccctgcactttaggaggcagatcacctgaggtcgggagttcgagaccagcctggccaacatgatgaaactaaatgtatttttagtctctactaaaaatacaaaaaattagctgggcatggtggagcatgcctgtaatcccagctactcaggaggcagcaggagaatcacttgaacctgggagctggaggttgcagtgagccgggatcgtgccactgcactccaacctggtcaacaagagcaaaactcagtccccccgaaaacaaacaaacaaacaaaaaacctgtaataaattaaaacagcaaaacatacccaaaaatgcatatcggcaagttgagagaaaaaattttgcttgggcaattttatttccaagtccactttttcagtgtacactgtataatacttagcaaattatcttaagaattacagatgaagatttctaaaatcagtgtagattaaggaaccagtaaagtgacttggtgacaataattcaacatatgtaaggataaaagagtagggagatcaacatccagataccaagtcatcaatgatctgctttgtgaccatgggcatgatgcaattgtaaaaatgcaaaaatgcctgaatcctaattttcagtgatatcctaggagcaaacgaaaaatacaaataaagtcatttgagaaaaacatgcaaattcatcagttattacataaatcccactcaccaaattacattcttaagagtataggttgctagttgccttatataaaactgccagctgttttcaattttgtaggcaaactgctctaaatgggcccctgggaactcccactacatgttgaattccatccttttcagtcctctgaaaagcatgtaatccaacaaatcaatcaaaatatttcatgtatagaaacaaagtttttcaggagggcatatatccccaaaatatttttaatcaagtatcttaatattcttagaactctggtccaaattctcttctactaatcccttgactacagccaatgcctagagtttacactaatttgtggatattttgctgttggaaaaatttaaaagtacatttttttaaatgtagaataaaaagtccttaaagattttttgtttgtttgctggcattttttgcttcgttttgtattaaggggtatttttattattttatttttgccagcaaatcataactttgtaaataacaaggaatttaaaaaatttttcaagttggttttgaaacttcagaatatttgtttcttaacttgtttccttacattctttacttccataaagatactcggaaacagaagagtaatggtatttgttttcattatacaggtaaaaagaatgacagtgaattacttaaaataactaagtttacttatagaagctgaaaattagacatataaattagattttctagtctttccatccccacgtgtaaatatgtccattaaatatgcctatgcacacatcaattcaagcaaacctcctacatcaaatatcttaatctacaccaaagactgggagattatttgattttttccctttttagaagttcacaaaaatttattcataaaaacagcttgggctggatgatggcatgtgtctgttgtcccagcttctctggaggctgcaactggaggatctcttgagcccaggacttctgttcaggctgggcaacatcacaagaccctgtctctaaaaaacatttttaaaatacaaaaaaaacccacaaactattttgtttttttaaaaaactgacttataaaggaagaaaatgtattcactgcaataagaaccataattatctacttagtttagtctgaataagcaaaagcctagtagttatagatttttcactttttgacttggtatgtaactgtggaaagtgtcaatcatctgctctcatacatactaatattttatgtcactatacatgtctactttaaatatcacagatattatctaacacagacaaaaagtttaacacatctttttagccaccacttatagaacacttactatgtgtcagacagtatactaagtactttacacacgtaatctcattttgaggataaagaaaatgaggtttagagaagtttagtaacttgcctaagaatacacattaagaaactggttttcaaaaccagatcttgtgataacaaaggctccctgctattaactattatactaaaaagtcacttaaaagaaacgtgaaggtcagttatcaagttgtttcatccttatttacagtttactcataattgctgtgttcagtatttatttagcacttactatgtgggtcacatcctgcaaggttctggagataggacctttatccttgagaagctcacagtctatctggaaagatagacaatagaaatgctttggtttatttaattaaggaactatcaatagaatttcatccaaatttaatgcattttaacaaatatttttcaaacctattataacttgaaggcttttattaattgtcaaatgtaaataatggactgcgtttatgaagtcttagattatatatatagatagggctaagaatcgtgcaagccactatttaaatgagggaaaccaagagtttcaactgaattatgcaagtggaagaccaagaataaatggaatataaatttatgttaccatttttttattaaaccttaaataatttgtatttggggtttgtataccctaagcacttatttaaaatgaattcctcaatcacatttatgataatgataaattaactcaaatatcaaaatatcacttcctcaaggaaaccatccctgattctcagactatgtaggattccccaataacagattttcaaaacatgccttatttgtcttagtactaccacaactgtatttacaccatttattgtgtaattgatcatttatattttttccctttataggatatataagctccataaggcatctttgtcttgttcataactatactcccagcagctaccaggccttgctaagagatgataaaacatgttatagcatgaatgaatgaatgaatgaatatagcaaaatgtacctttttctaaatctaactcaactaagaggaacttagaatctcggacataaatgagagttcctgttcttcctacagggttattcatcaccttcaaaataatgtcttatgtacattatctcttttcatcatggaggtacaatgttaagccttcgaaaacatgcttcagtagaaaagcaaggtttttcctgggaaaatttctaaagaacagatacagaaggaagagttacaattctcaagaaaaaacattcatttcattaccaaactaccaatttaatacaaacccaaaaatgatcctatgagtgtatatccaaaacactagtctattcttagtcttctaaaaagaacagtctcaaataacatccttgatggagccaatatacaaacataactttctgactatcttcttgatgccatggaaggagggaaagagaagaaaaaaaggaagatagaaaagaaatgaaggaggaagtgaagcaatctctattgggccttctaattgtactttctatccatctgttatccagtttccagtttaaattctggctgcacaggaatgtaccacttcttttcaacattctcttctctattaaaaacaaggttgatttttaatgataaaaaattaaaaatttagaaagaatacacaaagcatcagaaaattcctaatctgctgagtgaggaactacaagaaataaagaaatggaaagttgccattgagcacacagtaagagtcttgccagcgtgtcccactgcactttttctctgttcatcatccctatcataaacgctccaactattaactaccattaaaatatgcaagtctgcactttgcaaacaggttaggttccaaaagggtcgtgttcttattaatcttacaagctttcactattgttacaagttaatagcagcagggtaaaagtcttctgtttatatccatgaaagttcattaagtaaaggaggttctaaacttgtattaaaactataaatgaaggaaagccaatgtaaaatctaaactaaaaagtaataccaactcaaaatctctgcatgctaaccatatactccatctatgttcttcctcaccaatgaagctaggtattatataatgaaggaaatttataatcaagaacacacgtaattcagcaaggagcaaagtatgctttcctgtcacgtggtaggttcaaacccccaaaatgttaaaggactgacaaaagtaatcttgcttagcaaaacaaatattgttagaaagacttcagcatatgctatttctcaaaggtctcaaagaagatatacatatgattaatactaatattactacatactaattactaatattaatacatactaatataatacaaaccaaagtactaaataacagtttttaaacatcattgtaaaactgcttctttcctctgctttccaagtttggtcataaaaccattatattaaaacaaataggtcaggcatggtagctctcacctgtaatcccagcacactgggaggctgagtggggcggatcacctgaggtcgggaatttgagatcagcctgaccaatacagtaaaatgccttctctactaaaaatacaaaaattagctgggcatggtggcacatggctgtagtgccaactactcgggaggctaagggaggggaatcacttgaacgcgggaagcaagagacttcagtgggctgagattgcaccactgcactgaagcctgggcgacagagtgagactcagtctcaaaacaaacaaacaaacaaacaaacagtctatcaaaactaacttgaaatggaagaatttttgcaatgttctacattacaaataaacttttgaattgacactttttaaccttatataccttcttcatctataatagataaaaatcctatctcaactattatatattatatataataatttcttaataatttcaactattctagctacaaaaattatcttaaaagcaattgcttcatttgcttttatatctaaatttgcatggatgcttctttcccccacttgcaatttcttttttatttaattatttatttttttgagtcagagtctccctgttgcccaggttggagtgcaacggcgtaatctcagctactgcaacctccacctcctgagttcaagcaattctcgtgcctcagtctcccaagtagctggaattaaaggcatgtgccaccacgcctggctaatttttgtatttttagtagagacggggtttcactgtgttggccaggctggtctctaactcctgacctcaagtgatccacctgcctctgcctcccaaagtgctgggattgcaggcatgagccactgcgccccgccctgcaatttctttttatattcacaagttttaaaatttcatatatagccaaatatgctaatatatttatgttgcagccttaaggcatgctttaaaaatactctatgtaggtattctttggtattttcttttaggaattttataattcaatttttatttatttatttatttttgagatggagtcttgctctgttgccaggctggagtgcagtggcgcgatcataggatcaccgcaaccgccttctctcaggttcaagcaattctcctgcctcagcctcccgagtaggtgggactacaggcgagcgccaccacgcccagctaatttttgtatttttagtagagacagggtctcatcatgttggccaggatggtctcgatctcttgacctcatgatctgccctcctcggcctcccaaagtgctgggattacgggcgtaagccactgcccccagcctaattcaaattttaaatctgttaatgtatcccttaattacaaaagacctacagaatagagatataatactttctataaaactaataaagatgaaaaaaacattaagtaggacaaggatatggtaaaacaaatgctctgttgtagaagtaatacacatttggttaaaaaaacttttttttttgagacacggtctcactctgtcatccaggctggagtgcagtggcacaatcttggctcactgcaacctctgcctcggaagttcaagcagttctcctgcctcagcctcctgagtagctgggattacaggcacacagcaccacacctggctaatttttgcatttttgagtagagacggggtttcactatgttggccaggctagtctcgaactcctgacctcaagtgatcctcccaccttggcctcccaaagtgctgggatttcaggcatgagccactgtgcctggccaggtaaaaagaacttctaggaattacaggtcacttattgcatcgaaactggacttgcctttacattcttaatgtacttttacttttcctcaagatatgaacttattgttgtaaagctgaattttctttcgctacttaaatcatttatgtatatctggtaaattatgactaaatttttgttaaattgcataaagtaaactgaaatacatacttggggccaggcacagtggctcacacctgtaattccagcactttgggaggccaaggcgggcggatcacctgaggtcaggagtttgagaccagcctggccaacatggtgaaacctcgtctctactaaaaatacaaaaattagttgggcatggtgatgggcacctgtaatcccagctactcaggaggctgagacaggagaatccctagatcccgggaggcgaacgttgcagtgagccgagattgcgctattgcactccagcctaggtgacaagagtgaaactctgtctcaaaaaaaagaaaagaaaaaaagaaataaatacacacttggtacactaaaaaaaataataataataaataaataaataaataaataacttctgggaagcaatctgaccatctttactgataacagccttaaacaaatcataccatttgactcagtaattcgactccttggaaatcaccctcagtgaacagactaaggatatagaaatatggaaaaagtatgttagatgctttggtcaactgattgctgagtctctcctcaatcgctaaaatgagtgggagtgtaagagtgcttataaagcgggcagccgtgaagaaaagtgttttaggatgagagagatacatacttgaatcctgaagaaaatttatcaaaggatggggatgaaatagaaataaaaacaccttttttttttgtttttttttgagacagggtctcactcttgtcacccatgctggagtgcagtggtacaatcatggctcactgcagccttgacccacctcccgggctcaagcaatcctcctgcctcagcctcccaagtagctgggaccaccggcatgtaccaccacgtccagctcattttttatttttttgtagagacgacggtctcactattttgctaggcttgtctcaaattctggcgttacgcaatcctctcaccttagcctcccaaagtgctgggactgcaggcatgagccaccgtgctcagcccaaaacaatttgttaaacagagcaaaataaaatcaaagagaagactgaaggtaatggggtcaaaagttccaaattatgtagtccagtcagcctactctcaaattattaaaaaaaaaaaagaatgagtaataatgtaatacggaaaatgtgacaaattgttaaatgaacaaattacagcaaatctaatgaatgctgatagaagttggaatagtgcttacccatgggggtgggtagtattgactgtgaagtggcatgaaggtgctggaaatgccctatatcttcatcatatagtgatggttaagcgagtataaaatgtaaagataaatcatgaaaatttgcagatgttcatgattctaaacataattatcctttcctttacagttataataaataattacatcattattacttgcaacatatgtagagtcattatgtctctctcaaatgctcagttcgattaggactgcatttatgaaccctggacagctaaggatactccccattttacaattttgttttatgcttttaaaaaaataatccatctgaatacatacttcctagagggaatagaaatagccttcaatttggtctacattatcaccactgaaaactatgttttacttagtaaggaagatctaattccatgaaaatagttagcgctaccttaaaaagttcgggtacttgtcaaaaatggcttccaaatatattccttttaatacaggatgtgaaaacacttcctaataaattcctgcaaaattagatgatactgtatgtacttctgaaggacagacaagaaagtaacctaagaccaaaacaatagaggtctcctactactggggagaaggaggattatcaagaatagaggaaaacagagcctgcctaagactaatactggtctagaacaaaagagaaagctcaattcctaccaccacaaagctaaacagcatccaaggccccatgcccaccacaacaacacaaactagctccaagtaacacctaagtaagagcattcgactactagagaagtagcaaaagaacagagagagaccctctctgaagttcaggtgcgcagataaggctaacaggtaaacatgaagtaaaaacattggtcaaaactttgcagcaaatcaatccccatcttaagtactaggtgataatagatttaaagttgataatgggctggtagcagtggctcacacctgtaatcccagcactttgggaggctgaagtgggtggatcatttaaggtcaggaatttgagaccagcctggccaacatggtgaaaccctgtatctactaaaaatacaaaaaattagccaggcatggtggcaggtgcctgtaatcccagctactcgagaggctgaggcaggagaattccttgagcctgggaggaagaggttgcagtgagccgagattgcaccaccgcactccagcctgggcgacagaatgagattttgtctaaaaataaacaaatat

SEQ ID NO: 5644 - DNA, 2257 bp, Homo sapiens
gttctcggagagggtgagttgaaacgctgcctggaaaggaagtaccaggacttgcacagtgatctgcaggtcttcgcatgacctgtccttacattactgtgaccattgtggtataatatttactattttacctttagcatttgattcattgacagactatcatgtttcttatctcactttaactttttatatcccctcttacatgatctatgatcttttattcttttgtctcaccaagttggtgatcttttcatcttcctgtgattttgctcactttccttttcacttaattcactgacgttgtacacttttgcttctgtttagctgaaaccttttagggaatgtaatttctgtatttttagtagagacggggtttcaccatattggccagagtggctcacgcctgtaatcccagcacttcgggaggctgaggcaggagaatcacttgaaccagggaggcggagatggcagtgagcctagatcgtgccactgcactctagcctggtgacagagcgagactctgtctcaaaacaacaacaaaacatttactgcattctagattttgtcttggataacctttttctcctttaatctctcagttttgtgggtgagtaaactttaaatgaaactctaaagttttcattgtatttgtattgtaaaataagtccacctctttgtagttacttaatgttttacgtttaaactacaaagtatctgtctttgaccacagcactagacaggtaggtattcagtagcctgttaaagctgtgcctttgaaaattgtagaaccttgagaatgtaagatttatttacgtctttgtatctctgttaaaaggaaaaagagtaaatagtttgtttcttttatttaacttagttattttgaagataagattatgtgaaatactttaagctgtacaggggaaaatgacttggtcagtcttgcatataattcacttttttagccaatgcaagtcagtttagcccattaaaatttcatgaatcccatgtcactggggtcagtttttaggcacaagtctgataataacagtgctttatgatgtttctcctcccacacatactcttttagcataatggttgcagtgaaaacaattccgtatagcctctggttattaagtaaatatttatatatttctattaggctgaacacatttatgtgtacttggctcagttaaaatagggcatgcaggaatgtatgtgggggagcatgaagaggacatgaatctgttacctaaattaatatacattgttacttatgttggatcgcaaaagtggtagtataaggtgaacattggcccagttagagatttctcatctagaacagagagtattattttcaccttagtgaccatgagccagtgaagagcaacttctccagatccagtccaaacttgacctaagtctaatgttccccaaagattaggctcttattttctgtcttcagacttagaccaaaacttgaggggtttactgggaaaaaaaaaatctacaatgaggttgacttagaaaaaaaaaaagaatccatgctctatttttgagtcataaggatatagtgtcatccggccgggcgcagtggctcacgcctgtaatcctagcactttgagaggctgaggcgagttgatcacctgaggttgggagtttgagagcagcctgaccaatatggttaaaccccgtctctactaaaaatacaaaaattagctagacgtggtggtgcgtgcctgtactcccagctactcaggaggctgaagtgggagaataacttgaactctggaggaggaggttgcagtgagctgagatcgtggtactgcattcaaacctgggcaacatggggagaccctgtctcaaaaaaaaaaaaaaaagttgtttgatataattgatcactcttcccctgcaaatctctattctctgcctctgtgacactgcactgtcttgcttctctagctgttttttctctacctgcttaagaaggcattattctgattcttaatttctgttgttctcctgggttcctccttagcttttcagtctgtcacccaggctggagtgcagtggcgcagtctcggctcactgcaagctccacctcccgggttcacgccattctcctgcctcagcctcccaagtagctgggactataggtgcccgccaccacacccggctaattttttgtatttttagtagagacggagtttcaccgtgttagccaggatggtctcaatctcctgacctggtgatcctcccg

SEQ ID NO: 5645 - DNA, 1160 bp, Homo sapiens
agcaaaaggattatcacagaagcatcacaacaggcgcagacttaaattcaattaaaagtaggcaggaggacataattttgttgtatagaaattatggaatagggcctaattttaaagagtcttcaaagataaacatatcaggaaaaatatagctcataaaatatggggaaaaaaatctgggaagatgagtatttgttaatgctctgtagctccattgccctcagtatacaaggaatgtgcccacaatagggttggatttaaaagtcttcaaagctttggtctctttttctttcgttttcctctgatacagaatgcgaatagtctcccggcctccaaccccctctacatccccaccaccccataatagagacttaaagggaatttaaattcgagttcttgagcttctgctcaatggctaggtctttgaacaagttaatatcagagccttagttcttcacctataaagtaggtttaatacttaccttacaacattgaggattaaagagcatgagaggattactttatgaaaggtgaagcttagaacagaatttttagttccttgccaatgctaaaaaacaacaacaacaacacctttttcagaaattgctttattaggcttttgtacaaagggaacatctttactttctttaaatttgcacatatatctattgtgaaattttaaccaagctggaggggtcactagggagcattgagtatgatactattgctgtaaatcatagaaaggctggctcaggagggtactgacttgctttgactttgcggcaacttcagttgtccagtgacaaggcttgctgcatacacaccactttgtttgtttctcataccttaaattgtggattaaaaatctttggggcaggcctggaggctcatgcctataatcccagcactttgggaggccgagatgggcagatcacttgagcccaggagttcaagatcagcctgggcaacatgggaaaaacctgtctcaacaaaaaaaatacaaaaattagccaggtgtgttggtgcatgcctgtagtcccagctacttagaaggctgaggtggaaggattgcttaagccccgggaggtggaggttgcagtgagccgtgagcatgccactgtacctaccccgttttgggcaacagagtgagaccctgtctc

SEQ ID NO: 5646 - DNA, 3555 bp, Homo sapiens
gaaagttttcactgcatctcttgtgggatacgtataatgtttggcagatgatacttttaaatgacaataacaatagttatttttcagagagaggaatcaagatagccctgcaaattcagtgtagttgttaattctctgtattcttattaacaagattcctttattcatttatttatcaaatagttatcgagggccttatataccagacatcagtttaggtgtttaggatacattagagttaaaaaaagacaaaaatccctgccctcgtcaacttaaattttagtgagggaaacaatacataataaacataataaatagtaaatgacatggtatgtaggaaagtgataagtgttatgggaaaatcagagggaaagggggttagtgagtgctgagggaatgtgggttgccattgaaatggagtggttagtatatgcttcattaagaaggtgtcatatgaataaagactttgaaagagatgtatgagttaccaactgctacataaaaaactaccccaaaactcagtggcttaaaacaattaaacatttgttcactcatgaatcagtagatctgttagttcttagtctgagccaggcttgttttttctctatagggcttgctcacacagttatggttagctacaggttagctggtggctggctttgctaatcttggctgggttctttcttacgtatgaagtcccatctgggacaacttgactcagcctcatatgatctttaataatccttcagtaaactagcctggacctgttctcttggcacaataggatctcctgaggtttgggctcagaaccagcacaatgttacttcgttatattctgttgctcacagaaagtcacaaggcaagtccagattcataggctggggaaatagacttgatctcttgatggaaaagctgcaaagtcacattgcaaaaggctgtagatactgagggggacagccatttttgctgtcttccacagaaggcaagggagtaagccttgtgggtgtatggtgctggaagggatgggtgaagagtggaggaggtggcagagtattccaggtagacagaatactctgtgcagaggctctgtgagagtgtactggtgttaaaagaacagaggctagagtgtctcaaatggagtaagtgaggagagagttgtaggagatgaaaccagggagaaacaaggacaaaatcaggaagaggtttctttttgccataattaggacttgggcttttgatcagagaaatgaggtttccccctcgttttttgtgagttttattctccatatataaggtcaagattttatcttaatctttcattttcagcagtttgactgtgtgtctaggtagtttttgtttttgttgttgatgctgttgcctgggtttttttgttttttggtattaatcctgcttggggttctctgagcttcttggatatgtggcttgttgcctttcattatttttagaaaatcctctgccttatttcttcaaatatttcttctgccctctttcttcttcttccacttgtatggtacctgacatctcttcctgttctgctccaccacaggtaagccagtgcttgcatctcgtctctcctgggaaagatctgtctttccttggattttaagcttatagttgtcctgtaaccccagctctgatgggatcaagaaaagttatgattttgtagttcattaactttttcttattgttaggaaaggagcaatattctcccaactctgctccattagagggttttgagtagaaggcaggacataatctgatttatattttaacaagagcagttaggttactgtattgaaagtaggtagaaggcagggttggctctaacgaatttgaatgaggagcctcagcacttttcggcgccattttcgagtgatacctgatctcatcaatctagcggaagagacaggataacctatccaagagtatagcgccactatgactccgccggaaaaattactttaaaaatcgccaaaaattacttggagcaaagggcagtaggcggagcttcgccaaggctggcgcagtcggttttgacctgtagcagagaaccaattctggagaacagcctcacttctttgattgaatactcacataatgctttggaacaggacatgagattaaggtttaataatgatagaatgaagaccataataaaagagacctctacttacctcagcaattcttacctttcttacctatttgatgaagatgtcttttgaaaggtgtactgcaaggaacaaaatgtttgtaaattctgcttttaccaaggtttcttttttagttgatgccaaagagttccaatattgaacatcttaagtctgttacttggagtatggattgagtttggagcttactcagaggactacaggagagtatccaggaggtggataattactgtaccttcctcatggaaaaagttttatttaaagtgttatttctcgttgaatactatcaaaaaggaaaaaaaaatgacctaaacttttgagacagatttggctctagtaagtatttagatatatcgcttgcatatctgggagaagaaataagagactatcatcaatacattcccatctactaaaaaattttattttacacatgtcaagggattacttataacttccattgtcttttttttaagcctatatgcaatgaaaaatatattggcaaaataaatatttaaaccttttatgttaaaattactgtgaaagatgacaagttagctgctgtttttgtctacattatactgaaattaaatgtttataatttatattttgggtttatttatttataaatcatggaatttatgcaaaaaacatgagtagtacagattctcctctaattctgtaggactttgaataatgtgatatttttcttatagttggacccttgtgttttgaagaaatgccaactgcttgaagaatttccttgttatttgtattatttgctatagggttagatgttgagaaattcttctgacaaaaaattttaagccagttttacactaaatattccttagtctgattaatttgttattggatgtattctgtatctttcttttgtaatttgtaacttttatccacttagcacgaatgattctattgaagaaaatctttaggaagtggtagaaactttaaatcgccccatagtttgcctgtttccacattttattatcttataatctttgggagtgcttacacttatggagctaacattttcagagatacaggttctcatagtactactaaaacttttttcctctttggactgaatacctatgattataactatacagtagtttaagtttccttgtgattagtcaaaaataccattttagtatgaagcaatgaagtctattatttgttgtcccataattgagaaacttagatacaccttttattaagagtttgtaaattctagcttagtctacacagatttttatatcaatttgtttatatttttattaatgtcatttctggaattgtgaaaatgttaatgttcgacaagcaacattaaaaatagatttgaaacatt

SEQ ID NO: 5647 - DNA, 681 bp, Homo sapiens
gaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttct

SEQ ID NO: 5648 - DNA, 287 bp, Homo sapiens
atgacgaagggagcatcatcgtttggaaagcatcgcaataagacacacacgttgtgccgctgctgtggctctgaggcctaccaccttcagaagtcgacctgtggcaaatgtggctactctgccaagcgcaagagaaagtataactggagtgccaaggctaaaagatgaaaaaccaccagaactggtcgaatgaggcacctaaaaattgtataacacagattcaggcatggattccgtgaaggaacaacacctaaacccaagagggcagctgttgcagcatccagttc

SEQ ID NO: 5649 - DNA, 6906 bp, Homo sapiens
ggagtttttagccttttaacattcaaggattagagctccctctttgcccactagcagggcattagctggtgctgaagacagtggctgcttggcgagcctggatctccaagtgaccccctcagcaactcctgatgaacaggactgaagccaatattaaagcaagtcaaccaaaggttctctggtgtagacaagacagcaaaaggacagactaccttgtggaacctagcattgttctccttctgcagcactaagtaacatttgttctccgttaagatctttgcaaaccacacacaagaattgctggtcatcctgccaatagatgctgctcacagaaccaaatttcctgtgctgaattgtcactcatgggcttgagagtaggagactggagaccaaggtggctagaatccagttgggcctgatgtctccctgttgaaagggctccttgtggaatgaatagcacatggctcctgtggtggatctgatagtggcatagcaccaagtgatgcaggcctgccaggggccacagacacagaagatgctcccggggtcccccatgtactccagacacactgcaggccacctctcccagcaggttgccagtcatgggccccatcatcatgacttctgtccaaggtactgtgtgcagaaatgtgattgagattcaagtcagggcctctctgcccttttccctccagaaacaaaaccaagataatttatcctgaacacggtgaaaaaaggaagggagggaggagaaaaagtccgggtctcacctgggattctctgtctcctgcaacatgaaggatttagcctgggaggaggtggtgagaactctgggagagaaaaaagaaggaaagaatagttttacccatgctgaagttaatttaaaccttcacctagagaagcaaaaaaaaaaaacccacactttcccattttgtgcctcccttcctagagttttagccaaaggtttagctaagtaattggttttaccagcgcactcactcctcctatcccaagtctgtttgactccctccccatcatcctcctcacctcttttcaggcagggtggggatagcagcaggaggagattttgggagcctggcaactcctgcaaggaccgcaggacagcccctctgtggggatgcgtggtgccccatctgccgcccttctgaagaatgcactgccttcactttttactgtgttagagtccatccagactgttctatccaaaaaagtttctttttcccccacaggcaatcaggaaatgattcctttcccgactgcttctgtctagtgcctgggaatcttgagtcaatccctcagtaagtcagtgactagggaaatccctctctgagcctcccagttcatgttgcttagggaacctgatattttcgtgaaacctgcctacacatgggcagcccaacagcagaacaaatggtggtgaccaaagtgaacaaagaagtatagttgtgccagcttcgtagttgcccatgtggacaagtcagcaggatcaggacacgaggaagagtaaatgtgagacagtcaatgtgacttctgcgataaacagatttttaaaccccgaaattttgcaaaattttggtgaaacctgaactttcttcgttgcatatactggcactatctgtaccatcatacaactgtctcacattaaagctatttttcttgggcactgatgagtaagggacttgcacttaggaatctgttacagtgagcacagaagcagacctgtgggctcatagtcttcaccccccacccatatatacaagatgaacagagtggaggttaaacaacttgactaaacaacacagttcatggtaaagcccaagactgtacctgcccatccactgccttttccatgtatcctggaactgagcatagacctcttcccaggcagagctgacagcaagtaaaggagatcataatcaggggaccaaacaactttgtctaaagtgtgaatgtcacctaaggagaagctgtgagatcagaagggtggggcagaggagcagacaccatgagggagagtccttgggggtacatctgccagactgacactgtctggcctgggcagtggaggggctagcaggaaccacaggtactggtggtgtggctactaccgttacaactgcctgtgcttggacatggaccctctgcaatatgcggcagtttcattcattgccccctacattctacaccaagtagaaatggaaggcaattggatacttcacagacaagatctaagtggagaaggaatgcgtcctgtggctgcagagatccttggagcttggaggggagagcttgagccccactgatgatgacctcccacagctcgccaactcagccctccctaagtccccatcgggggccaattctcactctggggttggggggactccaccatagctcatccatcatagggatgttggtatctactgtgggttgggtagggccgatgtgctgaggatggctcccccacaagcaagagatgtggatttggggagcttcccatcttgtgttgaaggaacataactcagaataataagagccaactataacaaacccacagccaacatcatactgaatgggcaaaagctgcaggcattccccttgaaaagtggcacaggataaggaagccctttctcaccactcctattcaatatagtgttgaaagtcctgatcacagcagtcaggcaacagaaataataaagggcatccaaataggaagagaggaagtcaaactatccttgtttgcagacagtatgattctatatctagaaaaccccatagcctcagcccaaaaggtccttcatctgataatttcagcaaagtttcaggagacaaaatcagtgtacaaaaatcactaacattcctatacacagtcgccaagccaagagccaaatcaggagcacaatcccattcataattgccacaaaaaagaataaaatacccaggaatgcagctaaccaaggaagtaaaggatctctacaatgagaatcacaaacgctgctcaaagaaatcagagatgacacaaacaaatggaaaaactttccatgctcatggctaggaagaatcaatatcattaaagtggccatactacccaaagcaatttatagattcaatgctattcctatcaaactatcaattacatttttcacagaactagaaaaaacttaaaattcatatggaaccaaaaagcctgagtagtcaaggcaatcctaaacaaaaagaacaaaggtggaggcatcacattacctaacttcaaactacagggctaccatgaccaaaacagcatggtactggtacaaaagcagacacacagaccagtgggacagaatagagagcccaaaaataaggccacaaacctacagccatctgatcttcaacaaagttgacaaaaacaagcaatggggaaaggtctccctattcaataaatggtgctgggataactggctggccatatgcagaagatcgtaactggaccccttttactatgtacaaaaattaagatggtttaaagagttaaaacccaaaattataaaaatcctgaagataacttaggcaataccattctggacataggaactggcaaatatttcatgatgaagacaccaaaagcaattgtaacaaaagcaaaaatggacaaattggatttaagagctttttcatagcaaaataaacaacagggcagacaatctaccaaatgacagaaaatttttgcaaactatgcatctgacaaggggctaatatctagcatctataaggaatttaaacacagttacaggaaaaaaaaaacccactccattaaaaaatgggcaaaggacatgaacagacacttttcaaaaaagacatacatacagccaactagcgtgttaaagaaaacctcaattatcactgatcattagagaaatgcaaaatcaaaaccatgatgagatatcatctgccagtcaggatggctacaaaaaagtaaaaaaataatagatgttggtgaggttatggagaaaaggaacttatacacttgttaggagtgtaaattagttcaatcactgtggacagcagtgtggtgattcctcagagagctaaaaacaactaccatttgactcaccaatcccattactggatatttacctaaaggaatataaatcattccaccataaagacacatgcaagtgtatgttcattgcagcactattaacagtaacaaagctgggcacagtggctcacctcacgactgtaatcccagcactttgggaggctgaggtaggcggatcacctgaggtcggcagtttgagaccagcctgaccaacatggagagaccccatctctactaaaaatacaaaattagccaggtgtggtggctcatgcctgtaatcccagctacttgggaggccaaggcaggagaattgcttgaacccaggaggcagaggttgcagtgagccgagatcacaccattgcactctagcctggtgaaggagcaagactccatctcaaaaaaaaaaaaaaaaaagaaagaaagaaaaatacacattcagaggagacaaaaaataaaaaacaatgatgcatgcccacaggatctagaaaataacttcttaagggcaaatctaggagttattggccttaaagaagagatagagaaagagataggaatagaaagtttgttgaaagggataataacatagaacttcctaaacctacagaaagatatttatatccaagtacaagaaggttatagaacaccaggccaatttaacccaaagattacctcaaggcatttaataatcaaactcccacaggacaagggtaaagaaaggatcctaaaagcagcaagagaaaagaaacagataacatacaatggagctccaatacatctggcagtatatttttcagtggaaaccttacaagccaggagagagtgacatgacatatgttaaagtgctgaagggaaaaaaccttttaccctagaatagtatatccagcaaaaatatccttcaaacatgaagaataaacaaagacttccccagacaaacaaaagctgagggatttcatcaacactagactggtcccataagaaacgcttaagggagtactttggtcagaaagaaacagacattaatgagcaacaaagaatcatctaaaggtaaaaaactcactgttaagagtaagtacacagaaaaacccaaagtgtgataacattgtaactgtggtgtgtaagtagaaagaataaatgataaaccaatcaaaaatagtaactacaacttttcaagaccagtcagaaaaataagataaaattagaaacaacaaaaagttaaaaagtggggggatgaagttaagatgtagagtttttattagttttttgtttgttaatgcaaacagtgttaccaggttaaaataatgggttacaaaatagtatttgtaatccttatggtaacctcaaacctaaaaacatacactggatacataaaaaataaaaagcaaaaacctaaatcatatcaccagagcaaactaccttccctaaaggaagacaggaagaaaagaaagaagaagaccacaaaacaaccagaaaacaaataaataacaaggcaggagtaagtctttacttatcgataatacattgaatggaaatatggactaaactctccaatcaaaagacatagactggctgaatgaatggagaaaacaagacccattgatctgttgcctacaagaaacacacttaaactataaagacacacataggctgaaagtaaagagttggaaagagttattccatgccaatggaaaccaggaaaaagagaaggagtattgattttgatacaaaaactatgagacaaataaagtcactatacaatgataaaggggttaatatggtttccatttgtgccccacccaaatttcgtgttctattgtaatcctcaatgttggaggtggggcctggtgggacgtgattagatcatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgctcccactttgcattattccatgagtaaaagctccctcaggccttcccagaatcagatgccgctatgcttcctgaacagcctgtggaactatgagccaattcaacctcttttcttcataaattaacaagtcttgggtatttctttatagcagtgtgagaacagaataatacagaaaattggtaaagaggagtgaggcattgctagaaagatacctgaaaatgtggaaacagcagtggaactgggaaatagacagaggttggaagagtgtggagggctccgaagataggaagatgaggggaagtttggaatttcttagagatttgttaaattgttttgaccaaaatactgatggtgatatggacaatgaagtccaggctgaggaggtctcagatggagatgagggacttattgggacctggagtgaaggtcacttttgttaggacattgtggttggagacattgtgcccctgccctaggaatctgtggaactttgaacttgagagcgaagatttagggtatctggcagaagaaatttctaagcagcaaagcgttcaagacgtggcctggctgcttctggtagtctgtgctcatatttgtgagcaaagacatgacaagaaactggaacttatatttaaaaaggaagcagagtgtaaaagtttggagaatttgcagcctggccatgttgtagaaaagaaaaaaaccattttctggagaggaattcaagctagctgcagaaaattgcaagtaacaaggagcaaaatgttgatagccaagatagtgggaaaaacacc

SEQ ID NO: 5650 - DNA, 593 bp, Homo sapiens
cgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaagacccttcacccctcacctcgatgcagccagtagcttggatccttgtgggcatgatccataatcggtttcaaggtaatagcctgcagctggtgttttgagaagccctactgctgaaaacttaacaattttgtgtaataaaaatggagaagctc

SEQ ID NO: 5651 - DNA, 993 bp, Homo sapiens
gaacctgcccaaaggccagatgtcatcagcagctgaacagcattccagaaaccagctgcaaagacagaagcagaacaactggtttggtggagagatctgataacaaaaagttgggaaacaggtaaaataataacttggggtagaagttatgcttgtgtttctccaggccaaaatcaacagctgatctggataccatcaagacacctgaaatcttatcatgagccagatgctgaggaagagactccgggaggatcccgaggacggcccagttgcagccatgttgagactgacgctgaggaggaccccaactgtcacgagcaacacctgtcgaacacagccacccacctggggacagatcaagaagctgtcacagatggcagaagaaaacctgaggaaagcgggacaaccagtcacaatgagtaatttcatggtagctatgatagcagttatcaccactgcttctgcagatgtggatcctaactcctgcgagaagtaactcacagtgacaaagctgcctttgcttttatcgagttgcaaatcaaagaaggggggacatgttgggaacaggccccccaagatctggccataaactggccccaaaactggctataaacaaaatctgcagcactgtgacacgttcatgatggccgtgacgcccacgctggaaggttgtgggtttaccggaatgagggcaagggacacctggcccacccagggcggaaaaccgcttaaaggcgttcttaaaccacaaacaatagcctgagtgatctgtgccttaaagacacactcctgctgcagataactaaccagacccaccactttacttcggcccatcccttcatttcccataagggatacttttagttaatctattatctatagaaacaatgctaatgactgacttactattaataaatatgtgggtaaacctctgttggggctctcagctctgaaggctgtcagacccctgatttcccacttcgcacctctgaa

SEQ ID NO: 5652 - DNA, 777 bp, Homo sapiens
atgaacaagttgaaatcatcgcagaaggataaagtttgtcagtttatgatcttcacacaatctagtgaaaaaaaccgcagtaagttgtctatctcaaaatgactggaagttagatgttgcaacagataattttttccaaaatcctgaactttatatatgagagagtgtaaaaggatcactggaaaggaagaagttagaacaactgtacaatagagacaaagatcctcaaaatgagaataaaattggaatagatggtatatagcagttctgtgatggcctggcactcaatccagccagcattagtgtgttgattattgcatggatgttcagagcagcaatacagtgtgagttctccaaacaggagttcatggatggcatgacagaattaggatgtgacagcatagaaaaactaaaggcccagatacccaagatgtaacaagaattgaaagaaccaggacaatttaaggatttttaccagtttacttttaattttgcaaagaatccaagacaaaaaggattagatctagaaatggccattgcctactggaacttagtgcttaatagaagatttaaattcttagacttatggaataaatttttgtggaacatcacaaacaatcaataccaaaagacacttggaatcttcttttagacttcagtacagtgattgcaaatcacgtgtctaattatgatgaaggagcatggcctgttcttattgatgactttgtggaatttgcacgccctcaaactgctgggacaaaaagtacaacagtgtag

SEQ ID NO: 5653 - DNA, 2127 bp, Homo sapiens
aattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagccatactacctttatcacttttttttttttttttggtgcaaagcttaacattctgcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttgtttggtttggtttgatttttcactttttgcttttaaaattcaaagcaaaacaaaattgaagataccattgagaatcagaattcaagatgacttgattctcactaagatcactgcgcttttttaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctaggttttaatctgattccttgtgatttattataatgtagcagcatacttataaaagtggtctgtgctgagtcagatagagagcccagcccattagaaacacatcataatttaagaatatgatgcagaatgcccttacacttatttgtgcccagcttcccaaaaagaaaattgttttgttaagaggaaggcagttaatttggctagaatccaaaaactcattcagcatggctgttttcccttatttcaaatgaaaaacttttctaatactaaaatatgtaatcctgctttgctttaaattcccatgtctgtcactcaacaggaggcatagtgattcttaaatatttacggaacatttggtgagttgtaaagagaagtattattgcattgtaggtttttgcattgatgtgtcgatttttttgttttgtcccaagatttccttccagcaccttaatgaatgttcatatgatagaatgttttaagtatcagcaaagcattcatggatgcctgcttttcattctcagaaggctaaacctgttttgggtatgatgctacttcagaacatattgtctggcacaagatttcttctaataagtggtttatttaaactcaatttcggtggactgttgaattgaaaaacaccaaaggagtcttcttgtctggagactggattgttccagttttaaatacctgtgcccataagtatcccatttcatgaatgtgtgttggcatggggaaaaaatttccctgctctttgagtggagcgaaagcaattggttaagctgtagcagcttttttgtttatttttttaaagtaataataaaacttgaactgaaaaaagataaaa

SEQ ID NO: 5654 - DNA, 629 bp, Homo sapiens
tgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgggttttgctccatttaaagacatgaaatgaactacagccaggaaggtgatagatgatataataagccacctctgaacctacaccccgtctcttcacggtttagacttactaaaataaatacaaggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 5655 - DNA, 1622 bp, Homo sapiens
aaagacaaaaagaaaaatgctgtggctagaggacaggggtggagagagggaaaaaaaggacaaaaataaacaaaacatcaaatatgaaaattctcagagataatgcatttataaacacagaaatggttacaacaaagatggccgtgatgagtgagtataatatatttatatatatatatttatatataaatccgtgtccggcatctgactgtggcacctagggagctaagtccagtccttgcgtttgccttgaactctcccttctccgcaacacccctgttttggagtttcacagataacacaaagcctcccacagctccttgggggtgggttggggagactgagagtatagggtctttgtaggcagagaaggagagaggcttcaaggaaatccgtaaaaccataacacacacttctaagccacctgtgaccaacttgggaatttctggccccttggggaccacatctcagcccttgcccccttcaaataaaaggaggtctagcccctaccccaaatctccttctaccagcagtcaataggaagcaaagtgagacgatgtaggggaagaaatggctctcagggactgaggcatttgagaaacctctgttcttttgcaggcaagaatagaacaagaggctggttgcatttggggctcccttttctctgttatctgggagggccagcctctagtcttacatcagcccaaactttgaggataaggagggtaaggatagggtaagtggccacactggacaaggttctatgaggtcatagcaaatccttcccttgagcaccgacccccagttttagaagctttgcttgggaggggaggctgctggatgacaccatcagctcagtattcctttgcaatcaggagggctgatgttccttttgaagaagagttcagaaaaaggatggtatcctgtgaaggaaagccgtgacagaggcccaaggagatggagccaaggcctgtcaaggaagaaaaggacttttcccaccaagagttggagaaagaagacaccaggactacttcttcctcttcccagtgggtggcagcacggatctctaagagctggccaggtgctccacctggatggtgctggtggtgacagtgaggcagatgtccttatgatgctccgccgtcttatacggggtcaggtcaaaggaacactggggtggagggttgggattgctgtccccaccacccccaccctggggggctgccccaggagactggaagtgtggtggtggctgttgctgctgctgctgctgctgctgctgctgctgctgctgctgctgtgatgcctgggaggcctgggcctgggcctgggcttgagcctgagcctgagcctgggcttgagcttgagcctgggcctgggccactgctgccgctgctgctgctgcctgcacctgttgctgaagatcaggcgggttgtgtttgcgcatatgtttcataaggtatgtttctgatgtgtatgcccgactgcagatagtgcaggtgtacaccttggcatgcttcactgtgtgcgtagacaggtgcacctctagtgaggctgcatccgtgtacgcccgatgacagttgtggcacttgaagggtttatctttgttgtgttgccgtctg

SEQ ID NO: 5656 - DNA, 1747 bp, Homo sapiens
tttttatttggaatattattagatgatgccctatgataagatgagacaaatgatggggagggaaggaggatggcccttctctagaatcagcaaacccaatggttctgtgaaggtcagacccaagcttggagcagctggtctggatgcagatccaggagctgcagagtgtggaacaggaaaggctctgcccagggcccatgagctctagcattcctgctggcagattagagatcttagttaaatttgaccaagaaaggagcttagctaagaggtctttgtttccagaggacccaagactaccagactcctgtgcagtctgcctgtctgcagagcctccaatcacggtttaaagtggtcttggcctcccagcccccactgctgcagccttcagagccagcctctggactcagcgccaggagcctcctctcctgctgccctggtacctgtcatcctagtgtcacctatttgttttgcacagcattctggagaacatgtgcctcacaaagtgatcctgtttttctcaccctccaaagctgaggtggctaagggaggcaggggtgagagagctcactctctaaaccacaggcagggcaaggtgcttctaggccgtgtcccctccctggggaatggtcactactcctcagcatggccacaggcccctgtggttttgggagtttgctgagtgactgtggaatgggctgaccccagccgtttccctgctgtggaaacagcaaggtaggggcactgcttggtggtttgtcaagctcagaggcagccacggatggttaggaacaggaagccacactgctaaggtgtgatgagctagaagggagacatcctggacttcaagtgagacaagtgcagaggaggccactccacttaggaccttccttttagacctgcatgagcacgtgtttcacttaagcacattgggtccgaattgggcgcatgaacccagctgttaaaccaggtaccctgggactgccctctgcctctcagagccctacctgtcctggacttgaaggcgagcatcaggcaggccttctcagcccatcttccaccaggagtgcagagccagggtgctgagaggagcagggactgtaactacagtaggaggcaactttgctggtgtcattcctgctcggattgactttgtgctccctcccatccacagctatggtagccagtatttccccagcagctctctagtggggaagagtggctagaaccaggccattctcagtcgaatttaggaagaccaagactcatgttcctgacaggacggtcattccctcatggcatcactgactcagttctaattcctcccctcctgtttcattttggtttgaacaacctgtgcctgcagctgtttcttccaccttcctggagctcacaattggagcttcatgttcagtcttgagctcctaatgtttccagacagggcaggggataggagagccataatctatgaaagctgtgaaacaaaccctgggttatatagatctcagatggtctcatctgaaggctttgcccacttcccagtgagcagagggtttggggaacaaagaggtagctgaagagtggtggtttttccctgtatcctgattttcagaaagggctttagtctctgagctgtggctagtagctggctggctgaccaggggacgggggtctaatagggtgtctgaccataggacacctctcgtgtttggccttccctttcttgtgtgtttgtgtgtgtgtgtgc

SEQ ID NO: 5657 - DNA, 4244 bp, Homo sapiens
cgtgattatgaggggttgtgaagtgcttgccccatcagtagccagtgtgcatgtgtaaataccatcctctgtgtgccctggaggctgtccttcagatagcatgtacaggtggcagcatagggcctgtccctagtgagagtgcagggaactcagcaccgtcaactcctcgaccctgcaggtcagattatccttgtagaggccccctggatggcaccaagatcggccctggcaagcaggtgaccctgacttcagagcccttgcctgagggcctggcctggcagctctgctgttagaagcaggaggtgtgcagggggtggggagcagcccagcctctgtgatcttctccatggcaggatctcccagcaggtagagcagagccggagccaggtgcaggccattggagagaaggtctccttggcccaggccaagattgagaagatcaagggcagcaagaaggccatcaaggtagtccccatacccctgtgtcctgaggctactgggcagtccctccatttccccatgcctctgaggccgcccattctctgccctgctgcccacctgtaccttgggctttcttctcgcccaggcttccaactccaccctctcctgccaagcaatcctagccctctgagcctcttagggccccctcagacttgtccctgtgtccacaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggtctgctggctgcgcacataacttagcctgtcacacaccaggaggactggatactggggaggagccggggccaccatagggttctgtcccccagaggaggctgactgggatggggtggcagctgattaggcccagcaccaaatattcaccatcccttggccatcctggccctctcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtatggccagaaggcagggccgaggggtgtgggcgggaggcccggcctggcttagtggggacccagggcatcagacacaggtacagcacataggccaggagccagggggtgactggggtggctcggctcgggaggcctgggaccccacagtgcacgctgtgcccctgatgatgtgggagaggaacatgggctcaggacagcgggtgtcagcttgcctgacccccatgtcgcctccgtaggtacaagaagtatgtcttcctggaccccctggctggtgctgtaacaaagacccatgtgatgctgggggcagagacagaggagaagctgtttgatgcccccttgtccatcagcaagagagagcagctggaacagcaggtgggaggggtgggacagaggtggagacaggtgcagtggcccagggccttgccagagctcttctccagtcaaggctgttgggccccttattccacccatgggaggtgcacacaaggtcttgttggctgcccctgcaggtccctgtcacctctcacatgtccctgcctaatcttgcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcaggtgggagcagctctttgaggccacctgatttctggcgtgctcagtgcactcgggtggattttctgtgggtttgttaagtggtcagaaattctcaattttttgaatagtttccatttcaaatatcttgttctacttggtccataaaatagtggctttcaaactgtagagctctggacttctcacttctagggcagagggaacctgaacaagtgaggctctgggttccccattcctaattaaaccaatggaaagaaggggtctaataacaaactacagcaacacatttttcatttcagcttcactgctgtatctcccagtgtaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgcccaggcccccccacacagtctccaaaggtccggcctccccagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaaggtgagcgggccctggagcctgcggtcggagggccttgggcaagatcgcctcctcccctccagccctgagtccactgggtgctttctgcccaccccctgctcttgccagctggcccctgcttcccctagggcacatgctggaagccctgggccgccaccagaagtcctcagccctcctgcctgggctatggctccttcctggtttgggagccatagtgaagctttcctctctaagctcacccagcccaaactgtgacaggagaatcttcttcgactgccaagagcggtccaaggcaatggtcagccactgcagccccctgagatatttttagagactggacctgaggcctctggaggctactgatgatgcctgctgtgaacgcagacactggtgtgatgcgatgcctgcgcctgcagcggcagtgccctgggcactatggttttgagcttgtacccagcgctgcttttgccttgctctgtgaccccaggcaagctgcctcacctctctgggccagtttccccatcgtacagtggtgctgcacaccctggccctggccccgaggtggctgggaggtggctcctcaaacagccgctttctcatcagtgcccggtgctgggtcagggatcgactgaggctctgagctaactaggaaacacagtggccttggagggctggggagtgtcatgggggtggggacagggagccaccggtcgcatgtgactgaactcttcaccccagtctgtggctttcccgttgcagtgagagccacgagccaaggtgggcacttgatgtcggatctcttcaacaagctggtcatgaggcgcaagggtaggaggcagggccgctgcccgccctgggtcggcaccttgtaattctgtcctgcctttttcttcctgtatttaagtctccgggggctgggggaatcagggtttcccaccaaccaccctcactcagccttttccctccaggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagcag

SEQ ID NO: 5658 - DNA, 7638 bp, Homo sapiens
gagctgcacaggccaaggaattccacagagggtgtgacccaaagcccctaacaacagactcgctgggaccccctagacttggcatggaggctggcgtcgattttcccatcatccgcctctaagagctcagaggtagggagatcctgctccgccctctcgtcctcttcctccaagcctggggaagggacgtcctggcaggtggtcagggcgttgcagttcgagtccaggccaggatcgggtgaagaagaagctccggagcaggaatcaggagagcagcagaagctgtccggtgcagacctagaagacagaggtggtgaagcccggccagtgaggacaagagctgcggggaaggacaccgagatgagatgcaaatcgcaatcgactgaccattagtttccactgcagtgtttgcagatggagtcgaatgtaaccccccgggaatggagccgggagggtcagagaacgcggctgcgctctggatctccgaaggggggcgggggcctggaagaggtccgggcccagaatggacctccaggtccctgctgccgcaatctggccctgccctccagcctaccccttactcccagaggaagggacccagggagacccacccagatgccctgaaaggaggtggaggatgggggtggggcaatacgcagagtttgtctggtgaatgcaggaaaggggtgggggctggagaggaaaaggatggagcagccgtcagcttgtcaactccgcatctgctggctgcctcggccgggctccagcctgcgccctcgcccctcggaacagcggtatgtccattctctccgcattcgtctccatcgttcagccaccaccgcaccctttctctattcatttctcctgctcccttgtcctgccccgcccctcgtgcccaggtccatcggtctacacccatgggccgagccctcctcaccagggtcctcctggaaccgctccggccttgggcttgtccgcggctcccacggtccccgcccggcggggcacagagcgggaggggaggggcactagcacaacctaccctgcgctgcgcagctgcaccccttcgcgcatgggcgtggcgtagctcagacccgcccccagcgtttagcgtcttttgtcacccacctagagggtttgatatatcctaagcttttggcccctgggtcctggttccgtgcagcgagtcctcccagcaccccaccctgcacattctggaaagagccagactctggctgggccgagcaagaacagaaccacaagaaggttacacgattatttattgagagcctcctctccccgcccttgcaatctctaggtcactttctccgcttgtagattttgcgcgcaagccccagaaagacggctgggggcaggggtgctgcgtactgttcaatgagagccataatgtggctgtaactgtcttcctcatattgcaagaacactgctggcagatccagctcctcatatagcgccttcacccgggccactttctcagcctccttctgcccgtaattttcctggaagaggttgaaagacaggaaaacgggcttggccttccccagagcctccaggacccctccactcccctcattcacatattccagaacatctccaaagccacccactcctttcctccctccaattttcaagtgtctctacgtagctaaaatcccaagcttcccttccctatcccaaatattgcctcataccaggcatcctctactccagggtttctccaccttggcactattgaaatttgggaccagataatcctgtctgggggagctgttctgtgtactacatgtttggcaacatctttggctcctgccaactagatgtctgtaccacatgcacacacacagagttgtaatgacaatggcaaaaaatgtctgctgacattgccaaatgtcccctcgggaggaaaactgcctctagttgagaaccactgctctatccctttccaccaactcagggacccaccaccctctctcaggcaccttcaggatctggtactgttctggagtggcccgttgcagacactgaaccaccagccagctgcatttgttgtcctggatgtcagtgccaattttgccggtcacactggggtccccaaagaggtcaaggcacgctgcaatcctgtaccctgaaaccagctagatgagcatgtcctatagaggccaaggctaccatgggcaccctctgggcatcgggccctgtctgcaatacacctgcaggaagagctcgatcaggttcaggtaatagggctgctcccggcaatagagcttcagcaggcggtagatacatgcttccaggaggttagcatcattgatggcatccaaacccacgcccggctgtcatgacagacagaaaaacaagcaatcaatctctagtctcggttcatactaagagccatcaccccaacacctcaaccaggccatatataaccacctccctgtggcctgtccccatacccactgctattttcctgcccacattaccttctgataccagcagatctgtccccggcgggtaagggatgaatccatgatgtcatctgccaccaggaagaaagcttgcagctagaaagagtggaataagacctgcagggctcctcattactgttccttctatcagcaacagagctgctactttatatctgtatatagttttgcttttttttggtaggggacagagtctcactattatccagtgcagtggtgcagtcacagctcactgtagcctctaactcccaggctcaagtgatcctcccacttcagcttcctgagttcctgagaccataggcacataccccatgcctggctattttttttttttaatttattttttgtagagacagggtcccactatgttgctcaggctggttttgaacccctgggttcaaatgatcctcctgcctcagcctcccaaattactgggattacaggcatgaggcatcacagccggccagagctgctgcctttgacagtccctatgagctgggaaagtcaggatggggagacagaagacttctgtgctatggagacttggaaagtgacataacatgtttggctcagactccccgcctataaaatggaactaaaacactcttgttttaggttaagaaactagaacagatctttgacatctctaatgagccctagattattcctggtgtcagggagattaggaaacaccttcatataccgtactctattcttgccaaaaacctcaatgaatgcttaaagtaagatctattcatgaaactgacttcacattacttcctaaataaaagaaggctattcccacattgcccccagcactgtgtttgaacaccctggtgactaggaacacagccttacctaaagcagctccttagcagtgcaggtctaataaggtggaactgaaatctgactttgacctatgagtctcagacatctttaaacatctttaaacattaactaagggcttactcttctgagtgcccatctgaaggtacctgaacgtgtcgggtttcccactagaccatgatctccttggaagcagggacagtaacttccccctcttagcatttgcagagcctagcacagcattaggcctggagtgagagtttcctaaacacttgtctgacaaagaaattaataaaacactctaacattccctgtgatacttcttgcagtcagtcaaactatgttttggttccttaaatagcttttctttttttttttttttgagatagagtctcactctatcacccaagctggagtgcagtggcgccatgtgggttcactgtaacctccgcctcccaaattcaagcgattctcctgcctcagcctcccaagtagctgggactacaggcacctgccaccaccaactgctaggccagctaatttttgtattttcattcagtagagactgggttttgccatgttggccaggctggtcttgaactcctgacctcaagtgatccgcctgcctcggcctcccaaagtgctgggattacaggcgtgagccatcgtgtctgaccattaaatagcttttcaagacatggtttgggttgcttttttaaagagacaagggtcttgtcatgttgcccaagttggacttgaactcctgggctcaagtgatcctcctgtctcaactcttgagaatctagggatataggcacacaccagcgcacccagctcaagacatggtttttattttcataacttatttcctttttttgtttttccacttctagatacatacccaggtttttgtttttgagatggagtttcactctcattgtccaggctggagtgcaatggcgcaatctcggctcactgcaacctccgcctcccgggttcacgcgattctcctgcctcagcctcccaagtagctgggattacaggcacgtgccatcacacccggctaatttttgtgtttttagtagagacaaggtttcaccatgttggtcaggctggtctcgaactcctgacctcacgtgatccatccaccttggcctcccaaagtgctgggattttaagtgtgagccaatgcacccggccctatacccaggttttaatttttattattattttcttttgagacaggatctcactctgtcacccaggcttgagcagaagacatggtttgtgtgtttttttttttttgagatggagtttcgctcttgttgcccaggctggagtgcaatagcgcgatcttggctcactgcaacctccgcctcccgggttcaagcgattttcctgcctcagcctcctgagtagctgggattataggcatgtgcctccacgcctggctaattttttttttgttttttgttttttgtttttttttgagacagagtctcgctcttgttgcccaggctggagtgcagtggcacaatctcagctcactgcaagctccgcctcccaggttcacgccattctcctacctcagcctcccaaatagctgggactacaggcgcctgccaccatgcccggctaatattttttttgtattcttagtagagacggggtttcaccatgttagccaggatggtctcgatctcctgacttcatgatccgcccgcctcagcctcccaaagtgctgggattacaggcatgagccactgcgcccagcctaattttgtattttcagtagagatggggtttccccatgttggtcaggctggtctcgaactcctgacctcaggtgatccacctgcctcagcctcccaaagtgctgggattacaggcatgagccactacacttggcctagaagacatggtttttaagactttatcccatcctaatcctgtgtgctgtagtggatccacattgcaaaggaagcatgcaacaccgcctgccagagcccagcatgggccgtggggaaaggaccgttgcaatcactgctgttataggcagggtcctcagggaaggaggcatccatctgcatctttacctctgacctaaactcagaagagtagtgtggaggtcctgggctttccacatcaaaggcacatgtttaattgactctgtgtttatttggagtagcatggtttccctgaagccacccattcactgcctctcccaagggtgactgcaaggacaatcttgtttcagccaccaccactcaaccatgatggtctccaagataattaattccatggcctccccaaatttcctctgcctcctagcactgattcttaaccccaccagcactttctatttattagggaaattaaaaaaaaaaaaaaaacccaggccaggcacagtggctcacacctgttatcccagtactctgggaggccgaggcaggcagatcacttgagcccgggagttcaagaccagcctgggcaacatagtgacactccatctctaccaaaaaactatttaaaaagccgggcgtggtggtaggcacctgtagtctcagctacttgggaggctgaggtggaaggatcgcttgagcccaggaggtcgaggctacagtacaccatgattgcaccactacactcaagcctgggcaacagaatgaggctttgtctctaaaaaaaaatttagaccaggcgtggtggctcacgcctgtaatcccaacactttaggaggccgagatgggcagatcactcgatgccacaagttcaagaccagcctcagcaacatggtgaaacctagtctctaaaaaaaaaaagccaagtagaggctcgctcctgtagtctcagctacttgggaggctgaggcggtggaagggtggcttccgctccagaggcagagattgcagtgagccaagatcatgccactgcactccagcctgggtaacagagtaagaccctgtatcaaaaaaaaaaaaaaattaaaaatttttaaaaacttacaggtgaaactagggtgctgctagggttaagaactgattctaggccaggtgcagtggctcacacctgtaacgcctgtaatcccagcgctttaggagggcgaggcagatggatcacaaggtcaggagttccagaccagcctgaccaatatggtgaaaccccgtctctactaaaaatacaaaaattagccagggatggtggcatgtgcctataatcccagctacttaggagactgaggcaggagaattgcttgaacctgggaggcagaggttgcagtgagccaagatggtgccactgcactccagcctgggcaacagagagagactccatctcaaaaaaaaaatgaactgattctaccagttaaccactggcccctcaaggtcttgcttcccttggcccccatagctttactcctctgctctgccctcatcctccttcccttccttccttgcctgtcatctccatattttgaacccctcagcccctcagcatccctgtcatccagggccctctccctggatgccatgggcctattacctccttggaagcaaatctctattctccagacccatctccccgacaagttccagactggaatttccaccgcccacaggacaggcagatccacctgctccacccataccaagaacgtacccgggctgactgtgctcagcacgtcttcccttgagccagctgctcctctcaggccaggcactcagcatcatcgtcactcaccaagttctgaatgctcttcccttttgggctcactgccaccctcctcgggcatggcacccctcccagaacccagtccccctgccactaatgaaagctttaggccatgccagcaaactagacaccttcaagaccaagacgaactggtatagaagacaaggggatgtggggattggagcaaactagagaaagcacacaggagaacacatgccgtcttgcagaagttgcatccactcagcttcagccaattgttgctatgcgggaacatggacccaaatcttacaatttcccaagccatgctagaaatctaggttttagtgtgaaatctctttgttaaatttaggagacttaattgtaaaacattttcaaaatactgtcagtgagctgccagttttcaatttctgcttctgaatagcctttggaagacctctgtcacctttttttttttttttttttttgagatggagtttcgctgttgttgcccaggctggagtgcaatggtgcaatctcagctcatcgcaacctctgcctcccaggttcaagcgattctcct

SEQ ID NO: 5659 - DNA, 1678 bp, Homo sapiens
gatacaatggtgtcgttcgggaaacgcagccctaacgttggtcctaagctgacaaattggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagagagcttgtgaaactgagggaatagggctgtgtgttccagaaggctgataccatggaagacatcaccttggcttcctggctgtctggttagtgatttgagcaatgagaggcagcagctagaaatgaaagagtagaagaagagagtgtctcctgacactgtgtgcatggtctccagtcagcctctgattcctgtgagtcagctgcatccagattcccacccccttccccgtcccgagaaggttacatttggccgccactaagatctcctgagaaaaatctcttcagaggaattttggccaaatcttctctccctctcctacagccactttcctcctgaatttcttcctttcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtccctcttctgtgctgtcttcctgaagccatctgtggagtcaagcagtcatggctcagggacactctgaagtaggtcccagcacatctgcatggagcatcaggaggaaggtggatgaatacttaagacccagcctggcctctaaatcggtgctgagcgttttactcagtagacagcttgggaatcatagaaacgatgcggatctgacagagtggctgtggacactgaagcaagccataccagggtggacctggcctttgccgacacgccacacaatcaacccacctctgccccctggggaggatggaaaatccaagaaaatggtgtggatcaataaatccttcccctgatgcaaccattacaagtggaagctgtgttctca

SEQ ID NO: 5660 - DNA, 3861 bp, Homo sapiens
agtataaccaagctataacttgcacaaagcaacaaggaaaaaaaaaccttgctatccccattactttcctaatagagcaaggaccctaccacccctcactccatactctgcctctgccccaagcaagacgcagcacctgccaaaccaggcacttaaggaatatggtccaacttttcaaacgcaaactggagaggagacgcagataatttcttgaagagtgcaagaagacagcagaaaaggtactctgaggaagggatgcgtgagctttggggctgtcccctctgcctgttggaggattccaaattcgcttgcttcagagacccttggaagcagcacactcaggtcgcggccagcctcgggcctcggtgaaggaggcagtgtttacacctgtcacgagggagggggaaggagagcgaagaagcccaagcaaagccccaaacttctgaacagctccctggagaacgcagccagcgcggagctttgggaggtggaagcaaaggggcagggagagccggcggtggccggggagggaaggactcccacttacccggccggtgcccgggatggcgaggagggggccgtgcgcttcgggcgccaccagcggcgttcccgcactcgccgcagaagagagcagagccgggagcccgcaggcccgcagagccagctccgtcctcacagctcccggctccgcggcgggcagatgctcccggcccgggtgagggtctggctgctgggccgggcctggtccccgcaccctctttccccggcgcagctaggggagcggagcggcggcgcttacctggctccttcggggcggctgcgatgggcatggctcaggggcccggggaggaactgactccccggggaaggaccgtctattccgacgcggaactggtgagagcggaaggccggctgctcacagccctgtcagcgcagcagcaccatggacgcccacccggagtttcaccgctgccgcgggacccccatcccactaccctccgccctcttccgccgccgccgccgcctcctccacctcctccgcggagaccccccgcccactccacacactctcccatcatgcagcgggggaaccgctgccgccgacacgtcacttccgggcgcaggtggctaggtcgggaccgggcgctggtgggtgctgtggggtgggggaggacactccaggggaattggtgtcacagaacgcttatccctgcgcaggcgctgtcgtgcagagcgccgaccgccattttgggtgcgggcaagctgccctttccttttacttccttgcgagtcatagagctgtagggggatagacgtcttcccgcactcaggcgccggttgaggctgcgctcctggcgaaggacaggtgctcctttcagccggttaacgttcagctcaagaccggattaagtctcttgctctccaaataaaattgtaaaggtttggaaatatagaaccacatttttaccaaaaacctactagagagcattcgtcagcttgcccttttcgccccgaaaaacgactttttcattcacagcctgtctcttcctctttttaaatttatgccgacagaggaagaagctgatatttaacaaataacaagaggttgcgataaatagaatttaaggtgggaaagcagccgccaaactgacaaatcgtcttcgagaccgacaagaaaatagtagtccggaatttggctaatggatggagaaggtggtcgtttttcatagacccttacggagaatatctagtgaagctaaagagatcaccataaacttatgcattcaaacgcatttctggaacagaggtcgtaaccgattttgtttccatcatcagtcctgaacagttgattatttatataatcaactgttatttatataaaggtaataaaaatattacctttcctcctcctttacaatgaatatctgttagaacacctgccagtgtaacaatcagactacaaggctacaggattatgattactgtctcggatgatgagcccggggtcctacaaatcatgacccccgccggcccctcattctgcccatatttgccaaacgtctgcatcagtaatttgaataatttaaaatagttccaaaacagcaaagctcagcagttacgcaaagaaacaagaatggaaaacatcccctcaggcacagagaagtgtccacccctttgggtggaggaattatacaaatcaggagaaagataaggacaatagcagttcatcacgatttatcccgcctctgcaatgttctagacaaattaactcggagcgctccaatggacccgcatttgtctctttactattcaatcgctgtaagatatacggagactgcatcactttaaatgggagtatcaattgctttgtggttatgctggattttgtgttattgctcagtcactaaagtaagaaaaatctatatggcttgtcaaatttatgcctattgtatttcgccccctgctggtttagctcgtgtgcaagcttgaatttgtgtgtgtgtagaaactagaaattgattttaaacgaacacatgcttgttttcattttacagctctactaaacagaaatatcaaaataagaacatatgactagaccttaaagcagaccctacactaagaacatgtttaaactaaatgaatttaaactgcactccagcctgcgcgacagagtgaaaccctgtctaaaaaaaaattaaattaaattgcacaccccccatcagcttacaattttgtaatagggaaattgagtacctatttggccaactaacttgtaattggtaatcttacatgtaattccgaagacagtgccctaatgctcatgacattttattacaaagggaaagtatttgagtgtttttaaggtgataaatctgtgggaaatataaagtccatttcatttggagtcaatgatagtattgtttttatttaccttttaaaaattatggccataactgcattacctaagatttggcatcaagaaaagaagaagaaaaaaattaccagttaacatttgttgtatttacttctagtttttttttcctgtgcgtactttttacaaacttgtaatcataatttaagtagattttgtgtcccttttgtgttgtaagcatttccacccatcgtttaatgtaaaaccttaattttaattggctgcttagtagtcaatggaatgaccactatatggatagttttcagtattataaaataatacttagatgaacattttgtgtgtgtggctttgttcaattttagaattttttttctcagtataaaagttactaagcgaaaaggcaatgaatgttttattggtaatttatcatctcatattattttccaagagactgctaatttagaatgccaccagcaatatatgagtgcactaattttaccacctccttaccaaccagcagtgaatgataattaagaggggaaaaaaagatggaaagaataaaaagtgaaaacagtttaattcattttatattgtgtaagaaattaacagacaagcaagaacaaaacctcagcaatgtgttggtgttctggaaaagcaatatgcgtagaacctgggtctatgaccagttctgttgtcactatgattttgtataagttactcaacctctcttgacctcagtctccttatataacaaatgagagaatacagtcagatcacaggttctcaaccctcttaggacaaataatgttttggcacatgtatctctttaagaatacggtaaaagctttggctctttctatagaaaaatgcttgtatccacagacactcaaatttctcatcctaaagctcattcacagaagagggtctttgaaccacagcttaagaaatatgcaccagataatcgccaa

SEQ ID NO: 5661 - DNA, 2119 bp, Homo sapiens
gatgtagtcttgctctgtcacccaggctggagtgcagtggctcactgcaacctcccgcgtagctgggattacaggcgcccgccaccacgcctggctgatttgtgtatttttagtagagacagggtttcaccatgttggccaggctggtctcgaactcctgaccttgtaatccacccacctgagcctcccaaagtgctgggattacaggcatgagccaccgcacccggccccattagtaacctctttctgtttcaggatccaatccagggtagcacattgcatttagctgtgatcagatcatgaatctgtaatgcttatataggttccctaaatgtgtggttttcagcctcagactactcccctaatcctagacgcctgtcctctgcctagcccttatcaccaaaaaggggcccagggggcactgtggattatgtacagtaaacacctctagagggtggtccatgacgcccctctgatccactaagtcctatgctcactgctcaatgcacaccagattttcttgtggggtaaggaaatgttttagaaccagacagaggtagtggatgtacactattgtgaaggcacatcaagccaaggagcattcactttaaaacggttaatttcaagttatgtgaatttcaccttgatctacaaaagagtcctgtgcttcctggcacactgtggacacaaccattcttcatcgtggggataactcggaccaagctttcaaaatcacatccccctctgtgtaaatcccgtcagtggtttctcactgaattaaggataaaatccgaattctgcaccagggcctagaggcacctccctgacctgagccctgccttctacctccacttcatccccacttcacggggctggctcctcctcctcacactgcctgcctcagtttcccctacaaaggcttcctctgactagcctaatcagaaggaggcccccttgtgtttcctggccacagcccccagttaatcacctggagtcatttgttaggcttccttgcctgttggagtttcctctgtggccctggcacctaacagtgcctggcacagagcaaaggggctcagtggatacttttttttttttttttgagatggagtctcatctgtcacccaggctggagtgcaatggcacaatctgggctcactgcaacctctgtctcccaggtttaagcaattcttctgcctcagcctcctgagtagctaggattataggcgcccgccaccatgcccggctaattttatatttttagtacagacagggttttgccatattggctaggctggtcttgaactcctgacctcaggtgatctgcctaccttggcctcccaaagtgctggggagtggacacctgttgttgagctggatgagggaatgaatgagatgatggccaactctcttatttcactactggatgagaccagagacagaagatggatgagaacagaagaagccggctgctgccctgcagggagctggccctgagtactgtggggactggtgggggtgtggcggtggggacagaatcctcatcagccacagggcctgagttagtccagggaaggggccctgcactgtcaggagctggggaaatgaattttctctggtcacttttcatttcgtctgacatttcccataacagtttttcataaggaagcccaatatctgaaaaagatacagtgtccccagagcacaaagtggggaaggggcagggtgagggagtgccagcctgcttcccttggcccatcccttgggcaccagtggagaccgctagggctctgagaaaccgagttttaaaactaggttttcagaatacagtttttttccagaatgtcatacatatggaatcagacagtgagcatccttttctgtctggcttttttcactttttcaaaagcctctgatttgagaccaatgtttaaacctcaaagcattcacgttttcctaatgccgcttgagtaagaagcaaaaagtaaaacttaccttctggaatacttgatagttggatttggaccatatatcaagctgaggggaaaggagagaaggatcatcagcatcggtcttagaattcgggacttcaagaaataatattgtaactactgttaac

SEQ ID NO: 5662 - DNA, 4318 bp, Homo sapiens
cctccccgcaccgcgcgggtccggaacaccgccctcggcaaacctcggctggctccggcctttctcctcctctgaggcctggatcttctcttcgcgaccagtctgccctttccttcttttcctcactcgcgagtcggccaccgccgttcccgtttagggatagtctcgctcgggcgcctgctcgaggctgatctcaggggctccgggctgcgcagggagggagccgccttccggaagaggacggtggggcgcgagggaagccatcgcggactaaataagggaggctgcagcggctgcgcgtgcgcccagaggcgcagcgggagggggtgctctcgggcgagctctccggccgcggcccccgcccctgcgctgtcgggcggggaggtcggaaaccccctggcgagaccacgggcggacgcttcccgaagagctgcctgggctgcagccgcggaagctgcgttctggggagcggggagcgtgctccggcgccttcgggccgctgctggaagccggaaccgagcccgggccgctgcccctcaccggacgccgcgcgccaccggccctccgcggggcaggggctgctgcgagctcgccgggcgccctttagacagtcgtccttgtctactccactaccaaatgttgaagttcttcaagaatcagtcctttggaggtgatgtcattgaaaatgatgagtaggaaactccaagagcgcatttctccacaaaaccagtgaatacattggcacaaattgtcagaatcaattttatataaattctggaaattagtcaaaggtttatagtaaccaaggaaacatctttttaaaaagatggctgaggctggatgctgtggcttatacctgtaatcccagcactttgagaggccaaggcgagcagagcatttgagtcaggagttagagaccagcaaaaaaattagctgggtgtgtttgcgggcacctgtaatccctcagggaggctgaggcaggagaatcgcttgaacctggaagatggaggttgcagtgagccaagatcgtgccacctcactccagcctgggtgatagagtgagactctgtctcaaaaaaaaaaaaaaaaaaaagtctgaatcctgaatctcaggagcgctttctatcatttaaacttaccctggtgccacctccctgtccagctttgaaaacaacgacatgcatttctgatatctgttcctggtgccaaagggagcaggatggccttgttttcttttcttctttcttttttttttttgagatggagttttgcccgtgttgcccaggctggagtgcagtggcgcaatctcggctcacagcaacctccgcctcccggcttcaagcgattctcctgcctcaacctcccgagtagctgggattacaggcacttgccaccatgcctgaccaatttttgtatttttagttgagacgggattttgccatgttggctaggctggtctcgaactcctgacctcaggtgatccgcccacctcagcctcccaaagtgctgggattacaggcatgagccactgtgcctggccgtggaccttcttttcaaagaattatggaggcttattttagttcccctaacttggaaatctcctgaggaagaaaggtgactacaggcatttgtcaaaaatttgtaaaggcaagtttattagcctctgccatcgggggcaaagaataatagctaaggcaaacaatagacacaccaaaaagcctgggaggaaaagctggaaagtaagatattttggagaataaaggcttttaaaacttccacatattcttgggaatccaaaaggccacatgtacatgcagggtgagcaaatagagaagacttgagaaagccttaaactctcacctctggctaaccatcaggcttgctcaaataggaagtgaaaactaaggtgaatttgttgcttagctgaatgttgaaggtgtgccccaacacttacacagagcctactggtaaagactgagagtgttttctttttgtcttggtttcaggcatttaaggaaatctgtttctcttttggatcactagctgcaaattaagctaacagaacaggagctcagctggtcacacacagcaacgaatacagactttataaagttcagaaaagttaccaaacagtggtaaccataacaagtaccaacaatgaactatggggagggaggagaatctgatttccagagttaccacattataatactattcaaaatgtcacatttttagcaaagattacatgacaaggaaaaaccagaaaagtatggcccatacacaggtaaaaaaagaaattaatagaaactacccctgaagaagcacagacttcggatgtacaaaacaaagacttttcatcaactcttttagatatgctagaagagctaaaggaaaccatggacagagaacaaaaaaattaggaaagcaatgtctcatccaatacagaatatcaataaagagattgaaattgtagaaaagaaccaaatagaaattctggagttgaaaagtattataactaaaactgaaaattcactagaggtattcagcagcagactggagaagtcagaagaaagaatcaacaggcttcaagataggtcaattaagattatacagtctgaggagcagaaaggaaaaagaatgaagaaaaatgaacagagcataaaagacctctgggactctatcaagcataccagtatatgcatgaggggagtcccagaaggagaagaaagagagaaagggacataatatttgaagaaataatggtagaaaatgtcccagctttgatgaaatacatgaatctagatattcaagaggctcaaagaaccctaaatagggtaaactcaaaaagacccacaccggaatgcaaaagtgagctgggtgtggtggcacgtgcctgtggtcccagctactcgagaggctaaggcaggaaaatcgcttgaacccaggaggcagagattgcggtgagccgggattgcgccagtgcactccagctgggcgacagagcgagattccatctcgaaaaaaaaaaaaaaaaaaaaaaaaaactattgctgcagtcattcagatggaaatggggaaagaataatattaactgatttcaaaaaggacttgaagatgtgaatcatctattttgctgaagaaatcttaactctttgaaattactttttgttgctgttgtcatactcttaggtgccaaactgcggtaaattttttatcagtgaagtggaagcatgtgttttgttgttttgggaatttttatcaagtatcttcagagaagattatttcctgctttatcttcaaaaactggaaaggaagggtcaaagaaaagacagtagctggccggtcatggtggctcatgcctgtaatcccaacactttgggaggctgaggtgggcagatcacctgaggttgggagttcgaggccagcctgaccaacgtggagaaatgccatctctactaaagatgcaaggattggccgggcgtggtggtgcgtgcctgtgatcccagctgctcaggaggctgaggcaggagaatcgcttggacctgggaggtggaggttgcggtgagctgagatcacgccattgcactccagcctgggcaacaagcgaaactctgtctcaaaaaaaaagaaaagacagtagcttatgttcatgtcaagcacctctcatcacagtctagttccaaggaaaaaattcccagcgttttctacattcggtgctgcgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacctttctcagatacctgtgcatcttatgggttttgtttttctctttgagacagtctcaccctgttgcccaggctggagtgcagtggcatggtctcagctcattgcagcctccgcctcctgggttcaggtggttctgcctcagccccttgat

SEQ ID NO: 5663 - DNA, 1396 bp, Homo sapiens
tcggcggaggcttgggcgccctcctctctaggaacttcgacatctggccggtccttctcgagtctctccacctcgccctgccagccctgttttattcccgagcctgctcgcgggcccctaaggcgtcctctctggcagccgtgcgtcctagcctgtggcgggtggcgccgcgcgtgccctctgcctcaccttgctcacggcgtctctccgccccagtgcgcctgttggcgctcgctccgctgcctggctaacacctgctgtcctccgaaatcgtccttccggcaagccttccctaacccagtggcagggaagcgcgtttgctgggctcccgcgatgtcctggtgatgcttattaagcttcagtacactggaaaggaatctggttaaatacagttaacatctacatcccaggaccagtgcaggacctgcagtatttcatgaattaaaaagaaacacaaagagaaaaggtatctggtttatttaggttgctgtgatctccctgagaaataagagtcagtatagaccaacgctgtccaaccaatagaactttctgccatgatggcatatcctgtagctgcactgtcccctcatgtggctgtctgaacacttgaatgactaatgtgactgagaaactgagcttttaatcttaattaacttaaatttaagtttagccacatgtatttagtggctactgtactggacagtgcaggtctagctagaccagtggttctcaattgagggcaattttcccccacagataacatttgccaaggtctggagatatttttggttgtcacaactgggggagtgcttctgatgtctagtgggcagaggccagggatgctgctgagcaccctaccatacaccagacagccccacaacaaagaattatctggccccaaatgtcaagtacgagtttgagaaaccctggtctagactgtctagcacctgccttttgacaaggacagaccctcaactgcagcctgggaactgggattggccaaaggtcctgggctgccctcaggaagacagatgggtccagaggcctcagggaagtccctaagccctttattccatcagccaaacaacacgcattactgggcatgtgctgagcttgtgccagtgccaggacaggacagagacggatcctatcctgtgaagggctgcctgctctccctccttccagggtccttcaaggatcttggcagggggatgggaggttggtgcagggagcactaaaggtcctagcagccattcataagtccatctatgtctccagccccacatggtatcagccgcttccctcatcctcataggcgatggcaatccctcgtcttccactcacagcttctgtcactggcgtctgacccaggcggggctccagcccttgccagctc

SEQ ID NO: 5664 - DNA, 5590 bp, Homo sapiens
gggctcggagcctaggcgggcgggcgggcgccgagagcgacctcgccagacccgcgggggaactagcaggcttcgccggcgagggagggccgaggtgcggccgcggagagggtgcccggaggtgcccccggcgtccggggaggctcggggggcgcccacagccctgctccggagctctcccccaagttctcccagctcagactagggcttccaggccagctctctcccgcctcccggagcgagcggtccgcgcccaccctcatcccccggagcgtggccgctggtttggggcgcacgcacgccgatcgcggcgtccagcttcggtgcctacctcgcggtcctctccttgccgaacggcacatacgaaacttaaaaaaaaacccgaaaactaaaacctctgcattaaaaaaaaaaaatccccgttgctctttacaccccggaaacggcaagggaacgacgggctccggcggaggggccgctgtgggagccggttcaatccagcccggcatggttctccaggcctgcccgggcgcatgaagatcggcgccgccgccactcgtagcaacccctctcccccgaaatccgcggctcccgggctcacttaccgagcgtgtggatgggagcgcaggccgggggcacctgggagcacggcgggccgaacagtcgagccgcagctccgctgcagccgacgccggggcagcgagtcgccagacaaagcccgagatggcgaagcggagcgacggctaatggcgagccccacgcgccgcgctccgcccgccccgctccgcccgcccgcccgcccgcctcggcgcagcgcagcgccgctccgagcgcttgcccgtcagagccgcctcggcgccgccgcctcccgggccaccccggcctcgcctggcccctccgcctcctccgggcggctcagcctcaccccttccctcccactgctctaggggttgcacaaaaaaaattttttttttttaaagaaaaatggttttcgtcttttttttttctttttgcagggcgggcatgttgagacttttggatatttctgcccccagctcgcactcacctgcggagccgccgggagggctaggggtgggggcgcgcggggctggagccggcgagcgcgggttgaaagccagccaagctctgcagcgcccgacccgggcgtgtacgccgccgccagtccccgcagagaaatcgtcctcctaccccgcctccatcgctctgcgtttctcttccaatcagccggtcgcttggtggctcctccattctccggccaagcccagctgcctagagcgagctccactcctccatctgttcgccggggtcctcgctcccctgccggggccggcgagacggcgtgaggccggagggggatttgcaaggaaacctgcctgcttcccgctcccattgctccatccccgctgcctcctgcctcctgcttctctcctgcgtctttccaactctcccctgtcgccactggtgtgtgtctgagtgtgtgcgcggttttttttttttaattgctctttgcttttgcaaccctgaagcaaaagggggggggggtagttacagggaaaaaaaaagcgagaaagaagctcttagatttgcaacacatcggaaaaccgggggagcaccccgccttatccgatctccatgctccgcaagggccttccgggttttaggacaagcttctcaatgtcccgtttcgctgggtttaggatccgaggagtccgagcaaaaagttctccccctgggtcgtagtgacgggtgtcggggtgggagttgcggggatttttcaagaagcagcagctaccccggcgtcggtcactgggccggggtaggggaaagagcaaaatcccagtgggtttgcgcgagggatcttctagggtcgaggcgggtgtggggggagttggaaccgggagacaccgcttggcgcatctctccctcggtctctacctcctgtcctatgccagctccccctttaatttttttcctctcctttaatctaatttcttccaactccacctttgttgttaccggcgtcacacccggaccagccaatccccgccacgcaatcagcttgtcaaaaagcctcggccatccctaggaaagcaggccgcaggcgctgccccccggcggcggcgggcagccgcgaggggagcccagcacccggttctcgctgccccgggtggcagcggggcagcctccgacaagacgtcccttggttcactgtcctgcaggccggggatgaaaggcctggacagggtccaccacccactctcccactgccacggccgtggttgactgtctttgcctccccttttcagaggaaaggttatcaggacaggacgcagggagccagaagaccatctgaaggaagcctgcttccaacgggcccagcctccagccaccgctcctggggcagcgccattgctcctggctctcaggctgccagtctcccacaccgacgctctactgcccgcatctcggccagctgggtcacccagcccctttcgactctcccctggcacgcagccttctccttcactcggcctgcctcgctgctgctgtaattcctcttgtctcctgggagaaatgagattgctttcccaggacttccacatcccacttctatcaggtttcaccaacagggaggaagccctgtcaagatctggtgtgtcctgttttttttttttttttttcccagagggcactggcatgtaggagaagcggatttaccactagtagatgttaatgaaatttcagcttctaggcccctaacttgcaggacctgcccaaggccctgaacttaattttgttttcatcatttggtatttttttgttaaaagagccaccgaccacctccccgctaccccagaactgcacgtgtttctggccctacaaacccagatcgtcccttggaatatacacagggcaatttgtgtaggatcacactgcgctaaaagtgaggcatggtgggctaggcgcactggctcacacctgtaatcccagcactttgggagaccaagacaggaggtcttaagtgattaagcccaggagttcgagatcagcttagacaacatagcaagatgctgcctctacaaacacacacaccccctattataatatgtcaaaaaaaaaaaaaaaaaaaggaaaagtgaggcatagaactgactttattgttttgactaggaaagagcaaagggtttggaatcaaaagtcccaacttccccaccttcttaatagtgtgtgaatctgagtgccttattaaccttccctggtcccagtttcgtatctgtaaagttagaatagcaatcctgtttaatttgcttctctcaccagggatcagaaggccaaatgagatgatgtatgtaaaattgtaaagtcctccacagatggcacttgccacattacagagaacttgagacccccccccaccaataacgttccaaatcttccacatgcagatctggagtccaggtgtcctggctcctggccctgaactttttggctgggccaaggggcttttcggtaaagtgctttggaataaaacaggatgaacatgaatcataagaatgagtatttattgattccttgggcagcaaaaactatggctggcacccttcccacttggaaacgaattggcttgttttacatctatttcgtctgtggtgaggtcaggagtccaagacttgggctaacggccagagtatgaggaatctgcccttggccctttttctttgccccatttcccagttcatctccctcctcaccctccagccttctggcatgtgccttgaagcagagcgctggcattcaataaccccagcccaggctggtgacaaagcgggatcctagctacacaatttccacttggcctcagtatttccccaggttgccagcatccaagcaccagcttatataaaacccccagagtgcctggaatgcgttaaccaaagtgtggtacttaaattaccagtctacagggagtaattttagatggtataccaatattttcagatttatgtattttaatgcatattggaaatgttctgtttttaaatttttatttaagatggtataaagacacacgtttttgggccaagaatgttattgtcccttgttactttttttttttttttccttgggacggagtttcactcttattgaccaggctggagtgcaatggcgcgatcttggctcaccgcaacctccacctcctgggttcaagcgattctcctgcctcagcctcccaagtagctgggattacaggcatgcaccaccacgcccagctaattttgtaattttagtagagatggggtttctccacgttggtcaggctggtctcgaactcccaacctcaggtgatccgcccaccttggcctcccaaagtgctgagattacaggcgtgagccactgcgcccggcctgtcccttgttatttttttattgctgtgtaagtcagagatagtaaagtacacatactttaagtatacaacttttttttttgagacggagctttgctcttgtcacccagactggagtgcaatggcacgatcttggctcactgcaacctccacctccctggttcaagcaattctgcctcagcctcccgagtagctgggattacaggcatgcgccaccacgaccagctaatttttttgtatttttatttatttattttttgagattgagtctagctctgttgcccaggctggagtgcagtggcacgatttcagctcactgcaacctccgcctccaggtttcaggcgattctcctgcctcagcctcctgagtagctgggattacaagcgcccacgacaatgcccagctaatttttgtattttcaataaagacggggtttcgccatgttggccaggctggtcgcgaactcctcacctcaggtgatctgcctgcgtcagcctcctaaagtgctgattacaggcaggagccacccaacccagcataagtatacagcttgatgaacttttaggtatgtatatttagtatcatattacatatgtgtataccatgtaaccagcacccagatcaaaatatcaaatatttctagcatttagcaagttttttttttttttttttttttttgaggtggagtctcactctgtcacctaggctggagtgcagtgacacggtcttggctcactgccagctctgcctcccgggttcgtgtcattctcctgcctcagcctcctgagtagctgggactacaggtgcccgccaccatgcccggctaattttttttttaattttaatttttagtagagacggggtttcaccgtgttagccaggatggtctcgatctcctgacctcgtgatccacctgcctcagtctcccaaagtgctgggattacaggcgtgaaccaccgcacctggcgcatttagcaggtttactcagtattcccctccaagtatcatcaatgttctgaggttctgagctctatcaccatagacaagttttacctgttcttgtagtatttccattgtataaatataccacaatttatccattctacatttatttatttattttaaggtgaagtcttgctatgttgccctagctggtcttgaac

SEQ ID NO: 5665 - DNA, 1058 bp, Homo sapiens
acaccatttcactccagcctgggcaaaagagcgaaactccgtctcaaaaaaaaaaaaaaaattccaacgaagtcgtgagatcctgtctctacaaaaaactgttttaaaagttagccaggcagggtggcatgtacctggagtcccagctactcaggaggctgagggaggaggatcccttgtgcccaggagatcaaggcatagccaacatgctaatgaactcttttctcagttaattccactaattagttatctcttcttgttctgccagaatcccaacccttttacaatctactcatcaaatccatcaggccacatattatgccttcctagaggaacacttttcgtgatgacactttgtaaacaaggcaatctgatgctgcctgttctatcttcccagatctagttgatagttcaaaacatcaacattaaccacaagtaaaatatgcttaaaaaataatcaggagacgatctcctgctctatctggaaatttctctattcagctagttctgcgttgacaggtcaacagagaatggcactagttattgctacaatcctaaaaggcatttccctacagctaaaccatcaaccctttcctaaaatccatataatccaaaatttttctagcagaatttactctccctgcccctaccccagcagcatcttctgatcatttttcaccataaactgaggtttcctcatagtgatgccaagtcaggcaaacacattccttaagcgttccacctaactcccttcttcctggaagttacatgtaatagctgcctttatttacttatttttaaaactcttcaagcaccaggtacagtggtaagtgcttttaaagaacatgtatctacttccatccttaacactgtatgagattgggactcacattcccattttacagaggagaaatgcaaaggcttagtaacctgcccaaggtcatacagggcagagattggaatccaagtctgacctctgtgtcctccgctcttaaccttcatgctgtctttccttctgatctcttcctgtcctaactggtgccctgtggtcttataaa

SEQ ID NO: 5666 - DNA, 407 bp, Homo sapiens
cccatgtccacaccatattgtctccaggcaagagaagaggtgatagagactccaggctgcatccaactcagcacatcctgaagctgtgggcagggacagaggtcctacttgctccaataccttggcctttaggcccatacaaaggcgttcgtggtgccggtagcgaaccaagccaggggcaacagcgcgcagagatcgcagaaactccagtactcgcggaaaatgttccacgcagcgtccgcgcacaacctgccagctagccgcggcggcgaagcgtagagctgcgggacccgccaccaggggcgtagccatggtcggcgggctccgcccggaggcggtccctccgggttcctcacccggatgggtgaggctttccgatcactcctaggggcggggcttctggcaac

SEQ ID NO: 5667 - DNA, 1969 bp, Homo sapiens
actcacagccaggcttacctaaggaaaagacccctctgaactctccgacactcacatcctggggccgaaaccatgatataaacagcctctggagcttgaccgaagctccctgaacgcacacacagtccctcttttaacgtgtaagtgcacggtggccggggctcgccaacaagcacggtgtagacggggagcaaggactggccgggctgcgcaggaggcccgccggctggacccggccgataatggagcacgagccgcccaccctccctcaagaaggccagtgaagaagcacataggtcaggcgccgagccccgggaggcagaaatgggcccggaaaccggggagggactcgctgcggatgcccaggacgctggggccgggagtttgagcgccggggggccgggctgcagccgcgagggctgcactctcatcccggccgcccctctcacctcctgcgctggcggtcccggttcctgccgaggcggtcggacaggcgtcccaggagcgcggccagccctgggcggccaggcaggaggcccagcagtcgcctccagaacacgggtcccgccgcagctgccgccgccaccgccatggagactcgccgcttccgcttccgctcccggcgggcgcgaactttattgacaaaggcgagcgcggacacggctcaggcgcgcaggcgcggaacccctggctcggggagggcggcgctgcaccgcccccaagcctcagtttcccctctgggggacacaggcgaggaacagtggtcgcgccgcaggagggggtcggaagccggcccgttaaatccgtaagggcgccaggtggcctgcattcctgcagtcactcgtcacaggtcgcggaggaaaggatgcggcgcaggggctctagcaccgtcacgcttggctccaactcaccagctgtcaaaaaagcttttgtttgtttgttttgagacagagtctcggtctgtgtcccaggctggagtgcagtggcgcgatcttggcgcattgcagcctcgacctcccggcctcaggggatcctctcaaagtgctgggaccactcccaaagtgctgggaccaccaaagtgcgtgtgccaccatgcccggctaattctttacttttttgtcgagatgggggtctcactacgttgcccaggccggtctcgagctcctgggctcaagagatcatccagcctcagcctcccaaagtgttgccattacagacatgagccaccgagcctgaccactggctgtcaagattgactcctcggccggcgcagtggctcacgcctgtaatccctgcactctgggaggcagaggcgggtggatcacctgaagtcaggagttcgagaccagcctggccaacctgatgaaaccccgtctctactaaaaatgcaaaaaattagctgggcgcagtggcccatgcctgtaatcccaaactactcaggaggctgaggcaggataatcgcttgaacccaggaggtggaggttgcagtgagccaagatcgaaccactgtactccagcctgggcaacaagagcaaaactccgtcaaaaaaaaaaaaaaaaaaaaaaaaaaaggacttctcactgataagtgagggaattactgtttgaggctctaattgatagggtgttctttagacttgtacaacacccctaaggtgttaaacttgaacaaagtctgttcttgtacaaagtcttgtaacctggttaacgctgactcactaaggtgcacagaaccacggaaaatccccaccagactgagagaggaatcatttttcaccctgttagccccagaggctgcagctccatggcacagaacagcctaagcaaatctgtgtgagatgaacagtcttccaccctcctgatatgcccaagtacacagatatcactggcccctggcaacacacagttctatgcccaaaaagctgacggagcacatcctcatacaccaagaacactttttttttttttt

SEQ ID NO: 5668 - DNA, 844 bp, Homo sapiens
gatcaattcaataagcttgtgactaaaaaaatatgctgtcagctcagacacatgactcaggactgaacagaccccaaagagggttgtagttccattgaggtcttccaaatgccagtagagaaaggtgaacacgaagccatatccaaaacccatgaaccaagccacaaacagcactgagccatactgcacgctgcagagcagcttgattaagtcccaaaagttgaaggcctgcgagtggcttgtggtggttggtgtctcctcagaggactctgtagagttgttcctttccacctgcgggatctccacctctttccctttagaatcatcgtttttgaaatggttgtagcggaaccggaactgagtggcaacgatcaaggccatggtcatgagaacgccgaagacgatgaagacgatctggtaattcctgtactcggggggcttacacccctttccatcgatgagcacttcgatgtgggtgtagtcgatcccgatgcccacagacagcatcgccaggccccagcccagggagccccacatgcgctgcaacccatagcgatctctgtgttttcccagatactggagtgtgaccgtgtctacgattgtgacagaagaggcactgaaaaattctcctattatgacaactaccaagatcaccaagaatatagcttcaacttcttgttgatcataaacaagcatgacttggtcagaaggtaaagatttggtggtggtaacaataacagtggttgtctccttggttacgcttcctggggagacaggggttgctgtgcttgagttcaaagtcaagtccatcatacggttgtgttccaccagaacaaaaggataa

SEQ ID NO: 5669 - DNA, 9078 bp, Homo sapiens
aagccgcgcctcgccggacggctgagggcgggcgacgggcggcgccggctgacgggccgcaacgcgaggggaggtccggcggcccggggcgccctgcgactgcccgaggccggaggcccggaggacccgccgccgcctttgtgtcgccggcccccgccccgctggactggcccgggccggggcggttgggccggcgctgaaggggcttggccgcccgggtccacccgttcccggatccgcctcgccggcccccgcgcccgcccaacccctgcccagcccctcggctccgcgagtttgggtgagaagtgcggcggcttttcccagggatggagtttagaggacgctaatcctatgtgtgagcggcggaccccgcccggacttcccggaggcgcccggttagtgaggcgacggcgcccacccgcgttcgcgggctcccggccgccactccccggagccgccggcccgccccagccccgcgcgtcgcccgggagggcgggctgcactccctccacgtacctggctggcagagcgtctccagggacaaaaggtgccctgggatcaaagccgagcccccgcccccgcggggatgctgccctccggaaggaggggcgctgcccccaaggtactctccccgggcacccagggggaggttccatttcaacctccgatgaaaaacacggccctcccgggtacttaggagggtctgagggtaagtgccaagatggagaaaacacgccggcccctcacagagtatctcctgaggaatgagaactatctagcgggcaaggagggcttcctgcatagcagagggcaccccctctgatcccccaaggccaagggaaaaaaatcactcttcaccggcgcccctgagccaggacaggctccagtgcagccacccaccttataattttccgcggatgctgccttgatcagatgtctgaagatgactttaaggactacaagcaaatctcaagggaaaaattcagaccttgaacaacagccttgaactttttcagggttagacaagtactccccagtggagtttctgcccttatttcttcgttcttctcttaattcttccatattttaacagaacacagacctgccgaaacgacacaggatggctctttgctttttgttagttctccaaccttccaaacccttggggcacatgcaagcactgtggaaaaacttcattaaaccaagagtcatcttactccagatcccagactgcttgggaagttggacatgcatattcccaaagagaacagtgttggaagaagacaggagagcagctcgcgggttgggggtagagggtaggaaaagagggcaagatggaggactaccactcgaggccagcctccactgcctgttagggcggtagaacctaagagccggtccaaggcaacacaaaagacagtgaggctaggtctttaattgcagccaacgatcaagaaagcaactccatcaaatgacactgtctttttaaaaaaaattttttttttttgagacagagtctcgctctgtcgcccaggctggagtgcagtggtgcgatcttggctcactgcaacctctgccacccgggttcaagcagttctccctgcctcagcctcctgagtagccgggattacaggcacgcgctaccaggcccggctaattttttttttttttcttttttggtagaatcgaggttttgccatgttggccacgttggtctcgaattcctgacctcagttgatccgcccatctcagcctcccaaagtgctgggatttcaagcgttagccaccgcactcgaccaaatgacactgtcttaaatgatttaatgtcttaaatcgggaaaggagagtaagagaaagcactcaatggagtcagaggtgtcttgcagcctagctctttccacagacaagccacatgggcctatcatctaaccttttcaaacttctccaactgcttctgtgatggagggatttgggctagaggatctttttattttattttattttattttattttggtgacagagtctcacactgtcgcccgggctgaagtgcagtggcacaatctcagcttgctgcaacctctttctcctgggttcatgcgattctcccgcctcagcctcccaactagctgggattacaggcgcacaccaccacacctggcttattttttgtgtttttagtagagacggagtttcactatgttggccagactggtctcgaactcctgacctcgtgatccgcccacctcggcctcccaaagtgctgtgattacaggcatgagccaccgcgcctggccgatgatcccatttttcaaagtaggctgggtgcggtagctcacgcctgtaatcccagcactctgggaggctaaggcgggtggatcacttgaggccagcagttcgagaccagcctggccaacatggtgaaaccccgtgtctactaaaaatacaaaaattagctcggcatagtggtacgtacctgtactttcagctacttgggaggttgagacaggagaattttgcttgaacccaggaggcggaggttgcagtgagccaagatggcaccactgcactccattctgggtgacagagtgagaccctgtctcaaaaataatgataataaaataaaagtaattatttaaggctgggagcggtggctcacgcctgtaatcacagcattttgggaggccgaggcggtggatcatgaggtcaggaggtcgagaccatcctgtcttaacacggtgaaaccctgtctctactaaaaatacaaaaaaattagccaggcgtggtggcgggcgcctgtagtcccagctactcgggaggctaaggcaggagaatcgcttgaacccaggaggcggaggttgcagtgagccgagatcacaccactgcactccagcctgggtgacagagcgagactccgtctcaaaaaaaataattattatttaaaataatcattgggcctggcgcggtggctcacacctgtaatcctagcactttgggaggccaaggcgggtggatcacgaggtcaggagattgagatccagcctggccaacatggtgaaaccccatctctgctaaaaatattttttaaattagctgagcgtggtggtgggcacctgtaatcccagctagtcgggagactgaggcaggagaatcgcttgaacctgggagtcgaaggttgcagtgagccgaggtcgtgccactgcagtccacctggccaacacagcaggcctctctctaaaataataattattattattgttattcttgacaggccagtgtagaacaggtggggcatctgtggtatgacagaactgggttccaattctgtcccttcacctgtcccaggttcctcatctgaaaactgtgacccagtaaacctaatttcatgagcagctttcattaaaattgaaataatgttggaaaatgccttgtaaccgtgcttgatatagagtagttacttagccagttatttcctctcttcttccaattcctaacaaaatggaaaaacgtttggttgctaggaaagagctctaaggggattttgttgttgtttgagacaaagtttggctctatcgcccaggatggagtgcaatggcacaatctctgctcactgcaacctccgccatagacaggagccaagcatagtggcgtgcacctgtctgtagttccagcctcttaggaggctgaggcaggagggttgcttgaggccaggagtttgagtctagcttgggcaatatattgaaaccttgtctcttaaaaaaaaaaaaaaaagaggccaggtgtagtggctcacgcctgtaatcccagcacattgggaggccgaggcagtggatcacttgaccccaggagttggagaccagcctgggcaacatgcaaacttccgtcttctaggccgggcgcggtggctcaacacctgtaataccagcactttggtaggccgaggcgggcagatcacgaggtcaggagatcgagaccatcctggctaaggtgaaacccagtctctactaaaaataaaaaaaaaattagccgggtgtggtggctggcacctgtagtcccggctacttgggaggctgaggcaggagaatggcatgaacccaggaggtggagcttgcagtaagccgagaccgcaccactgcactccagcccaggcaacagagctagacgccctctcaaataaaagtaaataaataaataaaattatgtcattaaaaaaaaatacagggccgggcgcggtggctcatgcttgtaatcccagcactttgggagggtgaagcgggtgaatcacgaggtcaggagatggagagcatcctggctaacacagtgaaaccccgtctctactaaaaatacaaaaaattagccgggcaaggcagcgtgtgtctgtagtcccagctgctggggaggctgaggcaggagaatggcatgaacccaggaggcagagcttgcagtgagccaagatcccgccactgcactccagcctgggcgacagagcgagactcggtctcaaaaaataataattaacaaaaaaaaatacaaaagttagatgcgcatgttgccatatgctcgtggtcccagctactcggcaagctgaggttgggagatcacttgagcccagaaggtggaggttgcagtgagctgagaacccaccattgtactccagcctgcgtgtcagtgagattctgtctcaaaaaaaagaaaagaaaaaaaatctaggctatgctccctagtatgggaaatctagtctagtcatttggcagaatcaggctttgcgggccatattgtctctgtcgtaactaccaactctgctggttaaaagggaagtagccacaaacaatgtctgaatgatggattatggctgtgttccaataaaactttatttgcaaaaacaggttgctggttgcaaggtagttttccaacctctacgtgattctcagactttaggttgcatcataatcacctggagggcttgttcaaacgcagattgctgggccccacccccagaattttttattcagccagtctggggtggggctgatatttgtatgtctaacaactttccaggtgaggctggttgatgatggtctggaaaccactttgaaaacctctgaagcttttctcaactccctttgtgtacctaaaacactttatccctactgtagatgtagtatttagcgtgttatattagtttagtgattggtgtgtgggtctctgggagcctttctgaatcacctccctagcctagtgcctgacaatagcaatttgctccccattcattgactgaactgaaaccagagggtcatggtcatcatcattgttccaagccatagatagaagatgaagtcaccacccccgatctcagagctcatcagagtagagcttgggctggactatgcccttctctgcagtgagcagttttctctgtggagctctgcaacctggagccagccctgcctggggtaagaggaaaaaggactccttccccccagccccacagcctgtacgcaaacacaccaggagacatgacctgctcagaggagacctggaaccaagggaataaaatgagagtgggttgggggcttggctgtttgttatttttttgcttgtaagtggacaatttgtggtgtggtgtgtgaatttggggtcttaaatccagatagctgtctgctgtggacagccactgtttctgaattacagggcatttcaagtgacctgtggtcaggatgttttctctcagatcaggcaaaatcaattggtcctgataataaccaggggagttgtactttccctatcttgagtagaagacacagctcccaggtccacctgtctctcctgactgcccacctcctggctttttttttttttttgagacggggtcttgctccgtcgcctaggctggagtgcagtggtgcgatctcagctcactgcaacctgggcctcctggattcaagagattctcctgcttcagcctagcaaggagctgggattacagacgcgtgccacctcgcccagctaattttttttatttttagtagagacggggtttcaccgtgttagccaggatgctctcgatctcccgacctcgtgatccacccaccttggcctcccaaagtgctgggattacaggcatgagccaccgtgcccggccagcctcctggcttttatcctgggggcactgcaagtagagccaggcatgtggcccatgcatccttcccagcctctctttcctgctgggcatggaggaggaggcactgccaggagctccccacagacaggcgctgcttactaatgggttggctgcaaactgtaggcataacagttaccttcctcttcacgacccctaggcctgacgaggcttacacaggaatttctttgatttgtgaagtcttaagactatactgctgggcgcggtggctcacgcctgtaatcccagcactttgggaggctgaggcaggcggatcacgaggtcaggagatcaagaccatcctggctaacacggtgaaaccccgtctctactaaaaacacaaaaaattagccggacatggtgggggggcgcctgtagtcccagctacttgggaggctgaggcaggagaatggcacgaacccaggaggcagaacttgcagtgagccgaaatcacaccactgcactctgcactccagcctaggcgacagagtaagactctgtctaaaaaaaaaaaaaaaaaaaaaaaaaaaaagactatactacctaatcttccatgcctcgctctttccacgttaatagacaaaaccaggaaaaaggactgctccccctcctgctcttgactgggctccataagaactgccaaaaggccaggcagtatttgctactcttctggggttcacttctgaaaggtgcgaccctgcaacctagagcacagggaagttaggacagcagaggagccgggccgagccgacgctggcttagaactctttctgatactccctgttcccgccagctcgttagcccagcctgccaatcagttttgcatcaataaactttatgttctgaggttggccagatgaatgagaggagagcagctaaagactgatctctgaccttggcacataaacagcctccagattggacttgacagttaataaaggaaaggccctgcaattctctgatgcctttttgccttaattagattgagcattcaaaggctatggggaaatcttccatttgaagagaaaaacctcacaagacaggaagtcacttcactcattcattctttcagactgtcaatcattcggtctacagtcactggcatttgtcaaatgccctattacctgtgctcagcactatgctaactgcttttgagtcgagtggctgcaagaattccagaagtccatgccgtgctcttctggaagactgcacagccaggcagtcaagagcacaagcttcagtttaacatatctgagctcaaatcctgattctgccatgtgacttttggcaagttacttaaactctctgcctttagtttcctcttggagtaaataataccaacctccacaggctgtcatcaaggccaaatgagaccatctgtgtaaagtgggcagcacagagcctggtgcttggcagatgcctggtggccatgaacatgacagtgcctgcacctggctgaactgtcaggccgagaagcttcccttccttccctctctcccctcccccattcctggcatgctgccagtcactggggagctggtgatgactcacaatccctgccctcagtgatattataaatctattgttggccgagcactgtggcacaacgcttgtaatcccagcactttgggaggctgaggcagaaggatcacttgaggccagaagtttgagaccagcctgggcaacataccaagatcccgtctctaccgaaaatttaaaaattagccaggcatggtggtgtgcacctgtagtcctagctacttgggagttgggaggctaaggcagaaggatcgtttgagcctcgcagttcagggttacggcctgggtgaaagagggagaccctgtccctttaaaaataaaaataaaaaaaaactattggccaggcactattggctcatgcctgtaataccaggactttgggaggctgaggcaggtggatcacttgaggcctggagttcaagaccagcctggccaacagggtgaaaccctgtctctactaataatacaaaaaattagccaggcgtggtggcacatgcctataatcccagctactcaggaggctgaggcaggagaattgcttgaacctgggaggcagaagttgcagtgagccgagatcacactgctgtactccagcatggacaacagtgggagactccctctcaaacgtgcacacacacacacacacacacacacacacacacacacacaccaaaaaacaggacggccgggcacagtggctcatgcctgtaatcccagcactttgggaggccaaggtgggcagatcatgaggtcaggagtttgagaccagcctggccaatatggtgaaaccccgactctattaaaaatacaaaaattagccaggcatcatggcacgtgccaatagtcccagctacttgggaggctgaggcagaaaaatcgcttgaacctgggaggtgggaggttgcagtgagcggagatcgtgccactgcactccagcctgggcaacagagtgagactcagtctcaaaaaaaaaaaaaaaaaaaattccctgaaccctttcatgctatatttgctcgcacatacaggtttcttcagtgttaaccgtgttcatcacattgatgtgctgtttcacttcatgctgtgtgatgtgaacttcggccagagcaaggagaaagcagtatatactctgaaaaggaccccgcaccgtgttcacccaaacagcacctcgtcatgcatctcagagccctcggcctctgggccacctcctcactcccccaggggtgctctgaagccttaaacagtctgcttttctttttcttttctttctttctttctttttttttttttaacagagtctcgctcttgttgcccaggctggagtgcagtggtgtgatcttggctcaccacaacctctgcctcccg

SEQ ID NO: 5670 - DNA, 2302 bp, Homo sapiens
atagctgttcccagcagttagaggaaatggcagccctgggacctggggggatccaagggcagtccacgtctccatgggaagatggcagcagctctgtggctcttcacagtgaagtgacgacctgttgttaaatgtttaacagaagccaaacttggcttttaggggacagctctcctgccagccagccagcttgccaaaggaatctttcctgtgcacagagagcacactgggcttggagacattctctgcacagtgggatttggtgagaatcttaagagtttctgttcaaggtcagtttgtctctctcagaccgtggcaccaaggaacctgctgctaccctacttgatggggctgaacaggagatatattccacgcttcacaattgccacctttcgggagcggcttcaccagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacactagaggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaataactaaa

SEQ ID NO: 5671 - DNA, 2295 bp, Homo sapiens
atagctgttcccagcagttagaggaaatggcagccctgggacctggggggatccaagggcagtccacgtctccatgggaagatggcagcagctctgtggctcttcacagtgaagtgacgacctgttgttaaatgtttaacagaagccaaacttggcttttaggggacagctctcctgccagccagccagcttgccaaaggaatctttcctgtgcacagagagcacactgggcttggagacattctctgcacagtgggatttggtgagaatcttaagagtttctgttcaaggtcagtttgtctctctcagaccgtggcaccaaggaacctgctgctaccctacttgatggggctgaacaggagatatattccacgcttcacaattgccacctttcgggagcggcttcaccagttacctccaactcccgccagacccaattcagagctgccatcaggtcagacctttgcctgctcttggcaacacgtccccctgtcctgctcctctgcaacctgcccctctttttcttcatgtgctgtgaaggcaccatgtggatgggtgttcaacttctggattggggatgcacagagcctgagggacacactttgcaaacctgcaccttgcacttttgggttctggcctgcaaggtctcctttattcttttggaccaaggctgtccctgggagagggcagccgccggcctgtcagagcaaatcagcctcaggcggtttctgcggctctggtatttgagctttgttttccctctctcccgggaagaactcattgaaatagtttctctgggaaagacaaagcgtctcgcccagatgctgaaggatcacttggtaactgcctgtcttggtttcccgttgtgcccatgaaggcgccatcagctctaaagctgacctgtggttccgtctccaaacagctaacccagacgtcacccccttgcagccagccgcacagcctgagttggagttctggcctctcctagcagtgagtgacagtgttggaggggccttggacaccttgggtaattgctaactaaatatgagcagtaggggaaggtcttctggtccacggcagagccaacggggcacttcctcttctcttttctagtcagggtagaaagctagaaagaatcctaaaaatcactatccaagtccccattgtgtggggacagaggcctggcctgaagcctaggctggagggttcagtcggaagcagaagccgggagactgcatgagagggttccttccagcttcaccaagcccgtgctgcgcgggatgaagaaagtcaagcctgtcttccagtggggccctgaggtgggggagctggaggatagggtggcagcttttttatcagctgtccccaaaagaggcccttctcccagttgccacggaccaaagctcctcctgggagctccagcctgtctgttcaatgtttgccttgcgccttttcctggtgaggccacccccggcaccatctcaggcctcagaaggacgacctcactgaaacagcccttaggttgggaaagaagcaagccctccgcgccccgtccaagtctctcaactgggcacgagcacacacagacgcccaggccctgtccctgcgccagaatggccgctcgcgtttccaggcacgatgcccctttccatgagtgcacagagccctgggctgagctgggggccgagctccacgctctctgagcagctctgagcggcacgccaaagaaggtctttcagatgggctctgggatgtggaaccatggcgtccagccctagcgtcgactccacactagaggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaat

SEQ ID NO: 5672 - DNA, 1044 bp, Homo sapiens
acatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgtacagaggggctcctgagttttggaagcctgttcccagtacaggagaacaactcccctgtttgcagcaggagacttcagtgcacggtgacaacgctggagttcaagaggaagccagcaatgctgcaccattggcttcagacaccattgttgttgtttgccagttttaaacttaactagttgcagacgaagaccaccttgaaatgcaggcttgttgggcttgttttgaattttaacctcggatggaagagccctagtgctgtctgtctccatgcgggatgatgattgctaggcaacaggtgattatcaacaaaggatgccacggttatactctgcaaggtggtgttccagtggcaaacagctgtataaactcttgtaaacaggaactactgacaaaaacctatagtcgactttgggatctgactttattattcagcaactcaaagatgagttctaattggcagacttctggcactggcacttgtcctcctgtttctatagaaactgggttggaagtcagagctgcacaaagggaaaggctcccaaggaggcagcagaaactggggtaatcacaacggtcaacagcagcaaaggcagcactttctgatttacttgactgctatggatgccacctctctccacgcctcagtttaat

SEQ ID NO: 5673 - DNA, 1594 bp, Homo sapiens
aagccacagcttcctcgtgagccctgagctgcgggccgcggacgctgacctcctaccacccaacctcgctcgagctcgcccacctggagaagggccccggctgtgccccggggacgcccccacgcgggaaatactcacggctcccgcaggcgcaggcggctgcgcggggcgcatcgtctccgggggctccggcctcctcgagagcagccgaacgcggggctgggctacctccttgctgtggggcatcagattattttagcaccagcggaaggaacggacggaaactgaagtcacatggagagcgggctgctcggcgactcagcacaggctcactcagacccggcctcttagagggaagcgcggcgcgggcgcgggggtggggcgggccgggggagcggggcccgaacacctgccggcctagcggccgagcagcggggatgtttagacgatcttccagcaatgcgaccgaggctcccccggctttcttgcgttggtgccttggcagggctgggggcggccagctaggggccccttgcctatgaggtctgctgacccagaaactttgctacgagcttccagccaaggaccaagctgaggccgactttgggaacggcagcaccgtggtaaagaggcacagcctgtcgtctggcagggtcagccgctcagccagtctgtcttcttatccactcagccggtccttgtggatcatctcctttacggaccctgtgttagaaagaaggggaattgctttgtcgaggactgtcagagagtgccaagagcttcttgatcttagactgcgcggatgggtttttttgtacctgatgtgtacaaagttccctgccagctcttgccaagaattcaaaggagtaagaataattgatcatatagccatcattgaagcagcgccagacactgtgctaagagcttcatatgcattaccccagcgctcctgttctcgaggaactactgtcgtctagagaaggtgaaatatttacagtgcctgctgcgtgtggagtgacgtggaccaccatagtcgggggctcagacaaggggcctccagttctgatctctctcactccccttcaaatctgaaacgttgaactgtcctgcaggattgggtcacctctcttatagcctgtgatttgggattgtgtgtagcattgtccatcctaagagaacaggagccaagtccttttcactccaaacatctggcacattgtctctgctttctacaatattcactcatggccgggcacagaggctcaggcttgtaatcctagcattttggcagaccaaggcaggtggaccgcctgagtgcaagaccagcctgggcaacatactgagactccatatgtacaaaaaatttaaaacttagccagacctggtggcacgcacctgtagtcccagctatttgggaggctgaggtgggaggatcacctgagcacagggaggttgaggctgcagtgagccaagatcacgccattgcacttcagcctgtgtgatagagtgtgactccgtctttaaaaaaataaaaataattttaaaaataaaatattatctcataatggtaataacaatcacaccaatgaaaaag

SEQ ID NO: 5674 - DNA, 1637 bp, Homo sapiens
acttcggagcctggagcacagggcgagctctcctccgccctgcagcctcaggtaaggatccggaccttcactgctgccccaactggggctcctcagctcggggcctctaggggcttgggctgctggtctgggtggaggcgcgttgggggtgtcgaggagcttgggtgcaagccccatgcgggaagctcagggcaaagcgccttgaaaccctctctagtgaaggaaggtaaaatggctccgggaccccaggcggggaaagaggtgtccaaggaggagggctggagagtaaggcggggatggcagagggtacgcagaggctgagaagtgggaccagtgtctcaaggggcgccagcctcttcctccgcccaacatggccaccatttttgttgggatagccttgggctcctgccaggggaacagcagggcagtgagggagtcaggactttgggctggtggggaggccgagaatcaaggctctggggagtcaggactttggggctggtggagtggctggggactgaggccctggggggtcaggaccttgggctgctatggaggctgggactgaggctctgggggagtcaggaccttgagctggtggggaggctgggaattgaggccctggtgtgttcaagaccttgggctggtggggaggccagggcctgaggccctggggggtcaggaccctgggctgttggggaggctggggacttaggccctggggggtcaggatcttgggctggtggggaggctgaagggtggggactgaggctctgggcagtcaggacctcacggttggggtggactggagaccaagaccttggcaggggagctgtggctgcctcatttggacgctggagggtggctagcgtggctggaagcggccagccaggggttcacagaactgaaggtgaggcctccagaggccctagtctctacctgagtgtctctgaaactggggggatggggtggagcctttagggggaagggaagagggaactgaagaggaagtgggggagggaggtagaggaggcaagtctggcgccatgctgagtcaccgcccacaaggcccagggcgggccctcggggggccctggcagggttggggggatcttaggaagccacaaggagggctggggggctcttggagcaggagtcaggaggcctgggcagcctgaagagtacacgccgacggacagacagacagtgcagtcacccataaagtagaaagcactactaacagcactggagggtgtagtgtttcctactttatggatgagtgtactgtgggcttcggagatcacgccactgctgccgcccgctgcccgccaccatcttcctcggcgctcggggacctcgtgtgacaggtgagcaccttacggcccctccctaccctgcccagatgcctgaaaggcctccatggctttcctgcccttcctggttccggacagctggggaaaggccacagcagctcctctgctgccctgcagtctttgggggcggggagggctggacatgtggaaccctgatgcagccgcagcgtcaaggacgaggaaggggtgggaagggatggtacgtggaggggaatgggtggtgggaccagggacccaatgctaataaagactggactgtgcttc

SEQ ID NO: 5675 - DNA, 1816 bp, Homo sapiens
ctcagcgggactttgcctgggaggacacgtacatcagctaaagtgtgccccctccccatgtccctagtgggtgacccttgccccttgctcttctgctcacctcccaagttaattaccctagtgagcacactcccttattaaaacatcagggcagctgggggaggatcctaactcacgggaggctgtgggggaacagcctcgttgacccgtgtgtgacacagcggctgtcgtggaaggcaaactcggtgtggtctgtggggctcccatggtggggtgaggcgtggagtcccggcctagctgccccacctgagaggagggtgcccgggcagcctctgagacttgggctgggacccttggtctggaatctgcacgctacagccagaatctgataggatcccatgttactcggggtgggctgtttttgaagcagcatccacctttcctccagccccaggctgcggctgctgccactggaatatttggggtcttcctacgcacgctgcctgtgctcccttgcgttctcctgggtgccgaggtcctggcacgtcgtagtttagagaggccccatcttcagactgcagcacagtgacccacactgagggagtttatgtccacagagacctctttgttggggacaggacctttctgagaattctctggggcgaccacaggcaattctaggccagcgggtgggttgtggaacctgactgggctgacacctgggctccacaacccactgttagggcaggaggatcccacctgtaccttcttggatcccaggccactcgaatggagtctggcgtccttcctcctcatgcaggtgaccaaaccctcaaagtcactccagtgtgcaaaggcctttggccaccacagctgttcaaaatctgctgtaactaacaggctctggtcttcaccctgatgtatttattccacccacggtggcccatctcatgtggattcccagtaggccagcccgttttcaacaagaacagtcttctatcttcacattagaaacccattagatttttggacttcacaactaaattgtgggacagttttccaggctaacattttgtatggtttctggcatgttttcccagtgtgaatggggccacttttgtggaagggctcccctcccaaaggggtattctgcctggtgcagattccagcatccctggggtagtgcctttgaacagggatgagctgcaaggccacgtgcggtggcctggggacaagggctgccatggagagtctgtgggcgtgctctcagcccgtggccttatgcccgggagtacggtgccatctgtggaagcccagccgtgagcttatgcagaccctccatgccatcttaaacccagggtcagagggagtgtggcctggaggtcacacggggtggactgaaaaagctgcatgcttttgcttctcaccttccttccaaattaacaggtttttttttttttgagacggagtctcgctctgtcacccaggctggagtacagtggcgcaatctcggctcactgaaagctccgcctcctgggttcacgccattctcctgcctcagcctcctgagtagctgggactacaggcacctgccaccacgcccggctaattttttgtatttttaatagagacggggtttcaccgtgttagccaggatggtctcaatctcctgacttcgtgatccacccgccttggcctcccaaagtgctgggattacaggcatgagccactgcgcccggacaaattaacaggtttttattagcaattacttatccttaaatgaataattattcaataaaaggaatgaaatcataaa

SEQ ID NO: 5676 - DNA, 690 bp, Homo sapiens
cgcagcggtcgcgccacgacccggagccgccagcaccacctcatgctgctgggcagccgcgggccggcgccgctggggaggtggcagggaggcgggcagccggcgacctctcctacctccctgcagggatgagataatccacacccccaaaagtgcgtgggggagggggcctggccccaatcctccgaccccgcggccaaagccaagtctctttcctctcccgctcaggcccaattccggcccctgggacccaggagtcctgagagaacaatgttggtggtggggcgcgaggagcggaaaagcgcactgcgcggcgtgagctggcgggccgcagcatagcaaccgaacatggcggctgcgcaggcgccgccagtcagtggccaggagcggcggcggcagcaacaggaggcgatctcgcgagaggcgaggccaaaaccctgcctcgctagcgcagggagaagtcgcaccagtcggagcgcagagggacacgcagacatttcagcagaggcctcaaaggcagaacaaaatagtgcaaggagccgcacatccgcacagtgctgagaccctgcccaggacaagcttggccgcagtattccctttggcacccccacccacctggaacaaagcctgatgtaaagtctgggtgcgactcagaccggcctgggaaagaatttatttaataaatggtgg

SEQ ID NO: 5677 - DNA, 4088 bp, Homo sapiens
catgagagtcagtgaacgatgacttgatttttacatgacatttgaattctgtcactatctgattcttgacctaaaggtttctttgctaaatctgatatttattatagtataatatgataatttggagctcctgttgcatctcactgccccaaaaatgttggaatgccatatgatacagggaaaagattggagttcatcaccgtggaattttgatctgtcttaatgacacaacttaattttcatgatgatagatctctgaatgattaatccagaatgatttggtacagtgactggaagaaattgtttttctgggaatttgcttcccataatgacctgatatacaggtgaccttagtataattgaaattaattataattttaattagaacatgctctgtttacagattataattgcgcagcattttaaaaaaatatacataattatgaggatgagagaattgcaaacttgaacagttcttttgttttctctccttttacttgaaaagctttcagaaagcttttgaaagatgacacagttttcatagcaacagtatgcaaattaggtttttctgccaagaaactcataaactaaagtatggaataacacaaatgcttaatcttaatcttggctttggattttgtaagcaaaagcattttctgcatcaatttttttcagtatgcagttgcatatttcattttttgattatgtcaaaagttgaattctcattttatgctgtgtttctcattagttgcagtaaagtgttgatttcattgctgcctttcaggccttcatcatacaaaccctcaccatttttcactcctgtgcttttgccataggtttttttttgtttttggtttttttccagcaactagtttttctactttcactctttcccaccagagtggtctctctaaaacaaatttgctaaagttcttaagtaggctcttttttctctaaattacagaatagcaaactaactcctaagcaagatgagtcagtgtctatgaccttgcctctttcttcctttttagtatcctcaccaaccttccctctgttgacttttgtaatccaggaatttggaactacttatgacttagtgccttggcataatcacatgccatagatgaacatgttcaagactcagttcaaatttaactttctgtgaagccctacctgacttccctaggcaggtattttctccatgcctatagtatattgaaactttttctgttaaaataacataacatttcaattacacacacacaacctgtctcttccactgaacttctctctccccctttgtattctcagtgtctagctacacataataggactttgataaatatttttgaatgaaggtaatagaaaacccgaacttctctatatttgtgtactttcacaaacaaaggcttagaattccacatgaaagtccacatgaggtaagtgtgcattcatgagcatgtgtgcactctgggcaaaccaacagaagataaacagcaaggaagagcagttgttttgtgaaaaataatcatctgttagctgtaaatcagaaatattggccaaatcagaattcttgtttctaaaatgaggcttctaaaattttcacataactgccaaactcttatttgtaattcttaaatatgccctaaagatcatctttctcttttatagacatttagtgtatacagtccacataaatacatatactgattacctacagacaataatgagacttcagaaagaatcaaaagcaatagtgatggtggaatttttaaataatattcagctggggggaaatagactgagtttgtgtgatttcaggttatttagagttattaatgtaaacataagaaggcttgtgactcttatcaccctctatagaatataaagactaaaaataaaaactattacctctgggcctgtttttctttgggattagataaagcctttctaccatatcaccaaatactcataaaggctaacacagaaagcttttccaagttaataatttctaaaattaaatatcagggccaggtgtggtggctgacacctgtaatcccagcactttgggaggccgaagtgggtggattacctgaggtcaggagctcgagacaagtcaacatggtgaaacctcatctctgctaaaaatacaaaaactagccaggcatggtgatgcacacctgtaatcccagctactcgggaggctgaggcaggagaattgcttgaacccaggaggcggaggttgcagtgagctgagattgcaccactgcactccagcctgggcgacagagtgagactctgtctcaaaaaaaagaaaaaaaatcaaaataattgtaattaactgaaatgccctgttccttcattcacttgatagacttttctacctgctctatacttggcactcaattagattctggggatacagataaaataagacaaagctcccatctggtagagtccaagtttgttttcacagttatttttccacagtctgtttaaggtattaggaggacttttataaaccgagtgtttttcaggttacttcagagaggagtctccttccacccaaaaaaactaaccaaattattttatcataaagaggtaatcccatttttatgtccacaatttttacatttttgtatcagccaccaataattttgactgttttgtcaagtacatatttcatcaatcctatttccacagccgtacatgtgatcccagtgactgatagatctgtagaatgtgaactcacatttaaagtttattttgggaaggcatatatgccttttgatgacacacacaccaaaatatataagagctgtgcatggtaaacccacagtagaagggaaaaagtaatgctttctggtatacttcagaggctccatttgaagatgtgcgttgatgtttccttgattattttgaatgaggagtaggcggtaatatttaacaggtagcatacgtatctaagcatatagtaaatattactagtacttgtgtgccatgaggcactaatacataggtgaaacaaaaatatttttagttctaaaaaattctctagatatttatggatggttaggcaatagggttccttcatgagaaggaaaaaactgtatctttattgtcagtaagtgtggaaaaaaacccgacttgtatgtgtattcacagtttgataggcatattttgaagtcattgttttccatcagtattaagtatcatccatttctatgttctctagcaaaagaaaattcttagtgtgatacagctttactctttgtttgactttgtacaaggtccacaaaaggaggaggctcaaaagattggacactttaccctgacattcagcacattcattttatctttcgataaagataaccagaaatcatttgcctcttgtttattatcatgttgaaaacacaacagtatagttccttttgtcccttacattggaaaaggtattttaaatttagccttgccgtattatttatagttaggaatttactacattttggtagtctgttttgaaactaagcacttgtgtctgaaagatgcagataatatctatctatttattacacagtgggctctgtttgctgcagaaaagagtgaaacttttaactgcttagcacacttgccagtgaaatatacctgacagagcagaggttataactttggctctaattacttttagtaatggtaagacaacgtgagttttgtttgtttacatgctgtttacaatggcataattttaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaaga

SEQ ID NO: 5678 - DNA, 2400 bp, Homo sapiens
tttaattaacttcatctgatgtgagcctctcaataaaaatattaaactaagaatagtgtcactttacgagactcccatctgtacctaagagttttgaacatttgagttggtgaaacatttctttctaatctgaatttcccacattaattattttgaggcattttaatatccttggggatgattacatccaatgaattaggtcaaagtttcatagtctctattggcaatcactagtttaatttatgattttcagcaaaaatatcagatgtgtgaatttaatgtagattaaatcagccatgcattttgttatccttcaatggcgggtagaataatggcccccaaagatatccatgtcttaattcctggagcctgtgaatatgttaacttacatggccgaaatttttttttttttttttttggtagagacaggtcttgcttgctttattgctcaggctggtctcctgggctcaagcaatcctctcacctccgcctcttgaagtgctgggattagaggcgtgagccactgtgcctggccaagtattacattcttcacagaatgtactactgaatcattccttgggaatcaagaagaagaaataaatgcaagactaactttatgggcagaactctcagaatgaagagattcagaaggaggctgatagagaggaaccggtcatgtgtctcattatttattgtttattgataaggcataccgtcagagaaaaactgaaacagcactaacttctcaaggaaaatattcacgtatcactgttctgtctgaatgttataagtggttctactatattctttctgtaaagctgaacatagctggattatccttaagaaggatggatacatattcaaggaaaactttcatgaagcactaattgcattcatcacaataatagaagcattatttttacaatcaaattgtgtgagatattgaaaagctataaaagtgtggcataacatgacacaggtaatatctattaccattttacaaataagaaaaccaaggcacaaagaggttaagcagcttgctcatagttacacagatagcagatgactatttcaaaaagggaaatttatagcttccctcatgtaagatgagggaatgtgagcttctgaatgtgatgagcaaacgaaagaaaatgaaggaggcaaagtacaaagagagttgaatgaaaggactgaattgaaagaaatgctttctctttcacaattttctctaatcttatttggctgactgtggtgctcaaaaaaatgacaataaacaggtaagagaattataatcttacccattcccagcctccctccttcacctcagtgggaccttgttatcctgatccgcacagcattatgctgaactcccaagataaggggaacagaaaataaccagtaacaggtatacatgtttaaactatcattaaaatagttctataaaatagaaagccagcagactgctcccaaactcctgggctcaagggatcctccgaatctgccaaagtgcaggggttacaggcatgagccactgcacccagcccaatttacaagtctttaacttaaacattagaaatggaaaagcctaggcactttggacttaatttacacggagggaattttaaacgcaaagaatcttcggtgttctataaaaaattcacacattcagagaaggtatcttacctaatttttaaaggaagaaaggaaaaagtatgagtaaaacattattttagtggagaatgttgtgctcctatgaggcccaagattcataaccaaccatgatgccaaaggggagatttttttagaggaatgaaaaaattattccaatgttacttgatcaacactagactccactaggaggcactctgaacttacgtgctactgtgtcatgacaacaaatataaacattcatttcatgagagaaataactgggtaattatatatgccaccagctaagatcatactcaatgaaaatacctcttatttgagttttttttctttcctgcccttgcaaccccacacagaaatacaccctgacatacaattttcctgccaagtttccatcttcaaagtgtaaaagtggtactgccaactgggaaataaaaacttgaaaatgaaaggccattagcatctcagatacaccaaaaatatggggagtataatagaaggaaagaaaactttgaaaaggcagatttttcacaaaagcaaaatttctcaaaaaaaaaaactgattgacaaaaaagccaacatgttgcctgtaagataaaaaccataaacccttctggttgtttaacagagggaggtcaatctgtttcatgaaaccacatgtggccttccagaaagtcaaagggtctgcaggaactagattttacagacaaagaaaagaaaagaagaaagaaa

SEQ ID NO: 5679 - DNA, 670 bp, Homo sapiens
agcaatttcgagtgcaagtgccacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaagtgtggagaaaagagagagaaagggagagaagagtcatggaccctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatgtctctgggatttctttattgaattacaaaatgaacataattttaacttaaatgttttcattcttttttccaatttttttgtgtgggggtcttaataatttctcagttctcaatctactctatgtcatattaaagaggataatgtatatttacaa

SEQ ID NO: 5680 - DNA, 2026 bp, Homo sapiens
cctctacaacccttaggattaagggttctcttataaaagcgcggggctggggaggggaatatgtcagaggtgttcaaaccagagcaagtccatcttgaataggggctgggtaaaataaggctgagacctactgggctgcattcccaggaggttgaggcattcttactcacagggtgagacaggcggtcagcacaagatacagatcataaagaccttgctaataaaacaggttgcagtaaagaagctggccaaaacccatcaaaaccaagatggccaccaaagtgatctctggtcatcctcactgctcattatacactaattataatgcaattagcatgctaagagacactcccaccagcactatgactatttacaaatgcatggcaatgtcaggaagttaccctatatggtctagaaaggacaggaaccctcagttccaggaactgtccacccctttcccagaaaacccatgtataattcaccccttatttagcatacaatcaagaaatatctacaagtatccttagtccagcagcccgagctgctgctctgcctatgcagtagccattctttattcccttactatctccaataaacttgttttcactaaaaaaaaaaaaaaaaaaagactccaggcccagatagtgtcagtggtgaattccaccaaacatttaaggaaaaataatactaattctacacaaatgcttccaaaaaattgaagaggacagagtgccttctgctttattctatgagtccaggatcgcatcaataccaaaaccagacaaagatagacaagaaaactaaaaaccaatatctctcatgaatatacacataaaaattcttaacaaaaaaagcttagcaaatcaaatccaataataaaggtaaaagataatacatggccaagtggagtttattccagaaatgcaggcttgatttaacattagaaagatcaatcaataaaatggacaatagttagaactaaaaagaaaaaaaaaagtcaaagattaaaaacaaggcaagattttctgctcccatgacttctatttaatattgtattggaggttctaaccatgccatcaaacaagaaaaagaaataaaaggtaatcaggttggaaagaaagaaggaaaattgtattcaaagattatgtcattatctttgtagaaaatcccaaagaatctacagaaaagatcctagaactagtaagtgagttcagcaagattgcaagatacaacatcaatatacaaaaagcagctgtatttctatatcttggcaaacaacaatcagaaacaaaaataaacaatataatttacaataatataaataattgaaatgctgaaagataaatctgacaaaagatatacaagacccgtatgctaaaaagtacaaaacattactgaaagaaattaaggacctaaataagcggagcaatatactatgttcatggaagattcactattgtttagatgttaatttccctcaaattgatctaaagatttaaagtattcccaacaaaaatcccaacaggctttttttctagcaggtgccaagctgactgacaattcatatgtaagtacaaaggacccagaatggcaaaaacaactttcaacaagaaaaaaattagaagacttacagtacatgactttaagacttataacactataatgatcaagacaatgtgctattggcaacaagacagacaaatggaccaatggaacagttcatccatactcaacatggatgaatctttttttttttttttttttttttttttttttttgaaaaagaaagagttttgctcttgttgcccaggctggagtgcaatggcacgatcttggctcaccgcaacctccgcctcccgggttcaagcaattctcctgcctcagcctcccgagtagctgggactacaggcatgtgccaccatgcctggctaattttgtatttttagtagagacggggtttctccatgttggtcaggctggtcttgaactcctgacctcagatgatctgcccaccttggcctcccaa

SEQ ID NO: 5681 - DNA, 1854 bp, Homo sapiens
acttgaatatctgctatatgctgggttctagagctgcaaaagagaacaagagtagtctttacctttaggattttccagggaactgggggagacagacagatacatacacatacaccccatcctcagtgtgtaggtgccatgacaaatcaaggcttttgatgcagatgctatgctttcacttctcatggtcgatactttttgaatcttaaagtctgattgttcagatatctagaaaaggagatgtctggctttgctctgccctctgactcactgtgttggtttatctttaggcgtggtggagggggccagaactactggctaatgagagaaggcagaccttgttagtgacatgtacaaatgggcacatctgctatattcactttcattactgattattaatagtttattaaatggagtttactgaattactattattttggcttaaaatatatatatataatttatgtagttctatgtttatagatgtgttttcagaggtgtatttgttttagaatttcactctgtcctggaagtgatttttcaaatgtggatattaaaatggataggacataatttcccaactagtacagtatgctagtgccaaccttataccactgttgtagtacccatgaaaaataatttttaaaaagctgtaaaagttcccagtgctttgaggcttcttcaaaattgagaatgatgaaaatttccaaaattatcagttgatgccataattatctctaagagatgttgtaataggaaattcatggttttcctttattttcctgtttctgaacacaaaattcaaaagaaaactctttcttccttgtcactgagactcttggtcagtgtaggctgtgaacttgtactttgtgaagagaagagtactgtgaggaagcttgaaaatactgtaggtttttgttggcatcttcttctggatggtattcatgtactctgcacgccactgaaaatatgctctgtttttcataaaatatgctcattcttttatactgagcactcggaaattggttttcccaaaccatcttagtggagaatggcctgcttttatcagttatgtgaagaagtaaattccaggctcctcagctgcaggatggctccttgttcacagctgctgctcttgcctctgtggaagacgcctgctgctaagagaatctttgtgtgttgtgtataaaatgaactttgtttggaccattccacaagcaacttaaactgcttaggagtccagccagacattcctccccagttgatcatttaaatggaggtcagatttagaacccaacttatattcgtttaaaaatagacattgcctttagaaaactgacctttggtacatttggggcctagggatctgataggctatctcttatgatgcacatcgctctgttttagactctgaaaggcagtatgcctttgaagctagataacgtcagtgtgcttgtaacttgggacccagtctgtgtgctatatgtctgcttcttcagtccacactcattacttccaggaaattcgtgagaagatgagagattattcgttatagaattgagtatggtttctctacactaattttattggatattttccagtttgactaggaaaggttagagaacatggaaagaaaatttaacaggttaattttaaggtaataagaccattgtattgatatattcttcagtgtgatttaggtgagtcaggaatttttcctctggagactgcctaaatcagggatgtccaatcttttggcttccctgggccatactggaagaataagaattgtctcaggccacgcataaagtacactaacactaatgatagctgattagcttaaaaaaaaaaaaa

SEQ ID NO: 5682 - DNA, 678 bp, Homo sapiens
atagcttttgattgttttttaaaatcgtagttcaaaaacattaacctaaaatttaccatcttaaccatttcattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctttcttagccatctaatgtggcaaagtggtagccatctaatatgttgaagtgattgtttttaagggcttgtttgtggataattaaccagctgaaagctaactacagtttgccagtgg

SEQ ID NO: 5683 - DNA, 2387 bp, Homo sapiens
ctatgcttttctttgaggggagactttttattactgactcaatcttgttactacatactggtcttttcagattttctgtttctttgtgattcagtcttggtagattgtatgtttctgggaatttatccatttcttctagattttctgatttcttggcgtatagttgttcataagtctcatgattctctgtatttctgtggtatcagttttaatgtctctactttcatttataattttttaaattttactcttattttttcttagtctacctaaagggttgtccattgtgtttatgttttcaaataaccaactaagaatttcattagtcttttctgtaattttttttctgatctctattttatttatttctgctctgatttttattatatctttccttctgctgactttcggcttactttgctcttctttttccagttccttgtggtgcaacattagttgtttatttagaacatttctctttttttatgtagttgtttatttctataagcttcattattagaactgcttttgctgaattcccataccttttgttatgttgtatttccattttcatttgtctcaagatatttttaatttttccttttaattgcttcattgacccaatgaatgttcaagagcatgttatttaatttctatatttttgttaattccaaaattcctcctattatgggtttctagtttcattccattgtcagagaagatacttgatgtaatttcagtcttgatttcggacttgttttgtatcctaacatattctgctaggaaagtaggaagtaactagattgggacaaaatggttcagaactgtagtggttggaagggatcattgagcactaccactgaactggccagtctttgataaaagcaaatgctctgttcttttcctacgtagagttagcactacggtactagaaatgttgattataaaaaatttattctacattttttttgaacttttagtaagaaacgtattaatcagtggaaggattcatagttttcctggtatttcacttgaaatagttttaaaagtaagaccttgcaaggaacatggatgtttttgtctaaattctgaaatgatcacctttacactaatttcctattttctcttcgctcttgtttgagataattattagactgaaataggttctttgtagtacatttctaatcttgcaagtacacttgaaagtctacatacccagagaaaataagtgtagaatcatgattttagcatgaggattttaaaactttttccattattctatcttgctggcttaaaattagtacagctttctttcttgttttgtttatatttttacctttgaatgtttcttcatgtaaaagtgtgttgagaggattgagggagagggtttatgctgctgtggaaatatttttccttctttttggttaaatctgctcccccttgtggtataatctaggtcattatagtgctcatatttaatatctcagaaagataataagttcttgagtgtttactccttaccagatgttaggctaaatgcttcgtatacattttctcattcaatcatcacagccacctttggaaagagatataattatcattcagccctattggatagatgaggaaacacaggattagaaactataactagtgagttgtagaactatgagttgaacttaaatttgtctcattcaaaatcccataaccttaatttctctgtcataccatctccaagagcactccagaaggaaaactttctcattgagggctacagaaatacttgcactattttcctcattttcttatttctccattttaaaaatcattttttcactttcatcctcatctgatagaaatggttatggaagatgcaaaaaaaaaaaaacacacagttttaagtgtctagctttgtatgaatctgcctcattctaagtgagcatcatttgtacctctgtcattgtttttggtaatacccttgcaagaaaacattctccattggttggatccttcactgtttgcttacattgggagttttgattcattgtattcttaacatttctaatgacataatatctgaagaaagggagaataaatgaagagtgttttaaaatatcatttctgctaatctaatgtaacaaaattttgtaactataaaacctgactacttaactaaaagatcctatgttcagggtcatagcacttaatgactttctggcatgcttttacattcaaatgtctgggtgtaaatttaatgacttctacatttcgaggctaaagaaaatttccagcaaacacaaaatgaaaaagagtaaacacatatgcacctgataatttgttttgatgcatttatagttttgataataaaaagtactttgtattgcttttct

SEQ ID NO: 5684 - DNA, 1431 bp, Homo sapiens
atactactcagattcccaaaactttcgaggacctgattgctgtctctctgggttatgtccttctttacttgagcattgtaaacttattcatggaaacatttaagtaaaaatcagatactcttctattgcagtagtggattttctattaactttgacaaatctcatcatttccttggtatgttggcaggaaaaacacagtcaagttgaaagaacctaaaatgattatctagttttggctctatttaaagagaggattgctgaaattaattctagatatttaaaacatttggatgttagttaatctgcagttgatatttgcaggggatcattgcatgtgttaactgctgcaaaaaaaaaaaaaaaaaaaagccagccccaaactcagtggcttcaaataataaacatgtattattacttgagtatacttatgcatcctgtcagggctgaattgtgtaggttgttctgcttatcttgactgaactctttcacacatttgggatttgctgcctgtagagtagtctggtagatttggctccatcacgtggactcttctccctgtcgtctctcatcctccgtcagacaaattaggagtcgctcacataggaatggcagggttccagtattattttttgaatacagtgatgacatcctacttttatgttcattctgaattaataaaatatgtagtaactgttagtgcaaacaattgtgacctgactggaagaaaacgaaaatccttgaggatgttttcacacacaataaatgcatactaattaagctagtatgaagctttacattcagagaaaaataagatttttagattcaagagtccatgtgcaggtttgttgtttaggtaaattgtgtgaaactggggtttggtgtacagattattttgtcacccaagtagtaaggatagtacatgataggtagttttttgatcctcaccctcctcccactgtccaccctcaagtgggccctagtgtccttgtgttccttccttgtgctcatatatactcagtgttgaactcacacttataagtgatagcatgtagtatttgattttcttttcctgtgtgtgtttgcctaggataatggccttcagctccatccatatttctgcaaaagacctgtgatctcagctactcgggaggctgaggcatgagaatcgcttgaatccaggaggcagaggttgcatataagggtataatctttaaaaattatcgcaacaatttgatgtacaagttatccccatttgcaaatgagaaaagtcatgtcagagagtttaagtcctttgcgaaagtctgggtccatgcatatatgctatgtacatacatagctacatacatatatgctatgtattatctgactgacttatgctaaatatagacattctataaagcatcctgtcctaggtacatggcttatcactat

SEQ ID NO: 5685 - DNA, 2201 bp, Homo sapiens
tttttctttttttttttttggagacagagtcttgcactgtcgcccaggctggagtgcaatggcacaatctcggctcactgcaacctccgcctgaagggagattttcaaagcaacattgcctctatcataggtagtcttcaatgtaatactggcaccaacaagagaaccgagctaaattaaaactaccctcaaaatgtcatcacagctgatgtgcacagcaggaaggacgatgtcacaaaatgcacagatctgttcctattgcacattccacctttcccacgtactgctggcagcccagaataaccaaaatctttttagatgtctgtcttaaagagagctataatatgcaaacatacacacacacacacacacacacccccacacacacacacaacctcaaacctggtttataaaagagctttgtggatcagagtacaccctcacttggtccaagaatctaattgtcaacattaggcaaatagacccaatgaatgtaaccaggaagagaattaactggttggctggaatattgtatttgatatgatatgcttatttgcaaactaatctccaactgtttgtccagtactaattcaactgactcatcttctaaatgtataggacaaagcctttaaaaagttaagctcttcagcaacgaaaagttaacaccatctaaaataaatagattttaaaatatatgtaatgaaattacaggtcactggaaattcaattctacaatgaatataaattaacattaaaatctattaagtactattcctgggaagattttggttcagaggttttatttttttaagggcttaatatttgggaataaatgggcatagcttagaaacccttacaaagttgtaagtagactagaggtaagattatttggtgacaagatacaaagatctgtttctatgtccaaaataatggcttacctcattttagttaatagaagtattcccaaaaagttgtgcaaataggctttttataactggacgcttattttaagtatactagaggccatggttgtaaagaaaacctgtagtcactcctctaataaactgaagaactctaagtgattagcccctgtcctacatctgcacagtggacggcatactccaggcactcataagtgtttgttgaatgcatgaattcgctctgacagttttttttttcccctacaggactttcttaaagtgaggcacatgctaactgaaatggttctgcccgctgttactgcagaaagatggaatccagctcacagtttaactgatgccattacaaaatatcagataatttcagagtgttttcaatcaaaataaaatttccataagtatgagtgtatgtatttttgaggaatgttgatctatgattggcagaagcttttattgttaactcactcactgaaaacaactgcttgagctgaattctatttcaattaacaaccaaggcaagtaaagcactttacctaacttcagaaataccaccagaaaccattccacttctgtaacagcttcttcccctcactccagcacaaatatttaaatgctgtccttaccttagtccacaaaagcaaaacatgaattacaaagctaagattaaattagaaagctgccgacttaaatatgacaaagtttttttagccttaaaataagaactaagtcaaatacattcaacaaaagtaactcttaaaggcaaatttttttcttatttggtgttttcttcccttcccatttaaatttaagactcaatttttaataatattcatatgtccatttttctaaataatatatcctctttaaaacaatacagaatgcctagcagtgcaacctatgtgtccacataaatatgcaacctgccacataaataaaataagaggttttatcagtctatttatccagcatttgtaactgcaaaaaaggctggaaaaatagctaagaatatttttatgcaagttttggggaggactgaacactggtaaggattcactgtagggctccatcattataagtttcctaaaaagtagtgtgcaaacaaaatatctgaacacagaaccctaaacatactagatgtatgtgtgggtatgggtgatggagaagagagaatgaatatgttaatatgaatgcttgtcaaggacactgataagaaaaagaaaacctctcacttaaggtgctaatgatatgtcaagggacctaaat

SEQ ID NO: 5686 - DNA, 27178 bp, Homo sapiens
ggcggcgagcgctatctggagctgaccgtgcggctcttaatccctggccttgggaaagtgaattggcctgaatagcaaggaggagaacttgggtgtggaaataccgggtatgttcttacagtatttagatggtaaaatataaagctagccagttattctgtcaactcattagacaccattgtagggaggagaactcagtttaaggggcaaaacgttgagagttcagacttttttcttgaatcagtaggcatttagcagacggataggcccctgccagggttcatttcgcagaaatggcagcctctagggagaggtaacctaataaataaattattgcatgtgtgtgtatgtgtgtgtgtgtaggggtgtgtgtgtgtgtgtgtgtgtatgtgtgtgtgtgtgtaggtacttttctccctattttacagctgaggacactgatgtacaaagaggttaaatcacacagctagaaagtggaagaactaagttttgacccttggtgttctgactgggggtctacattctaatccactgttctgcctagattctgaatggagtgaggcagggatcatccccggagggtcaggaatgtacccctcaccccatacagagagggccttgaggattctaaagagaggttttatgctagatgtagctgctacagtctggagaaccagagttcctcttacagttctttttgccacttaaataaatgttagagatacagcagtaagcagtataccagcaatctgctgtcatcccgcattggttggggaaaaggagagagacagatattaatgaaaactagaagacaaacatgagaagaaccttccccacacacccaccaaaatatcagataggtagagccagaccacgtagacgctgtagatttgttaggagccctttttatttgaggaacatttagaaactgacaaattctttaagtaggtgtgtgttgaggggagagaatcaaagtttaggtatgaaaatttctccggttgcaatgcaaaaaacagaagcagaaagaccagttggactactgtagaagtctggagaaaaacactaccataatagtttggtgaaagtggacatgtagagaaggaactggaattgagatacgttttagaagtagttgataggaacttgcagatgaagaatagtaagcaaggataaattctggatttttggcttaagctagatattatccatctgtagatgatgatgccatttactgaatgtgagaagattgaccaagtatagctaggttagaaactgtagtgggacattgggaatagaggaacatatattaagtttaaggtatctattcagtatccctgtttcaagtaggaagttgaatgtgtgtgtttggcattcttgggaaaggttaccacgaggtatggcatcaacctatatggtatttatatctgaagaatgacaaagggtatagatagaattgtgcccataatggagtcatgggacatgcagatgttgagaagttgaggcaaggaagaagaagaagacaatcaattcctgccctctcaatgcttactttctaaaatcaagacagaataaatatgtaaataaagttcttttcagagaataataagtgctttggaaaaaatagggtagtgttataaaccgattggagtggtcatgctattttaaacactatccttcagcggcttttttgtgtgtgttctttgaagacttgtttggagcttctagcaagggagcactgctacacgtatgcccttacagaaaaatcatcctcctttatgggggtaagtcatcctcctcagccgagtgggcagctttggaagagacatatatggggcagttaggaaggaaggggaacccagctagttagccagatcagccaaatcaactgttgggatcagttggtgacaggtgtcatgcaaaatgaccgtcacatcctccctgtgactcttatgtttagtaaaatgttccagacatagtgcacattctgtaaatatctattcaatgaatgaatgcatgaaggaattcacttttatatttaccactgcctcctacggttaggaattactacaggggctatcaggcagagtttaatggtcattatctactgtaattcaggtatcatgactgagtggaatagttacatgacagaattttattttctctctacttaattgcttttagttgtactcaatgaaatctaccttatcctttccttgacaatatctcaggtagaggtcataattttctagtcactttcagttgctatcagtacagttggttagagatgtcaagtccaaactccattaaggtgtctcttcttacactcccctcatatcaggcttgacctaaaggattgcaggaatatgtaatacactctaatcttttctgtgtctgagtgtaggtatgtgtggtcgtatctgagaagtacctttctcattccctcctctttgtctagcccagaagttgccaaactttttcagttattggtagctttattgtcccagcagttttttctagcaccccttgatgccaccttatttcctattccactctggttttccaggaagcacttgttttatatgagagcaacagccaaaaacccagcttttcaaatatatgacattcttaaaaggaattaaacagtatctaatgttcaaattgagaaacatctcaagctggtagttcaggtagtgtctggtaaacagtgagtattgctatgtttccctcaaatatttaaaatatcctatagtacctctataaggtggcaagggtacctggggcaccttagcacagtttgagaactgtgaatttaactcattttcagtcttgattttctatgttggggaatgggaggcgggaaaagtagtggagcttgggagtgtctgacttcactgagcaattgttggttctttatctcattcttattctcaggggttttgtgtgttgatggaggtccccgctaatgtggtggttttcttgggttaattttcatcttcatcagttcctccatgttactgagtaccttctcagacagaattaccttttttgcttcctttggtttatgtccctagttttcctcacttgaccacatggctacttgtacttccctattacatcttcccttttacccccaaactccccatttttccgcatgaagacaggaaaactgctgggtcctatctctggcatgctttggagaactacaatagggagaagggttgatcccaatatttgtcctggcttctagccaaaagcattcccctcacccttcatagccaagcttctaaagagagagacataattattcttatttcttcatctcccattcactccaaagtgtgctcctgacttctgatcccatcagtccacaaggtagttcttcttagggtcactagttacctcccagttactaaatctaataggccttttcagttctcattttagcttctcagcaatgcttggcatacttgaccacttcttcgttgagacgctatcttcccttggtttccaaaacacaccacttctcctactgttcgatctcactttctctcattgccttactctagtaaatctttgactccatgctttctcctatttcctgtcaccttgaatccttcccactttcattcttagatggtgaccttgcttcttaatctcatttggggaaaaaaagtgaaccaagttatagaggattcccatacctattaatcctaactgtatctgtgagtcttggttaagctaacctctctcgggaagtaaatctcctgccttctcatgtactttactgagcctttctcatcagtgtatacaaatgcaattatttacccttttgtttaaaaaagccaaaagcaaataaaataatttttaaaaactctcttctttccactttcctctttggctaccattccatttctttctgttaatagcagaactcttggaaatggtggtttatatttgttgtctccaattttcttctcccatattctgtttagaatattccaatcagatttgtatcccaattgtttttctgaaattgcccttctcgaggtcatcagtgacctctacacattgctaaatccagtggtaatttcttagatcttatcctacttgatctataagcattgctcaccaaacacagttgtttactctgctctaaaaacagtcaaacaaaaaacaccctacaaacaaccaataaaccaaactcccttcatttggcttgctgaacaccaaacttgccaagtttttctcctatcattctgatcactctctttgtttcttttgctgattgctcttcatctccttgacctccaaaggctggagtttcccatgctcaatcttttctcattttgccctacttgtactggacaagtcatctcattcagttttatggctttaagaaccacacattgatgactaccaaatcatatcttcagcctgaacctcttctctaaactcccaatccatatattgaactgcttacttgacattttctcaatgttgtgtaataagcatctcaaaactaacaggcctaaaactgagctcttgatagtattcaaaacttttctttcagtttttcccatctcagttacctgtgactcctttatatcttttatatctcatgccttgacattcagcaaattccctttatcttaccttcaaattatattcaaaatttgactatttttcactgttcccactgtttctaccatccttgtccaagcagccatgatctatctggaatattgtcatagcctcatggctagtctcctacttttgccctttctgtctggacgacacagtaagactcaacaattatttcatatattcctttccatttcccaactctcttgttgttagttgggactatgtgattcattttggtagatggggtgttaatgaaagcaacatgtgtcaattccagagtattgcatggaagattgggtatgaaaacagtgatcatgtaggccacatattgaggtgatagaacctcaagctaaacatagcctagagtaccaactcaccacatcaatgacagctcccctacagaataacttccctcccaccaaactttgcataagtagtaaataacttttttctcttaaaggtattgatagcttaggactagtttttaccatgaaaagtccattttaacatgattaaaaatatattgcttcttcaatatatttttatcacagcagctagagtgattctgttaaatcttcaaaactctgcagtagctttccccctcacttagagtaaatgctgaagttattttgatctgtgagaatttacatgatctaactcctccagtatattatttttatgacttcatctattcttcccctcttctttccctctgctataaatacactgaccttctggctgtgcttgaacacttcagacccataactaagacctttgcctttaccattctctctttcagggatgctgttcctacagatatctgcatgcttagctccctgactttcttcagatgcttacatatgactttctcattaaattcttcattgtcagtcaacaccatctctgcctcctctattctcttcccatactggcaaaggaaacaaaaacaacaataacaacaacaacaacaaaaaacctgaacactagatttttcagtgttttggttgtcactgtgtaataagccatccaattacttagtaacttaaaacaaacatcatcaaagtcttttcttttttcccaaggtagaattcatgtcttcatcccatttgttattgtagaacttttcacctctgttataaaattatcataaatatattttattataaataattatgtacataatttcattattactaataagctccttgaagacaggaatttctatattcgtctgtatatcttccaagcattaacatagtaccttacaaatagattaatgatcattgaatgttaaaatatatattagtgaatatttgacatatgttttaaaacatttatcagtgaataaattaatgttattatcaagaaaataaaaaacactgctgacaaccagggattacatattcagtggtttgcatgatgactttaggaaacctgtctaaagatttctatgcaaaatgatcagaaagttaaaatgtcaatattatttttgttatttattgatagattagattatgtgtggatctcacacatagttatttgtagacttagtctctgcctttaaataacaaatgaacagaggcaggatttatgtgaacttttggctattgcaggggtaattagccttttcttatggggtatagcttgcttatgtcttctgttctgggatggaatctagagaagatagggaaatagcacccgaaaaatattcctgttctaaaatactttcttaactccatttacaatttggaatccatttggatggcacattttttttaatgtatgcaacctggaaggctatttttcttaatataaacctatacatttaagtattagttgatatggtttgtctgtgtcctcacccaaatctcatcttgaattgtaactcccacaattcccacattttgtgagaggaacccggtgggaggtaaaggaatcatggaggcgagtctttcccatgctgttcttgtgatagtgaataagtctcatgagatctgatggtttttaaaaaagtttccctgcactagcactctcgctttggctactgctattcatgtaagatgtgacctgctccttgctttccactatgattgtggagcctccccagctatgtggaactgtaagtccattaaacctctttttcttcccagtatcaggtatgtctttatcagcagcatgaaaacagactaatacattagtcaatcaaaaaattaaaatgtactaaacatttcagaagatgcctagagaaaatgtttcacctgataaatggtactgtcataagtagttgtttttctgtaatgtgacaatgctagattatcttctcttacgtaaaaacgtcagaaaatacagctggtaccaaaaaattggaaaaagaaagacaaattaatagaaaaatgtgtttaaagaatataaacaggtgattttacaaaaaggaaacctgaatggcccattaacatatggaaaggtgtttaaccttactattggtaatgggaatgccaattagaccccacaagaatataccaattctcagttctcaaactggaaaacattatacatagctataaaatttaatgtaggtgtgtgcatgagggcaaatgtttgtcacaggcatttagaaaagtaaatcttcatatttatttggataaatgttaccatactttttgatccagtaattctgcttttcaaatctatcttatagaaataaaagcatctacatacagatgctgaaaggttgaattagctggacctaatggggctaccaaaagaaaatcagaaaacaaaacaaactattttacaatttcaacatgctttattggatctcccttctctgcagtcacccttagcattcctatttattttgattttaaaaacaatctattatttataattaagattcactttcagttcagtttttaatactaatctcacttctaaatatacacccttctctaagctcagggaacctatggtggggaaggtgacgtagtcttttctttcattttcttcatctctttttctttctgctttagaatccactgggaaaagtagttctctctttgctgttgatgtcctatcaaggcaggcaaccaaatatatgggtcaccttagttgtccttttgagggccctgcagcatttatgccatatagtctcatgatatcagtaatatacttgctggttgacctcttacgattcttcttcagttcctgcctctaacccctctgagtcattcaccccaacagataaacctcttgggtatggccctatacacatagagtccagctaccacctacagtgatttgctggtctagatgtcaattattttccaggaaatctcaaacttcttaggactaacttacaagtggcctgaacaaaatgacaatttttccctcacttaactctctaagtacctctgatctcccccttattcagtcacaagagagggatgctcctgactcatatcaaaaccaaggtattaaaattaaactttaataaaatatactaaaagctatagtggtgtaaaagtatgaaatgatttcttttgtcaattaactccagtgacagcattgaaaaactttgttctgtaaaaattacaaactgtcagaaattttgctttttgaaattatgttagtgagacaggaacaccccactattgcctgaagagctaagctatgtgggtactttgacacagagaagcagcctcaattttccacccaggtgcaaagcttcagataatgtttttcagatacaagattccacagtcatcttaactttgtagatttcaaggaaacagaaccctatacccacttcttagtccaggctttatgctaatacagccaggctattctttcagcctatcaaagaactgttcatttaaattttatttaaaccccaccttactcttaaatgaatcagaatgctggctcttccttcatctgttttggcaaaatgccccatcaattgtgtagtctttttttactgctgcaaaatgataaacttacctttgtcagaccatagatgtgtcatagtctggtggtctttgagcaatttattagtcatgcctgaataacattttctgtgcccaacactctcaaaggtattaaaaagacatatatcacagtagatgaaaaccagtatgtaactgagttgttatagggctgaaagctgcttaagaaagtagagaaaagaaataaaataaagcagagcctaatttttatctccggaatcctttaagtccctccatttagttgactctttatgtttcacccttacattcaccttatgctacatggaagctaaactatactttcttaaagacacccacatatttttgtctttctatactcaaatatgctgcataggccacacccctaatgattttcttgattctcatctaaatgtgacctttcatttgattttcagaaaactctttggcttgttatgacacatacaatttcccttttattataattattggaaaatgtgatttggttgacttttagatttcatcatatgtcttcatcattttctcttacctggaatgttccaatagcctcttgattagtttcctcgcttctattctaggcactctacagtgtattttcctcacactaactcatgtgatttttaaaaacataaattacatcagattactttcctgtttgcaaccttttattggcttcccatcacagttggaataagacctacagtctttctcttgtcatataaagcccttcttggtacttctatcatcttatgtcctacttctctgcttcatgagcaccccccattagtcattcttgcagcagtgggagtgggggtataaaataaaaaaccgaatcttttcaaatgtcctttatctctctaacattcctcttccagatgctcatatccctcatgtttactcagtttttattcagatgtgctttcctcagagaggactttcatgccatctctggaaatagcatttctcctcacctaaccaacactaataacttaaccttgccttattaatttcttgtaaaataacagccccaaaatatatactaatgtgtgtgtgtgtgtgcacgtgcatttgtttgttagaagctctatgaggtaagagtttttgtcatgtttgctactttgttcacctgccaaaagtagtacctggcacgttataggtatgcaataagtagttgttgaatgagtgaataaacagatgaataaatgaatgaatgaaagttttccaatcatgtatttaccttgcttgtgtttgccacactattacacttttagttttatattcagaagtggctaaatcatagacttgagaggcaaaatatctgagatttatatacctgctctgttatgtgacctaggagaagttacttaatctgtctttttcaatgttcaaatatataatagagataatgatatgtatatctcataggcttatgagtattacattaattaatgtggcacagagtgctgtagaagttgttatatttgttattttaacatttaattggtgattatttgaataatatctgtcttcttcgttcaacttttgggagccatattaatttttatccatcactttatcttcaagccacagtttgtaatgtgtactctataaatattctttgaacttttttataaaaagctggtttcagttttgagatcatgcatgcatgtatgtttgagtgcactgggcctattttcatattctgtaattaccagtcattgtcactagatggcaagtttgtcccagccaaggcaaaatgttttaagaccagaaactgaagagtagccctaaataggggaaaatgtcatgtatgtgtttttgtagactggtaggatgataaacatttacttatcaataataattttccatattttattctttttttcatttcattaggtactctaccttcctggggagctcttttgtatagtgatgcattttagcattactgtcatgccattgaccctttgttagtatattcacacgtttctatttaaaaagcaatgtttaaaaaggtctcttaatgtattctttatcaacagatgtttcccaagtctttcaaaatcataccttttacctgctggttccaaatatgttttgattttgtctaagacataagctaccctttttgagcaagaactttgtctttttttctgattactagccaccctatatcaatgtgaagtatatgtcccttttgattattttaaactctcaatgtaccatcttggaaaaagaaactgttaggctcaatgctattgtacctgtccagcttcacctatgtttagcaaaattatcaaaaggctcctggtgtaaaggaacaaaaaagagtgttaaggaacctacaaattagataatcaatctgtaaatgatcatcttattgaattattacaattatcttcataaatataaatttcttagaattggttaaatgtatatatatgctttggcaagttaaatttaccaaaatacattaaaattgtgggcatgtaaacaaatataaataatagtacctttaatatggtgctgattgtttttagtacagcaatatttagaaagaatcattattttcttttaggaagttagctactgaataaaatagacctaaaaattaactattttttgatatcctttttttctgtgccttgatgcgtcatattataggttaaaagaaagaaatgtggttacttttcttacaactgctaaaatactttttccctcttttcctcttgtcttagtccatttggactggtataacaaaataccatgaactagtagctaataaacaacagaaatttatttctcacagttctggagccttagaagtccaagattgaggcacaagcagactcagtgtctgctgagttccaccatttcctgattcaaagatgatgccttctcactatgtcatcacatggtaggagggtcaaggcagctctctagggcctctttcataagaccattaatccactcatgacttaatcaccacaccaaaggccacatctcccaatattatctatcaccttgggaggtaagatttcaacataagaattttgggcagaatacaaacattcatactttagtatgtcttcttattatgaaaaatgactatcttggctgtgcgggccctttttttggttccatatgaaatttaagtggttttttttctaattctgtgaagaaagtcaatggtagcttgatgggaatagcattgaatctataaattactttgggcagtatggccattttcactatattgactcttcctatccaggaacatggaattattttccatttgtttgtgtcctctcttatttccttgagcagtggtttgtatttctccttgaacaggtccttcatgtcccttgtaagttgtattcccaggtattgtattctctttgtagtaattaggaatgggtgttcactcatgatttggccctctgcttgtctattattgttgtataggaatgcttgtgattttttcacattgattttgtatcctgagactttgctgaagttgcttatcagcttaaggaggttttaggctgagtttttttttttttttttttttttttttttgacagaatcttgctctgttgcccaggctggagtgcagtggcatgatctcggctcactgcaacctccacctcccaggttcaagcgattttcctgcctcagtcttctgagtagctgggactacaggcacgtgccaccatgcctggctaattttttgtgtttttagtagagacggggtttcaccatattagccaggatggtctcgatctcctgacctcgtgatctacctacctaagcctccgaaagtgctgggattacaggcgtgagctacggcgcccagccaacgatgaggttttctaaatatataattttgtcgtctgcaaacagagacaatttgacttcctctcttcctatttgaatactctttatttctttctgtttcctgattgccctggacagaacttccaatacgatgttgaataggagtggtgagagagggcatcctagccttgtgccggttttcaaagcgaatgattctggcttttgttcattcagtatgatattggctatgggtttgtcataaatagctcttactattttgagatatgttccatcaatacctggtttattgagagtttttagcatgatacagtgttgacttttatcaaaggccttttctgcatctattgagataatcatgtgttttttgtcattggttctgtttatgtgatggattacgtttattgatttgcatatgttgaaccaggcttcaatcccagggatgaagccaacttgattgtggtggataagtttttgatgtgctgctggattcggtctgccagtattttattgaggattttcgcatccatgttcatcatgaatattgtcctgaaattttctttttttgttgtgtctctgtcaggttttgatatcaggatgatgctggcctcataaaatgggttagggaggggtccctcttttactattgtttggaatagtttcagaaggaatggtaccagctcctctttgtacctctggtagaatttgactgtgaatctgtctggtcctgggattttttggttggtaggctattcgttactgcatcaatttcagaagctgttattggtctattcagggatttgacttcttcctggtttagtcttgggagggtgtatttgtccaggaatttatccatttcttctagactttctagttttatttgcatagaggtgtttacggtattctctgattgtagtttgtatttctgtgggatcagtggtggtatctcctttatcattttttattgtgtctattttatccttctgtcttttcttctttattagtcttgctagcggtctattttgttaatcttttcaagaaaccaactcctggattcaatgatttttttgaagggtttttgtgtctctatctccttcagttctgctctgatcttagttattacttgttttcttctagcttttgtatgtgtatgctcttgcttctctagttcctttaattgtgatgttagggcattgattttagatccttcccattttctgatgtgggcatttagtgctataaatttccctcttaacgctgctttagctgtgtcccagagattctggtatgttgtctctttgttctcattggtttcaaagaacttctttatttttgccttcattttgttatttacccagtagtcattcaggagcaggttgttcactttccatgtagttgtgcgattttgagtgaatttcttaatcctgagttctaatttgattgcactgtggtctgagagactgttatgattcctattattttgcatttgctgaggagtgttttactttcaattataggtcaattttagaataagtgctatgttgtgctgagaagaatgtatattctgttgatctggaatggagaactctgtagatgcctattaggcccattggtccagagctgagttcagccctgaatatccttgtcaatattctgtcttgatctgcctaatattgacagtgtaatgttaaactctccaactattattgtgcgggagtctaagtctctttgtaggtctctaagaacttattttatgaatctgggtactcttgtattgggtgcatatatttttagaatagttagctattcttattgcattgatccctgtgctacaaagctgtaggcatcatgctacctgacttcaaactatgttacaaggccacagttaccaaaacagcatggtactggtaccaaaatagatatatacaccaatggaacagaacagaggcctcagaaataacaccacacatctacaaccatctgatcttcagcaaacctgacaaaaacaagcaatggagaaaggattccctgtttaataaatggtgctgggaaaactggctagccatatgcagaaaacagaaactggaccccttctttacatcttatacaaaaattaactcaagttggattaaagacttaaaggtaaaacctgaaaacataaaagccctagaggaaaacctaggctataccattcaggacataggcatgggcaaagacttcatgactaaaacaccaaaagcaatggcaacaaaagctaaaattgacaaataggatctaattacactaacgagcttctgcacaacaaaagaaactataatcagagtgaacaggcaacctacagaatgggaagaaaatttcacgatctatccacctaacaaaagtctaatatctagaatctacaaggaacttaaatttacaagaaaaaaaaaaaaaaccatcaaaaagtgggtgaatgatatgaacagacacttctcaaaagaagacatttatgtggccaagaaactatgaaaagaaactcatcatcactggtcattagagaaatgcaaatcaaaactacaatgagataccatctcacaccagttagaatggtgatcattaaaaagtcaggaaacaacagatgctggcgacgatgtggagaaataggaacacgtttacactgttgttgtgagtgtaaactagttcaatcattaagacagtgtggcaattcctcaaggatatagaaccagaaataccatttgacctagcaatcccattgctgggtatataacccaaggattgtaaatcattctactataaggacacatgtacatgtatgcttattgcagcactatttacaatagcaaagacttggaaccaacccaaatgcccatcaatgatagactggataaagaaaatgtggcacatatacaccatgggatactatgtagccataaaaaataatgagttcatgtcctttgtgggaacatgattcaagctgaaaaccatcattctcagcaaactaacaggtatagaaaaccaaacactgcatgttctcactcataagtgggagttgaacaatgagaacacatggacacagggaggggaacatgacacactggggcctgtcgaggggtgggaggcaagggaggaagagcattaggacaaatacctaatgcatgtggggtttaaaacctagatgacaggttgataggtacagcaaaccaccatggcacgtatatacctagttaacaaacctgcacattctggacatgtatcccagaacttaaagtaaaaatttttaagtgattatctgttactttattctactttttaagaatgtcttaaaatgaatattaatttattctggcattgatttttttccaagtcaacccaaacatagctgagatgctaccattagcaatgtagggattcaaacatactgatagtctctctcaggttaattgattcaatgtaaaagtaaacattcattgacagtgatttcctgtattacggaagacttgtatgagacttgcattgacttctacttcctctttatttttcctaccccatttccaacttccctttcaaatctgactcataaatttattttatatccaacttgagaagatattaatgacataatctaatataatgagaaggcattatccaagtacatttttcaactatatactatcctacaaatctctgagattttgtcactgtctcactttttaaataatgattataacttagttgaaattatacattactgttatcaaaagataatatgtagttattgttgaaactatactgattcacaaaagaaaaaaatgtaaccctaacaactattgataatcttctaacaacttagtataattccttctactcctttctcttcctgtattattaatatgtatttataaaaattgaactcagtattaccattcatattggtttgtaatggttagcaatgtttagttaacttttttgtgtgattatacattgttctgcaaatcatgttttgtaggattctgacactgcctaacactgtgcatctacgtatctgtacctcctgtgacattatattgttgtatctacctatgggtttatacttcttcagaagtaatctaaatttctcttctgtatgatttcagaaggcttagtctgcaaaatggtcttcacttcaaatgtcaccaagttacccccaaatgcttgtatgtcctacaaatttgtatgggttgctgattaccatcttagttccctacttttcttgctttacattcccctcctctgccactttttgatgggtgtggcaatcgtgtttcaaatatggatgtaggttcattccttaattttctctctccgttacctcagcctttaacaataatgtattaaagacggggaataatagaagaaagtttcaatatatttttaagaagaaagcttgaaactagagatgaatactcccagagtttatagttaagtcctctttggtgttatatgggtaccctattggccccttctctctttagtttctgcttatagaattcacttcttatttaaaaaggaatgcctttgagaaagtttattttcctagatgttcaagtctcaattccaaatccttactttccatcatgaatctcctcccttccaagatgactgacagttggagttccaacaccctttggaaacaccttgactcctattaatatgaataggtcttgttctagaaagcaccatcagggaatatccaacagggtgtacccactaggacacagtatcgttctacactggtaaatttcccaatgtagaagaataccctgtgagggaattagagctgaataatccaggttgggttccaacaacctcagtcctgctcctaaagaatctctccatttgcttaagctcaaattttaccttctcacctttatctagtatcttgttttgatttattcctgtgtgtaactctttcaataaggataggcagacaaaggagacagatatcctatctctgcaaaatgaatacttttcggagacattgtcttaatctaagtttagctaagatctattcttataaaagaagcaagcaacattaatgcaacttctctcacagtaaagaaattattcacaacattatacaaaataggtaactcttcatctttttacattttttaatcccaaattaggatctttgctttactttttttaaccgaaggctcattaaattatttctacattcagaaaataatgaaaaaacaccccacaaacttaaagctttcttctgcttctgtcaagatttaaaaagttttaactacttttggatagcaagttttaaataatcttagctagattatttattgtatttaattaagtcagagaatagctattccttaagaacaaaaacagtatcttacactattcttggtaatggttatggcatacttaaccaatagaaggctagcatctagtcaatatttgctaaataaaagattttggtcagtacagttattcagtaacaccacagttacctaaaattaaacaaactagcagcttatcctgtataaaatacaacctagcaagaaaaagaaataattggcaaaagtctctgagcagtgcaaataaatgtaaaaaaaaaaaaagtaatgcaataaagcttatcctatgtatgtagaacttctccctatcttaccatttctcaaacacaaagtttgaactgggttacctcaccctatttcaaggctaaactcatattggcttgaagtaatcatgatctggtagtgagcaggactgctgatccaatcaaagtacacttcagggcttctgtggtgaaaatgccaaaacagatcctctcttcaacactggacttgaaatgaccagtatcttgaaagtagcaggacattttgctaaaggagagaagatggcctaagatcagggtctctgaagggagtagagcctggaaatttattctggtcaagttcactttctgtcctgggaataactctacccatatgatagccagtgtcttttttttttttttctgtcatccaactttgttgagtttcctatcacttgcaatcaaaagaatccttactgattgatttatttagaggtgacttcattagttctttatttaaattcatatctttagtttatgaacagttctaaaaaccgcttttttgtggatttcaagcaaacactagaaatagaaatttgaaggagaatgatgggcaggcccattttcattagtaagccattcagtcagtcagtgtttgttaaacatatgaggctggaagattcatgaaggcattggaacatgtcttccttatatatgtctttgtcctcatccttaaaaaaggtcttgcacattgtacctgctcaattaatatttactgaataaatgagtaaaacaattataatctagtataagaatttaggtttataatttagtataaaaatcaggattgtttaaaatatttgataattaaagaaaaacagataattgtgtatggttaatacatgaagctacagatagtataaatgggtaagaaaaaactcttattattagtttgtgatcctaagagtttactttattcctctaaacctcatctgcaaaatgtaagtaatataaaagtgagctaatgaagttctgtgagaatgttaatgaaataatatatgtgaagtgccccattagagttcagtatatattagctactattgttgtaatgaataaatcaactttgccttaatgtaataatgcttggttgttactgtgttgttataacttttaaatttttattgaaaactaaatttcatagttaaatttgacactaagtatattcagtcatgtttggttttacatattcattattatgaagtaatcatgtcagattttcacatcaaatgtttcaatttaagaatattgctgtcagatgcttttatagaatgcctaacaacaacaatgttgaaaatcttcattgacttgtccaactacttttttatagaaaatactatttattagaaaagaaacagaactagagctaattagcactacagtcataaggatcaagaacattttaataaaagaataagacaacaaattattgaaagtcttcaactagagctaattagaaccacagtcattagaatcaagaacattttaataaaagaagaataagacaacaaattattgaaagtcttcacttctgctaagtaaaaatcaaagagagcctgaaaatcatctcattaggtcttttccaattagaaaattctaaataaccacagagttagtacaaaagataatgaaacaaaaaaacaatttgcatcttaacttaccttgtccaagtgtgctttaagtgtattcatttgtcgcattttttctttcatgttaaaattacctatcagaaaaataaatattcaagaatcaagtactacttttgtccactgttacctgctatcttaatttcttttctcttgcgttcttacactgttatagatacatcatatatctacctcactggtttggagtatataagatttatatatatatatatctcacatttacatatacatatgaatatacacaggcatgcatacaagttgagtatctcttatctgaaacgttcgaggccagaagtgtttcagattttagatattttctgatttgggaatatttctatatgcataatgaagcctcttggggatgggaccaaagtttaagtataacatttatttatgtttcatatacactttatacatatacctgagagcaattttatacaatatttttaatagttttgtgcataaaacaaagtctgtatacactgagccatcagaaaacaaaggtgtcactgtctcagtcacccatgtggacaatctgtggttggttgccatcaccatcatccttgactctgaattcatatgctaccaataaacaattattttcttacacttacttgcacatagatacttaatagtcaaaaataaaggcataccattaatacagtaagaaaaaaagtaatgtattcagggtaactaaggagcacagtagcatcagcagaattcctgtatcagctattaaacaacagcaacaacaaacaactgcaggctttcagtctctacctacaattctgcattttgattaataggttactgtacatggtatttttttaagttgagaagaagtattagaagcagatgagagaccaagaagtgagtcttttggattagggctttttcttcagacacatctgcctcattaacaatgttttttgctttagaaatcccttttttattttataaacttacatcatgtcttgttctgttatgattgtatgcttctctagtccttcagcaagcccatatacattttcatcatgatgtctgtaggcactttttctgtagagttaacaaccttatcttcattgttactattatcatgatcaccttgattcagaatcgttttggctacttcaccatcagtcaatcaataaacaattggagctgcattatcagtgttcaaaatatcttcaaaatccacttcttccagcttactgtcagactctgatgctattttttttgtgtgtatgtaaggaagttagattttctttttcaattgacatggaaatacttcaaagtcaccacctagttcatggtcatcattgaacatagtcacaggccagaggttgtgccaggcatgcacagctatgtctttagttactattttcaaagcattggcaacagaatataagacatccttcatgctaaagcctatcaaaaacttttccagccctctgttcactgctgctagcatgctgttcacgaaagggcttttgcatttactgttcattgatctacgtagaccctggtgtcatggctgaattaatgaagtcacgtttgaaagaaaatacatgaacattatttctgatgaaaattttagctgcaggatgagcagaataattgtcaaggcatagcaaaatcttgcagttgccatttaatccagcatccctacagtgagcatgagccactattacaaaatgtttgtgaaaccagtcagaaaagatatttctgttatctatgcatttttgttagcataataatggactggtaagaaattcactccttgaaaacagtgaggacaaaagcttttgcctatcacagcaagtctacatgtatgcacatctgctgcattagcacatcctagcagtacttctgtctttggcatccttaatttttgtaggggccatctcatcatttgtagccgctatctttctggggtaataatgttaaaacagggatgtttcatgagcattttggacatgttctggcattagattttcatcagcagagaccttggcaaacttgtcaatgaattgaatttctttgctgttttgtgatcaacagataactttatatctagaaatctttaaaaacttaatgtcatgtcttttcttaaatttattcaaccagcctgttgaatattcacagttctcttcaattttcaggtaatcataacaaatttttgcttgtttcttgatcagcataccattaagtggcctgtgttcactgtgacgctgacagatgcactgtttcaatacacaactgaaatcttcattttttagctttatgcagtgcttttctgttttttattagctgctgttcactactttcagcacataacttcaaacatttattgttttatctcttcaggtcatatatggttgtccttccaataccatactcttctgtaagataattcacacttacagcgctgtctgatttctctaacagcttgactttctgtgctatagagaaacataaatgcttcccctttttttagtcactgccaccaatgtggatatccacaggtctttttgacattttaatagtattttcacttagacgagaattaaaaaatataaaaaagatcacagtgaataatgcttgtaagtcttggccccacgtggagcatcatgggaacctgctgttggcacctcccattttattactctttgtgggcatgcatgcataaggaaatctgggcatgcacagaaaagatatatcctggctgaagggagttgggagggtattttctcccttggggatgctgaataaactttgtaaagtgtgcctgtgttttgactgtaacatgtcacatgaggtcaagtgtgaagttttttacttgtggcctcatgtcggcgttcaaaagttttgatttgtggaccatttgggattttgaatttttgaattagggatgttcaacctgtgtatacatgacacacacatatacatatatgtatatacatatgcatatatactggaaatgtaaataaatagagcaatatttatagaaaattaggtttttggtgattttttcacttgtgtggtagattgaattatttgctttaacccctctctgaaatcatttgccatgtaaccttttaattccacccatacacacacaaaaatactcttccttcattaccctttgatgttgagttcaatcatgtgacttgctttagctagtaagattttagaagataagacacaatgtgtttttgtgaattcagccttaccctccagctctttgccatcaccatgagaataataatcctggccagctattggctccagaagaagaatgagaaatgtatggagccgacccatcccagcaaaaattacagacattttaaaaacatatctttcagaaaaccttctggattttctttctttttttctaggctggaatagatgcctctttcatatctttgtaattgttatctccatagctttatcactgagtttaccacaatgtactaagattgctttttactttgtcataatctttcaccagactgacttctatagagctggacatatctcaaaaattttggaaaagatatctgtgccttgataccatagtagccaaataagtatcaaataaattacttaatttacagtactaagtctaatatgcaaagtgaaattacattcacattgaaatgattcaataagatcttatagtcaattgactgacttgtcccagtttttacttccttataatagtaacatatgtctacacctttgtcatgtgtcaaggtagaggaggtatttcagctcttaattttggacttggacgtacgccttgcaatggcctatggactattagcaaacatgacacaagtaaaagcctgaaaataatgtagcagttgagcctaccctcgggcttattattttcatgtgcaaaacatgtcctgggtagcccattagtcccattcgtccaagaaaaacaaaccaagagaacttggatctaacctgtaatttggagccaagctcagcctaaatcagccagcctctagtaagcacacacatttatgagggagaatcaatggtagttattttttgcctctcagttgcagggtggtttgttacaagaacgattgtggcaagaactgatacttatctatgaagagattttttattcatgtaactaatgaataaatcacagtttattttgtatccaaagagaaattttctagtgcttgcaaattgtcataatcaaaatgaatccagaatgctttattcacagagttaaattaaatcaccatcaccatattaacagatggatggccataattttaattaattttaactgataacattacctacttcttcctctaaatatttatatacgtatacattcacacatacacatacatacatgtatatatctacataattattaaactaaggtttagatatgtggtcaatactgctgcatatgtatgtcccatcttctcttttctccatttttcacatagttcctcacaaggccatctggactaaagaagagggtttgtagtttcccttcaagctaagtgaatttgtgtactggacaacaggatgtcagaagacataatctctgccacttgtatgtaataccttaaaggaaaggaaaatgctgcttcttcctcttttacccttttactattagctagaatttggataggtggtggtaagccatttaagaatcgagatgagcaaaacactaggtaaaagaaggctgactgattactttgtatagcacagctaccatattaccttgggcctttaactcgtgagaataaatgtctgccttgtttaagccattgctaatactgtatataaaatgtatgtaataaaaatgcaaggtatatatcctgttcatttgaattactctaattaggtggcctaattttttaattaaatatttttagaaattataaaattaacgtgtgttaatgcacttgttcattgagtaaaaaatataaattttactgtctgaattctcctctctaggaattgtcatgaatttggtactattattgccttgccagactaggctagttgtctttaccctactcccaactgtgtaaggcattatatgtcaaatatttgtcaccaaagccagtggtggcaagcaattcaaaggtttttcactctcaggcataggctaactgagtttggagaccacaaatgagaagaagggagaggaggagaggaaaggagagaataggggaggggagaagacggaagaaatgtatgatagaatactatctgctgcatttttgagggctgatggtgaactaatattgtgtgtcttttcctagtaggagtgggcattggagattgaagctgagatcaatggcagacagggcagcatggcttgcacatgatttatctgttcggcatagcagaagtgattgaaacagggatgggtacttgacaattgtttttgcttgtttttttctggtagtgacttatttcactcagctctttctcatatgtggatataattctacttcaaattttgaagttgcactaaaattggttacatttaaggagggttgtagaggctgggccacatagcctaaatatatgatcaaaccttattccagatgcttttgtgagagtgtttctgcataatagcaacgtttaaatctgtggattttgagtaaagcagattgccctttgtaatgtacatgggccttattcaatcagttgaaggcctgaacagaatgttgatctacaacacacacacaccacgcacacactctcacacacacacaaacatatacatatcttattggttctccttctctggagaaccttgatatatagggggcataccaaagttactaaatatgaaatatgttcatatgcattttctagaagaaacttatattctacataaaagtaaagtgatgattgtgatgaaaatgataattgctactagatacttagattataattcactttaagaattcacagtgttatattgtcattaacttagtaccttccatctatcctggctcttatgtgttatttattaatttatcacacaaagctattgtgtatagtgaactagttgaaccataaataaaacagtttaccataacaagtaaacaggaatgtttacccagtaagttttaccttcagttttgtctgcaaccagtggaaaatgctgtcttgtattaatgaatagattcagtgaggctagccaaagcacctgccaaaacacctttaaaatgtttcttttaaggaagttaaaaaaattcgtgttcaaaatgttaactcaaagtattcagggaacaagcacataccttgtgttaaccagtatttatatgaagtgggagttcaaattactgaggcttaattttgtgaaggtagctggaacatataaataactttggggtaaggtgtttggataaggcactactcaagtaaagaccttctttctttctttcctttttttttttttttttttttttacttaatgaagtatctttctaagtttccttttagaaagatgctttctaaaagggtgtggatgcttttctaatataccatggataacaggaaatgacaacaataatgatagcagatacttataaatgtgtgggtcaaaaatgaatattcttcgagttttaggtggaagcttactcaagatgagatactccatgaaaatcttttcccaaatatttgggtcttccatattgatacccatccttaccacctgtctcacagggaaagatgacttaggtaaatacctttcttatgctttaaattccatccactcccatttcatcaaggatattgtttcacagattaccattattttttcttggcttcattttctcgctctttgctgtctccttctcttcaaaaaataaatgcatgtattcaatttctcctgtattgaaaatatctcccttagttctgtgtaccccagctacactcatgtcttcacctcccaaccaccctttttgtcagggctgtacaggtttgctctctccaagaatttatttagtcatccagaaatatttctaagccaagccttagggattggtctttgtatacattataaaatttaattcttaagtgtctgacaaaatacatgtagatatttcctattcctaatttatagatgtgaaaactgagactgagagaggctgaaggatatgctgaaggcaactggaatccaaagcctgcccactagaatgtggatattgtcatcctcgcctaaaatgttcaactggtgctcattgattgggtgcctactgtgttactatgtatcaggcactatcaagctttctgcccattttttttaagtctttatgacattccctgtgaaacgggtactctcattagtcaactctgta

SEQ ID NO: 5687 - DNA, 1913 bp, Homo sapiens
cagaataccaaacacacctttattcaagtggaagtacaaaagcacattcctaaaccaaacgcatacatgtgatttttacatattctgctttttagggattacataatcctgtttcagtcaccatacgtgactactggtctctatacataagggtatacatgtttgacaggaaaaaacacatgcatttttcatttgcttttacatttagatcaattcatttatatatcaatttcatttagattcctaccttgccttgatgaaatcctactcttgctgatggcaaagaagtaaaatatagtggcagaactatcctagaggttagccataggaggattatagagtgagcaacatatttttatatatttgttgagggtccctactgaatattataacactgaactatgaaagcctcaattgctggactgacaacaagaattttaaataacatttgtcttactcacaaaatgttataaagcttaagatggaaaaatacaaaatgttttgacattacctaaagaatcatgaactcttgttaggtatatgatggtggccctgaacttgagccaacatctgtaatcacttttatcagtcaaaaagccatgttcttttatatagcctgtagactattaaaatacaaaaatgtggtaatggataaacaactatacacaaagccctcacacttcaaatactgtcctggattgatgagagaggagcagaattcaaacatttatctgcaatcctaatggttaaaattttaccaggaacagacctgccactctcttgaaatactgtctctgagattaacatacgaacagcatcatctctgttggaaggctacattcccttatgatgctgatttgtgtgtgtgtgtgtgtgtgtatggttttttgtttttgtttttttgtgtttttttgagagagagtcctgctctgtcgcccaggctggagtgcagtggtgcaatctcggctcactgcaacctccgcctcccaggttcaagcagttctcctgcctcagcctcctgagtagctgggattacaggcgcgtgccaccacacccggctaacttttgtatttttagtagagacggggtttcaccatgttggccaggatggtctcgactgcctgacctcgtgatccatccgcctcagcctcccaaagtgctgggattacaggtgtgaggctattaggagtcttgttggctccctgatgtccttatcatgtcttcttcgcagactgtggatgcacacaagacagctaaaaccttgggcatcatttgaaaatgtttggctgcctgctacaatctcaggagagagaatccttcatacttatattggactggatatattgtcaatcaaattcttttttaaaaaaagatgcttcactttaggaaataagacaccagaccagcaacatcaagtaggtatggaatacttgctggtgaaacacttaaaactaggaaacttctaaatcttctaaaggtgcttaagagaatggagaagttaatcaacaggaatccaagtgttgtggctgtaaagcaatacgacataagatccctagtaaagagcaggcctaagagttggttttggaaagaacttgggccaagaacagcagaaaaagctaaatgagctacttacgtcgatgtgttttaatactggtgcattagcagtatcttatggaagttgtgaacactaagaaccaatttcaaaaaatataaaaatgtttatagggcatattaaaataaaaacagcttaaatgagttctataaataaaataggcccagcacagtgacacacgcctgtaaccccagcactttgggaggacaggtgggaggatcgcttgaggccaggagttcaagaccagcctgggcaacaaagcaagaccccatctctgttctttttaatatcaaaattataa

SEQ ID NO: 5688 - DNA, 1716 bp, Homo sapiens
aggggagcaagggttgaaaaactgttgggtactgtgctcactacctggttgacaggatcacttgtactccaaacctcagcatcatgcaatatatatctagttaataaacctgcacatgtaccatctaaaagtaaaaagaagcaaatttaaaaaaaaaaaaacaaaaaaacagacccctccccaccagtctcctggttctttttgaaggtggctgtggtcagactattccagcaggttcctcagtgcttcatgctgttcatcaaacctggatccatctggacctaccatttatgtcatttattgttataaaaaataatacatattctcttgacaccttataattagagttcatttaagtcctttttatcaactccattagagtacttgtctggtgtcgagagttttggtagttccagtatatgtgcttgttttgtttcttccactggatctcaagaaggaacaaattattttggtgtcttatagaacaaattcagattgtactagattagaaggaatttattttgatgttattttggagaaaagacttacttgggacttgggtggaagtggagttcatatggatggttttgttttgaataatttctaaggtcttttagctctatcatttcttgtcagtctcccaccgctaaaatataactctatttacttcgttttttcacacagaaagattatagtgacatagtcttcctcttacttaaatacatgtctttttaggattctgccatagtattgattctgccatggcatttattatgcccagtgaccaaggcattagaatatttgtggtacctttacctttttaggccaataaatatcattcatttgctaaagaacatttcattaaacgaggtacagttggctctccatatccatgggtttggcatctggattcaaccaaccgtgaattgaaaatattcaggaagaaatttcacagagttccaaaaaaacctggaatttgtggcatgctgagtactacattgaatctacacagatgaagtgatgtgtaggcattctgttaggtattataagtaatctagggatgatttaaagtatacaggacaatgcgagtgggttatatgcaaatactacattattttatataagagacttgagcatgttgggttttgttatcttttgggggatcctagaactaatcccccatggatactgtgggatgactgtacttattttttagaaataatttctacactatagccccttttttactcccagtttctttcatttttttttttttaggcttcctaaaatattggcagaagctccatcctttctctgtgctttgttccaatgtttttagcatgtttcagcttgttctacatccctgggatatataataagacctagcctaaatgtaagcttgatagttcagggactatcttaagtgttatgttaactttttttcttttaagggagggagaacaaattctaatactagttaatagtgtcttacccacagtgtgttatctaatgcctttcaaactaggggaaaaaaatcagtgaacattatggtagatgctaaaatctgccattttcttgtatatttctgacagtttcagttactttgcatttgtattatacaatgactaacatcagccttttaccattctttcctctggtatttttcagtaacaaatagtgaatgtatttagagataaaaataattttgtgaccaaa

SEQ ID NO: 5689 - DNA, 9011 bp, Homo sapiens
gtcacggggcgcgcgctgatgcgaacggggtgacagatgggaacgcctccgagaccgccagcgacgaccccgctcgggcagccccggatttcctcggctgcaccggcgccggcagcggggaccgaggcccgcgtccgttcgggtcgggccggggcttagccccgcgccccacgggcggccgggaccccacccggaccccgccgcggttctgggccgccggagcctcgcgccgcctctcggggaccttgtcccctggcctccggcctctcgggcccctcgcctgccgtctaggagggaaggggccttggatctgtgccccgcccatggaacagcgcccgggctcggagaggccccgcgaggccgcaggcgcagaccctcccggagggctgggcgggcaccggggtcttcggctggcttgagggacccgacccctgggggaggaatttggggtctgtgtgtccgaatgaacgcgggggttcagatgagtctgtggtgcccccgctttccatctcctccggccccggccccagaggactgtctgagaggccggtggccgcggatcctggacgcgcctccctcctgcctgtggtttccctttattccggcagcggcgcgagcccacccttcacatacaggagctacatccagaagcttctcctggggccacagcgtgggcttccgagactctgcgtgaccccagctctgcccctttggggctgcgggtgaagccctcaggaccctccgctttctaaggaatgaatccccgagtgtggcaggaaggacacagccggctcctgacgcacacctgatttgattcaacaccgagtcggcacagacacaaccagagatggcctgggtccaggctggggctgcacgggctgtgtcctggacagccaggagggaggccccgcacacagacggccgccgggcagggggcctgagcgggacaggcctggccacagcccatgtccttggccttccacataggtgcacacattgtctgcccagagagggccaagatgccccaggcaccccttcgctccgggggctcaggacacaggctcccagctgaggccacgcctggacccagagctgatgtttggctgcacgcgagcccactcgggacagacccaagaacacgaattctctccctttggatttaaggctggtgttttttgacatttacttcagtttttctctctgaaattaaaattacctgagtaaaagattttaagacattaaaaaagccaaaaacacagaatccctgcaggcagacggtgccagggaggtggcggccagggccaggatgccaggggcacggtggggtcggctggagctccagggctgggcctttcccagtctcgcctgccctggagcccccaggagccgcccctgggccgacgctcctgtggccggagcacaggaaggcacagtgaggtagggacagtggccattgtcccccgcctgccaccagggctgagagggcagcgcacgcctcggcccctcctataagcccctgccccctcggagctgggtgtcttgtccagaagctggggaacggcccctgcagtgtgggaggggaggggctgccgggaggcctgagctcagacagttaaataatcctttatttgggtgggctgggggaggggtgactggcccaggagggcaggcgaggccgggcccagacccccatggggggtggcaggggcctcgggcgggctaggatgcacctggcacccagaagtgccgcgggggcactggctcctcaggggcccgagcgggcggggagcagtctcctacttgtgccgggcctcggtcaccctctgcaggcagtactgcgcggcgggcagcgacaggaccaggctcgcggtgcggcggcccatccagtacaggctgtagcccagcaggccgaagaaggcggccttcacggccaaccgagacactctgccggagacggacggcgggggcacgctgtgggagggagggggcgctgggcctggctgggggtgggctccccataccccagcccccatgcctgggtcactgccgcatgtggttggcctccagggcgctcagcctccacctgggggcttgtggggtggggcttgcagggaggggcgggcactcacgtcatgatctcctggatgttgaggtcggtgctccagttcttctcgatgccaggcacgtggcccatgcccacgacgcccacgaccacggaggggacgcacttcctgggctcggctgtggggaaggacaaggggtcagtacctgctcgggcctcagcctcacagggggtcccacgcctgcgggcggccgtcaccgtcagaggcccgaggcagctcgaggcgccgcgcggcctggcgcagcatgtaggttaggtagacgtcgcgctccgagacgatggtgcggtgcaggtctgggaactcgccaatcatctcggccatcatctgctccagtaggtccttctgcttgcagcgttccacgtcatccttgctgtggagagggatggctgcagccccgcagggatgggcaacgggctgggggggtggggctggcactgtggacaccgggcagggaccacagcacgtttgtttgggatttgtggcggaaggaaagggcagggaaggccttgagtgaggattggctgcgcttggacctgcacaggagggcctggagcctcccacagaccaccctgcaggccggccagggtcccgggggcagccctacctgatggggtctgacaggaagcacaggccccaagccagcctgaccttctgccagaaggagagcgctgcgatggccctcttgaaggtgacggggatgggtcggtcacccaggtggaacttgcagaaaggcaccttgctggcctggagcagaggctgggtgttggggagcagtgggaaccccggaccacccctgtgagccacatccctgtggccaccccctacctcaccctgtgcccacctccttgaaggcctccctgaactcgccacctggggccatgcccagctgctcggtgatgtgtgcagacaccttcagcagcagcatctgcatcagccccgacatgagcccgttctgcagagagagggagcaggcatcagctggaggggcgggtgcgggggtgcgctgggggaatggcagaactgggatggcaggcagcaccagcgcagagccctgccccagcccagtgctgtgtccttggccccctccccgacaggtgcaggaccaccctagcgtgcagagggtcagaccagagcagggagttctgtcccaacaggcacttctcaaaggtagctcccttcagaaaagaccttcacgggccgggtgcagtggcgcacgcctgtcatcccagcactttgggaggctgaggcaggcggatcacgaggtcaggagttctctctcagaccagcctggccaacatggcgaaaccccatctctactaaaaatataaaaattagccgggtgtgctggcgggtgcctgtaatcccagctactcgggaggctgaggcaggagaatcacttgaaccccggaggcagaggttgcagtgagccgagatcaccagcctgggtgacagagtgagactgctctgtctcaaaaaaaaaaaaagaagaagaaaaggcctttatgaggcagtctcgttctgcgaaggggccgccttgagctggcacagacgctgggtgctgggcaggcaggctggagaaagggcctcaccactcacacctgcctgctgaggtcagcacagcactgctggtgcggacaccaggccacccccatcttcagcagctacagcccgaggcctattgcccctgtctcaccggccggctggcaccacgggggtgtccacgtgtgaaggagatgatgcccacagaagggcagcaaagccccgggggccacacagcgccgggcaatcgctcacacctgcacgcgcccagggacggtctgggcctgagccatgagccctgggaatgtcccgcctgatggagtgcccgtgtttccccggggcccaggccaccctggggagcccaggctaacttaggatgagacattcacgaggccttggtccactgggacccactccacctctggaggggctggggtctgagctcagacgtgcctgtgaccaaccccagtagaaacctagacaccagggcacagcgagtgtcccccgggaggggacaggtgaagcggacacctggtgtctcccagaccctgccccacgcccccttccctctgtgacaccgcagcagtgagcagcacggcactgccgaattctatgccccttcgagatcactgggccccaggctctggtggggaggctgcccagtgctgggccctggctggaccggggactgccctttagaagacggcccacagaggtcttctttggtgacttgcctcatctggagaaattaaaaaatgaaaggcaggcgccaaacgtttagggacatttctataagatctcattataattgtttcctttgaacagggggaaggcaaactgaccagggctggggtcaggcgtgctgggccccctttgaaaacacaaagcctggccgggcgcggtggctcatgcctgtattcccagcactttgggaggctgaggtgggtggattgcctgagctcaggagtttgagatgaacctgggcaacatggtgaaaccccgtctctactaaaaatacaaaaaattagccaggtgtggtggcaggcacctgtaatcccagctactcaggaggctgaggcgggagcatcactagaacccaggaggcgaaggttgcagtgagccaagatcgcaccactgcactccagcctgggcaacagagcgagactctgtctcaaaaaaaaaaaacaaaaaccgaaaacacaaagagcaatgagaaagtcctgcctctccggtcactgcaaggctggagaagtggggacaggaggagccctgagccccacccactttgggcctgggtgtggtaccgggggggccaaccttgcactgagacctgacccatccccagcaactgctcagcaacccagtcctcgggtgaccagcccctgcctcagcttggagagccacccatttcctcctcccttgcctgaaaccgggtaatggagcctctttcatttctcctggcccaggggaggtccctaacccggcaatccccagggcaggccaggcacagccacactgactgggggcatgggctgtgagaggaacctgggcaacaggcaaacaggtggctttgaccccgaccctgaccctgacccttgcccgcggctgcgcacctgcctcacggcctgctgcagcttctccaggctgagctcctgggcctcccgcagcagcgtgctctcgtccatcttcagcatggacacacgatattggcagagctccacgaccaccacgtcaggctgcacctcccggatggtctgcaacagccacaggtcacacctcgagaacacagccgctccctgcccctcagcacagctgacgccagcaccaggggccccatcccaggagcagccagccttggcgtcaccccagggctagctaaccccgctgctgcagtgacagctcaattctctaagcgacgagagaggaagctgtgaggcttgttcacttgttaagtgggaaaacgcacaaggccgtcacggctcccaggcaggaagcccaccttgccactcccagggaccacagtgttgaagcaggaggcctgcggtgcgcacacacgggcacacgggccctgccgggaggtccctgagtgcaggacacaggagcttacaccaacccgtgtccgggatgtggcgggtggcggcgctcaccttcacaacgtccctcttgctgtcgtcgctgaagtgggctgtccccaccacgtacaccctgctcccgtcctcagccaccaactgggtcacagtgcgcggcaggttgggccgctgacgccgccgcttcagcttcatctccaggagcaggttgaaggcgtccacgtcggctgcaacagcagcacaggccgttgtggtgccgggcccaccccaaggacgccgccgggcccgctggcagcctgggctctagaaccctcctgggttctgagaactgaacaggtgcagagcacaagactcctgacgagcgtcacactccacaggctttgcctgcccagtgatgggaacaccggctaccacctctgtgagctgcacggcttcgagaagccagggcctcaggagtcctgtgccccatacaccccatgagggcgaccttgggggttgctgtggatgaggttcggtgtgggggacagtgggggcaggtgccgcagggggctcagctaggggaggggctctgaggcgaaatgggcccccccaccccactcaggagggacaggctgaggccacagcaaggagggactcccgtgccgctcacactgcttgtgctcacgagccccccatgcccaggggcctgcctgtgctgcttgcagcccctccaagaggctccactgccaggcagggcccaggagcagctgctgttgggtggcaccaggcctagcagcacctacctcaggtctcggccagggcccctgctcaccacaagctccaagcccctggcagtggttggctgcctccccctcctccctgactcaacagcccaacaccggggaacgtgccaggaccctgagggacacgtacacaggttctgggggtctccagaaagcaccctgggcaccggctctgaagcctctgacggcacaacaggttccacgttggcctgcaggtggaaaggagagttcaagtcagggtccatgcaccccagaaagccagggctccgtggcaactccacggaccacgtaccctggaaagggacccgtggccgctgtgtggaccacacaccctgaaaaacgagggcccgtgaccgctccacggaccacgtacccgggaaagggacccgtggccgctctgtgtaccacacaccctgaaaagcagggcctccgtagagcctaggccccacactgtcagtacccctcctgcttggccatcactggcacggctgccatcaagctgggcagacagggccaccaggccacctcagcccagcgcccctctccctcggaggtgcctcctgcctgaccctggagaaccctgtgaagatcacctttgcagaacaacagccagggaccgaccccgagagcccacaaagcggggaagccccccgcccctgtctctgtgcagccagcccagcctccacctcacctcgtgcggtggctgctgctcctccccgtccatggctgggcggcggcttcctgcacctgtggggagcctgaggagaggcatgagaggcggggtttccacctggagccccagacctggctcaggactcactgcgtagtgccctgtcagtctagaaccatctgttgggtgggcctgggggctccttcccccatatccccaaatgcctcctgcccatcaaaggctgctgaggtccagggtcggttcaggtcaggcccgggtggggaaaggccagcaggtccccagacaccccagcataaaccaaacgcagacgggcccagggcgggttgctggtgcacaggcctcactcagaacagggccagagctgcccaaccctcactgcggcacggcgggcacacataggaaggcagccctggggtccacacatgatctcaggacacagcaacgcagctgctgacacatggcaaggaccccagggcctttgtacaaaagccacttcccctttcagtaactacagcctgggcaacaacaccggcacagagtcagtacagacggaggaatccacaaagcacacaaatcaacgtgtttggacctaagaccttctctcccactttaagagacaaacatggtgtggaaggaaccacggtagaaacccggacaggctggggcagccacacgagggggctgccccgaggcatcacagctccccacagactctcagaaaccaggagctcaggccgggggcccaggagcctgagggaaggaagaaaacagccaggcgcctgcagcaccagaggcacgcaccggccaagacccacagagcatcggcgagacctgcgcggagcccctcgaggcggggccagggaccagcaggctgtcctgagactggccacaggccctgctgcaccatgtggctcttcctgaatgttctcagccacggaatgccaggagtgactgtttaccaagttaatggctcatgcatgtcctggcggatggatgtgtcaccaggcagaatcattaaaatatcccaaacaggccaggcgcggtggctcacacctgtaatcccagcactttggggggccaaggtggatggactgcctgagctcaggagttcgagaccagcctggccaacatagaccatcctggtgaaaccccatctctaccaaaaatacacaaattagccaggcgtggtggtgcacacccgtaatcccagctactggggaggctgaggcaggagaatcactttgaacccgagaggctgaggttgcagtgagccgagatcctgtcactgcactccaacctgggtgacagagggagactctgtctcaagaaaaaaacaaaagtaaaaaataaaaatgagccgttggaaaccattctgagctgtctagtcgtgcaaggtattgtggttttgtcttgaagcgtctgcgtcagtcagacacgagcatctggcgaggaaacgacggggcttgtaggatgtgcttcagaggggccactgccgggttctgcactgatgcctgcgtgcatctggggtcattttcatgtcactactgctgcccacttctcagaactcataagaaaaaggaacaatgagcaataagacgctatgtcaggttcctttcctctgcaaaccctgttggcacacagccacagcaggcacagacctcggccccagccaggactcacagacccagctgggtcctggccacccacatccaagttaagatgcctccaagcttgggtgtcctaacctgtgaacaggaaggagctctctgtgcagtgtctaggagggcag

SEQ ID NO: 5690 - DNA, 218 bp, Homo sapiens
gctcacatttaatttttattttgattttttttaatgctgcacaacacaatatttatttcatttgtttcttttatttcattttatttgtttgctgctgctgttttatttatttttactgaaagtgagagggaacttttgtggccttttttcctttttctgtaggccgccttaagctttctaaatttggaacatctaagcaagctgaagggaaaaggggg

SEQ ID NO: 5691 - DNA, 1217 bp, Homo sapiens
gtacgtgcccttgctccacaaaggccacggcagcctgaaggtgctgcgccatgcgcagcttgaggagcacggtggggaggcggcggcggcagaaggacgaggccgtgacgaagtcgcagagctccagcgaaccgcgcgtgggcaccaagccgagagcatacagcttgtccagcagcgcggccgaagcgcgcacgcggaactggtcgcgttcgggcaggtcgcgcaggcgccgcgccagctcacgcacggcacggctcagctggttgtagcgcgtgtagtcctcccgccgctgcagccggtaacgccgcagcacgcgcagctcgtgcaggttgtggtcggtgacctcccagttcaggaagtccacctgcttcagcagcttctgctcgtggaacttaagcttccgcaccatgatggcggcagccgcagccgcaggacccgaagctgagagcgcgttctggcatccgcgcgatttccgccgcggcgccccaagacctggacggcctgggaccctgggccaatgaaagaaagacttaaagtcacgccctcacttcccattggccagggtgggaccacgcctctgcactgggatctcgcgtttcttcttttcttcgcgtttgcgagggagggggtagaagcaccggaggtgggtggttgggagcgggtccctaggcggttccgcgcggtttttagtagccaagactgtatccctttctgcggcaatcatttcctcctagacttctgtcctttggggactttcagagtctcccccgcaagagctgaagaggccatttctggggaagaggggtgactgcggcttgttgattgggtttactgtgctaacttgcactgggctcctgccatgccttgggggagcttgccggagccggctctcctggggctgacctggtagtccccgccgcccgccagcgtcaggtccttcacctggcatgcagagcgatctctcattgtcaagttgggataggtggcaccgaacccatgaaatactgattggctgcttcctaggcccacagaaaagggatctataagggagtcgcctggaaatctgtattattaactaaagtgtcagatgattcataaaacccagcaagtttgagaaacttggactataactacaagtccaaaccctttagtctgtgctcaaatgaattatcctgacatgaatttctggccaccaagcattgagttaacaaatttaa

SEQ ID NO: 5692 - DNA, 1578 bp, Homo sapiens
gccgaaacgactcctcctccgttggcgggagcagcagccgccgctgccagctgcccatctaggaggaggtttggggagacggtcccgggagtctccgcatccccaacattgttaagcgtctcttcggaagagctgcgctcgcagacctcctcagggccataatccgtggcccgagagacgtcgaaaatctcggaggagacgtcctctgtgcgtgactcgtccgggtcgtccaagctctcggtgtcctcggtgatgctagtggccacctgggccgtggtgacactggtgatctggaagcagctcttcttcttggccggcatcttggacatggtgaagaaggctggagggcagagaggcacgccggctcctctgggtcctgtcggaaaccggggagggcagagcacgggcccccaaagacaaagtccgagtctgcgctggggtctgaggcccgccgctgttaagagtcacgggctgatccaggcgctggccgcccggtgagacatcctcctcctcgtttccttctctgtgtcggtctcttcggctctgcccccgtctcagtcccgcggcggctcctccttcctttttagctctcgcagccgcggcgcctcaattcaattccctcagaggcggcgagagcgcgaacccaggggcgggccggctgcttcctctctcgtctccgggcagccgtggtcagtccagctcggcgctcggcgcggtcagcaggccttggctgggggtgggagtgggagggcgaagaggaggaggaggaggcggtggcggcggcgtgaggggcggtgctgccccgctcgggctcctcaggccggtgccggcgtcagcgctgggctctctgactgagggaaggagcggcgagtccggagtcggagatgcctaattcagccgggagccgcgggccggagctggctgaaggtccgcgggcgggcggtggggctgtggcgcgggcaggcggccctccctccccggctctagccggagctcagccccagggacatgtcgactgcctcaggcggaaacccgctctgggggaggggaaagccggctcggtcctccccttacagggggaaccacccctgcgggcgggcggcgacggcggtctcggcctcccctcgcggcttctctcagagaggggcggcggcggcagaccgctggcacgggaccggaggcgccccggctgtgtgaggtagcggtggtggcttctccggctcctcctcggtgcgcccaattcctaaaccccgaagaaactgaaattcaaactgctgaagcggcggctgcagctccctccgctgggccaagatggggctgaaatggccgcgccagggatgctgggaggagcagcagccccgctgccgccgccgctgccgactaaaatgccgccgctgccgcagccaccgccagcgccgcagccgccgccgttccgtgacgcaccggcgtcgtgacgtcaccgctccgccccctccggtttcctgcagtttcgcgtggaacctggggtggggggcaatgggcggggctaaaggttaaaaaagggagcggtttctttatttaaaatttttaaaatttaaa

SEQ ID NO: 5693 - DNA, 1153 bp, Homo sapiens
aataaggaaaagactttctccaggtagtgtattagagcagagcagaatgcaggggttactgtgttgaacaaaaggcacacatcagagagacagttgcaaactcagaatactgcgttatgggcaaaactaactggtccacaagagaaaatgagagactcgatttggctgccaggaacacctgggcctaggcaagaacacaagaggtttctgggggtggggaggaaataggtctcgctgaaggtgacagatcccttggggggcggccagctgtctggatcactgtccagggactgtggccagcccagatacctccgaggtgagtccagatcactaggagcagcagtctgtcggtgggatgcgatggatggcgatggctgtggcagcgcaggtctgtgggcagaatgatgtagtcgtctggcagtctggtggggaggagagggcttggcagcggcggcagtgggtggtctgtccagtgtgtaacaggagcccagcttgcagctggagcgcaggacagcgtccaaatgtacatgggaggggctggctggctggaaggagagggcggcggctcgctccagagtgaggcccaggggcggcagcaggagcctggagcgctattcctggaacaaaggcaagcactacgcgggagggaacaggagcgcaggggacatcgcggcggctcgagggggagggaggcgcggagggagggcgccggtggcgaccctggcggcggccagtaacacagcggaccctccccagagcacccgcccccaggcccgagggtctcccggcctagaagtcctcgtcctcctcccatccaaagactcgcttcatctcggccagaaagccccggtaatcattgaggagggggctctccttcttgatgtaggggatcacccactgcagggcgggccctgtgaggcgggtgatgaggaacgtcaccttcagggcgtcgctggagaacgtgttctcgtccacgaacatgtaggagcccgtctgcacgatgaactccgggagtcggtcggtatcgccgtcaaacgtctcgggaaagggaatcgggttcctccagcgacgcgtcgcaggccggatcggcaaggccaggagggcctttatcagctgcacccgaccgtccatcgctgctcctcgcttcgctgga

SEQ ID NO: 5694 - DNA, 2599 bp, Homo sapiens
cccttttttcttaccccactcccattaggcttccagccaccctaagccacgagactgggcagtgtcaccaaggatcccccactgacgaacgccaccatccaacctggtcagtggctgctcaggttctcctgcacccaggaggatgcacccgggaggaggctcccggcgcggctgtctcacctgcttccggtagacatagcacgcagcgatggcgaccatggtggattctcccacaaagcccgccaggagggagcccacgcccagggtcgcaccgtgcaccctgcagatgagaacacaaaggcaatttgtctgttaaggccaagtcaaggcacaaccgtcgatgccaaaacccaggaaagtaagtgtagcctcgagacggctgagaccagcggcgttctccatctgctggcttcgtaagggccgcagctaataacctaatgtgtgaggggaaccaggaactcggggctgggccacctccctcccacagcacatggatcccacagcccttcccaccctccccaggacgctgggagctccctgagcgcagggaccatgtccttctcttctggttttcatgtccagcatacgttcaagcccgtgcagggccggccatgccctgacaggagctcagtggctattattcgtgtctgggcctgatttcaaaagcacttttctaaaatggatcccaagagcctccacctggtgcctgggcagacacacaaaacatcattctgaatttccgattctagacgtgcctggggatttcccctgaaaatgtagctgttaaacctctggacacagtattgaagtggcagaaggacccacagccccaaactccctgacaacataccccaggtagggtaggaccacgaggctggcgatgaggacgatgatccgcagcacagagctgggggcaaggacgaaggttttcttcagtgtcatcagccacccggtgagatgcgccctcactgtgactgttgggaggagcaaaggactcgtcagccgtgcccgccatccactccccatcctgctgcctctggaccagggcagcacatccgagagccaggggctgcctaggaccctggccttgctgttgagccgctggccacctcatcttcctgccagggttccccatccctgctcctgagcctaggcccgcctcggctccccgcctcctcacagccctttggatctaaatggctgggaccaggcaggctcctttctccactgggacagcatcttccaggcagcctagctgctcttgtccagtcctgtccccacacttggccagcctcgccctctgatcatctacctctagaagagaacactcagagaaaagtggcactctagtgtgatgctgcgtgagcagaaaagctggcatcagaagccatcttccctgcctgcggtcagaggtgtggggaccaagcagtggggtaggaggaggaagctgctcgtccccacttccctctgttctttccctggactggtcctgaccacttccaccgaggtcacttccctttctccctcctaatggtgtgggccctcgttggtgtgctgccatttcaccaagggctgcatggcctgcccatgcctgcctcttcactggatctctgagctgcaggagggccatgggtggacagcggggaactgtggagagcacggggcttgcccttgtcagtaggaaggccctgagcatctagattccatctgaaactggaaaggcttgaggacgcgcagggcagggcctgggccttgaagagagggcctgttaacctccctgtggacagcaccaggcaagggctcttggaggaggaagtgctcattcctgggataaaaattcctttccaggatatgctggtttggaaggaagtctttgccgtcttcttggtctaacagtgtgtcctgccttcctctgggtggaagccttatattaatactaacgaggctaattttcttctcttaggcaggcagacagacccactgaggtttttgaccaaaggagagagtcaggatcccaggcatatgctaaactggttggcccaaatccaacagattgcaaagagtggcagggcctggcagctgtctggaagcccttcatcttacagacaaggaagtggtgtcaaatggacagtaaaggtgaatcacatactcagctatagcctgctcccagctggggcactccaggcccctcctctggtcactactgtagaaattaactgcatgtgtctcaatctgcgagtgcagctgcttctagatggtggcaccttccagagcttggttcgccctgtgtctacccaacaagtacagatgccatcccggtgctgtgatcttccagccatttctccatttctgtcacagcccagaaagtgacgccgcaaggccttagagcaagggccgttccatcagccctggcctacctggggctccatggctcctttctttttctttttgttttgagacggagtttcactcttattgcagaggctggagtgcagaggttgcagtgagccgacattgtgctactgcattccagcctgggtgacggaatgaaactctgtctccaataaataaataaataaataaataaaataaaaagtta

SEQ ID NO: 5695 - DNA, 1867 bp, Homo sapiens
ggatgcatgtctttatttaattcgttcattccaggttcatcccacatcttcacatctcaccctcccaccgtcaaaacaggtcccatgtaacaacagggggccaaaaacaacaggcttgcccacagtctccatcaccccctaccccacggaacactgtggggacaacggtaccttgcttgaaagccacaggtttcaaacacttttaggggcacaactctcttcaaactggaaaccacgagccactacgtagaacaggctgtcagggagtttcaacctgggcaacatttggggtacgtccctggagccccaagttccctcagagcaggtgaaaactcctgcttcagagcccttctttctatccaatcacttgaaacgttccatagaaagaagaaagaaaaaagaactcccttcttgaaatgcgaataccaagatttcgcacgaccaacacttccacctgttgaaataaacagtccacaaaattaaggcatttgggggcaattagagggaagtaaagcatttactaaagttacaatatcatatcaaaagtgttcattatgcttttgaaggctcttaactaggcacaagggcagaaacagtcacggtcccggccactgcaggcaaacacgtgttgattaccaaagcagaaagggaaacagagagctggtggtgagcattctcttcagcaggtccccaggcaccaggcccccctccaagtcatgcctcacatgcccaacagcaaagagaagcagtgggagctgagcagacactgcagggcagggcagggcactgctggctaaattacagcagcaactgtacacacgaaacagcttcttcataaacaccattctcaaactggatttatgcacattcatacactacctagtatatctaagagatcttgaaatcaaagcaacataaaaaagagagactcgcctgcaatccaggcactgagcaacgacatgtcaaggcaacagaaatccccctcctgcccccactcacttctccatcccactgtctgctgagaatttctagtatttattccacacatcactgtacacttcaaaatctgcacattcctctccgtggaattctcctgggatgtgaatcccacccacgtgcatcatgtacacatctaaactgtttcattccacactgagaggttcgggtttggagcgttcattccacactgagaggttcgggtttggagcgttcattccacactgagaggttcgggtttggagcgggaggaggggagtgaggcataagtgagaaaggaggtcacatggcccaaacaggtacttccaggaggccaatcccagccggtagggatccaggccccgggaggccaggcctgcttgccgagtaccgacggccaggtgaggaggcagaagctgtagccccagagccagaagacccacactagtgtcatcaccaacatacaggggggccacaggctcccagtgcccaggttaaggtgcagtcctcaccgagaaggccacatcagcttcctgtgagtgtgtcccatggatccaggggtggccagaggcccatcaccacgggtgttggcacttcctaaaaccgcacgcagcgatctccagactcgttcttggccatgagcagcagaaatgctgcagtgctgcctgccagcgtacaggctgttcaagaacccaagaggaatttctcaccaatacgtaaacatgcaccacagctagactgcggttccgtgactttgggatttcagagacaggcgaacttaagaagaaattctggggctgacaaacagcaaccaacattttgttttgcaaccaagagcatttcaaaaagcaaaaatattgccctctacttttaccttcattacataaaagga

SEQ ID NO: 5696 - DNA, 2105 bp, Homo sapiens
caggggttttccttttttttaatattagaacatattcttcagatggtatttgttcatacgttggctgaaatactgccatggaacataatctggtgtgatgagaggctattgcccacctcctcctgctgtggactctgcagacacataaatatcattcagatcttggagaaagctgcttttacaggctttgctctataaatagggatagtggaagcattgccctggaaacctgttagcttatactcttgggcctttttataactccagtgagacaaagacccacccccagagttgtgattatttttgtatatgccacctagttcatagttacccactagtaggatccagtgatgtttctgcatcagagtgaaggaatttctaaatgagagcaaactctctgccatgcattgacatcggggttctatagaagtcgtcagatttcaggttataaagcagtgtgtaataaaagcaaacatggaaggtagcatagaataatactagtatctatcactgatgcaaaagaatctttttacagtgcctgctctgtgccaggcgtgtgttatttaatacagccctgtgaggtaagtggtctcgtttttcccattttacagatgagaaacctgaggcacagtgaggatcaggaacttgcccatggcccatgagcttgggggtccagcccaggctgtttggtcccagagcctgtgctcttgtccattatactggtggtattgcccctggcattgacaaagtgggaaaagatgactaacctgtgtagggggagtttaaatttgacataaagtggtgtgggtagtttcttccagcccccatgcccgtgagtttagccaggcctgttacctgctaccctcttccccgccttcctccaccctgcagaggagcagagcgtagcctgagtgcctgggccagcagggtgagggagtgggccagaaccatgcagatgtcatccaggacaccctctcggccagtgtccatagcactctgacttcaccaggggagccctgcacaggagacactcagtttgttctcagaaatccagtagctgggctgacccatccatctgccctggctctcagaaaccagaatcactcaggctgagccgtgggtcctgcaggtctttcccctgtgggaggccagcatcttcgcttgctctcttctccacctgaagaccaactgtcatcttaccagcgagctcagctgccagggtttgtggctggcgccagtcgtattgtggacatgggcttatgctgagcacagaccaggtgctcctctgggaggagtgagactcacgggaacaccatcctccgctttctcgtgaggagggtgccccctccttgaacttacctaagggacgatggccagagaatagtgaaatgtatgcaggtgccactgcttagttcctgagaactgtttagctgtcatttttttgcccttaaatatgcctttttttaaagcacatttcactgatttcatgtgaatctagggtaaaaatggagtagtaagaccaggcggtgagagagtgggcttccgtccacttcagggcggaagctggttagtccacgtgtcggtccttctgggaccctgccacacaggtgtccccacaccaaggctggcagaaggaggtttaaatgaccacaggcttcggatatcagaaaggcagctggaaatgacactgaggaacagatgggctataacagctgcccttgccacttggctctacatcctcctggctccgagcaggcccaccgttgcttttcctccagtagatggtgggccacgggatagagccagaacagaagactcgtccccctccactcttgtctctggcaaatccaccagctgggaggaccacctttcctccctcctgcctctgtgcgtgtgcgtgcactccatgtcgacagccacaggtttctgctgcagcagcctcttcccctgaataggactgggattaagccccagcagctggtgcaccccactcagagcacggttaaggcagctgcccaaacctctcctcggctttctcagggcctttattcgttcaggctttctggaagtcagctggcggaggtgaagatggcttgggcgcccct

SEQ ID NO: 5697 - DNA, 2105 bp, Homo sapiens
aggggcgcccaagccatcttcacctccgccagctgacttccagaaagcctgaacgaataaaggccctgagaaagccgaggagaggtttgggcagctgccttaaccgtgctctgagtggggtgcaccagctgctggggcttaatcccagtcctattcaggggaagaggctgctgcagcagaaacctgtggctgtcgacatggagtgcacgcacacgcacagaggcaggagggaggaaaggtggtcctcccagctggtggatttgccagagacaagagtggagggggacgagtcttctgttctggctctatcccgtggcccaccatctactggaggaaaagcaacggtgggcctgctcggagccaggaggatgtagagccaagtggcaagggcagctgttatagcccatctgttcctcagtgtcatttccagctgcctttctgatatccgaagcctgtggtcatttaaacctccttctgccagccttggtgtggggacacctgtgtggcagggtcccagaaggaccgacacgtggactaaccagcttccgccctgaagtggacggaagcccactctctcaccgcctggtcttactactccatttttaccctagattcacatgaaatcagtgaaatgtgctttaaaaaaaggcatatttaagggcaaaaaaatgacagctaaacagttctcaggaactaagcagtggcacctgcatacatttcactattctctggccatcgtcccttaggtaagttcaaggagggggcaccctcctcacgagaaagcggaggatggtgttcccgtgagtctcactcctcccagaggagcacctggtctgtgctcagcataagcccatgtccacaatacgactggcgccagccacaaaccctggcagctgagctcgctggtaagatgacagttggtcttcaggtggagaagagagcaagcgaagatgctggcctcccacaggggaaagacctgcaggacccacggctcagcctgagtgattctggtttctgagagccagggcagatggatgggtcagcccagctactggatttctgagaacaaactgagtgtctcctgtgcagggctcccctggtgaagtcagagtgctatggacactggccgagagggtgtcctggatgacatctgcatggttctggcccactccctcaccctgctggcccaggcactcaggctacgctctgctcctctgcagggtggaggaaggcggggaagagggtagcaggtaacaggcctggctaaactcacgggcatgggggctggaagaaactacccacaccactttatgtcaaatttaaactccccctacacaggttagtcatcttttcccactttgtcaatgccaggggcaataccaccagtataatggacaagagcacaggctctgggaccaaacagcctgggctggacccccaagctcatgggccatgggcaagttcctgatcctcactgtgcctcaggtttctcatctgtaaaatgggaaaaacgagaccacttacctcacagggctgtattaaataacacacgcctggcacagagcaggcactgtaaaaagattcttttgcatcagtgatagatactagtattattctatgctaccttccatgtttgcttttattacacactgctttataacctgaaatctgacgacttctatagaaccccgatgtcaatgcatggcagagagtttgctctcatttagaaattccttcactctgatgcagaaacatcactggatcctactagtgggtaactatgaactaggtggcatatacaaaaataatcacaactctgggggtgggtctttgtctcactggagttataaaaaggcccaagagtataagctaacaggtttccagggcaatgcttccactatccctatttatagagcaaagcctgtaaaagcagctttctccaagatctgaatgatatttatgtgtctgcagagtccacagcaggaggaggtgggcaatagcctctcatcacaccagattatgttccatggcagtatttcagccaacgtatgaacaaataccatctgaagaatatgttctaatattaaaaaaaaggaaaacccctg

SEQ ID NO: 5698 - DNA, 783 bp, Homo sapiens
ggaaggagacttcgtttcccacggacgaaaagttgccacgcccactcagtgtcgtcagagccccctgtgcctgaggcgtgcgcggctcggagccctgccctcggagtcctgcggtgccttcctcgagtctggcctgctttccatcctgctaagtacttggggcatttccctctttgggtaaggtgtggtcttccctgtcctggcattagacacaaggcagtgggccttcctgccattctaagtgtagcttaagacaatcagtgcaaagcaaccctttgtgggtgtccagcccttgcctcgggaggccagaaaggtggcctggggggagagcgtctaagctggctgtggaaagacccatgttgggatccattccacagaggtcgtcaggggtctctgcctggcctggaggtcccagagaggaccctcctcccctcaggaaggcccatctggaagggtagcagaggactgctcacaggaagagcatgcgaagtgctctttctggggatgcctgtagttggtgatgtgggaactgggttttgagggatgcctaggagttcatccatcagaggggaaatgaggaagccatgcaggatcaatggataaagtgtgctcaggtgagggttggctggtgggccgctgcagggcgggggcctgtccagtgctcccccacttacttgctgcctcccgactgctgtaattatgggtctgtaaccaccctggactgggtgctcctcactgacggacttgtctgaacctctctttgtctccagcgcccagcactgg

SEQ ID NO: 5699 - DNA, 1161 bp, Homo sapiens
aggattcatcactatcaaaataactacgtattatgttgttttatcattcaatttgttggcactatacctaatccacagtaaacaggattatcgttaacttaatacgatctttcttaggaagaatttggtaacagtattctattgtagttttcatgagaaggcttttcctattcaccaaattgactcggttccttgtcagtatgaataatgacccaaggtttactggggatggtgacaatgtaggaagggtccctcgcctcattcagtgccttctcagaggccctctccagaacagccatgtgtgacattctgctgtggtcatttctatttacaataatatacatatttttctgctgcatgcgtgcaacagtgtacaatcagacccaaccctcaggggggttttctcacactgtttctctcaagcgtggctgctctgatggacgctgaacactgatttctgaacgaagcctttcccacagatgccacacttgtagggtttgtctccagtgtgtgttgtctgatgtttattcaaattggacctgtcagtaaaggccttcccacactcagcacacacgtaaggcttctctccagtgtgaattcgctgatgcacttggagctgtgattttttagtgaaagacttcccacagtcactgcactcataaggtttctctccagtatgaattctgtgatgtgtaatcaactctgacttctgtcgaaaggtcttcccacattcagaacaaatgtagggcttttctccggtatgagttttctggtgcttactgagatttgacctgccactaaaggccttcccgcactcggcacacacatagggtttctctcctgtgtgaactggctgatgcaccaggagctgagacttggaggtaaaggacttcccacagtcactgcattcataaggcttctctccagtatgaattctttgatgagtaataaagtttgacttgcggatgaaagctcttccacactcagtgcatacatagggtttctctcctgtatgaattttctgatgaacaatgagtattgatttctggttgaaggctttcccacattcgtggcattcatactgtctctctccagtgtgaattttctgatgtatattgaggtgtgacttctgagtgaaggctttcccacattcgtggcatt

SEQ ID NO: 5700 - DNA, 3887 bp, Homo sapiens
gtgctgtttacgaactgcccttcgtacaaataacatccgttatacaaagatacaagatccgggttatgcacaattccaggcttggaggtggcaggggggcatcgcctttgggctgaggatatcaaggttttagaaagaatgaaaaaggagcccctgggtttgcaatctgtggcttcccctccctgctccctaggaagggtctgctacatggaaacaggttgggatagaaagggggcgggacgggagcaggggtgaggtctccagtcccaccacccaagtcccaagttgagctggagaaagtgaacaaaggggaatgaaggcacccctcagttcccaacttttcagtaggtcaagacaaagtggtcgggagctagacacactctcaatcctgatggacatggtgggagagagccaaggctacttgcccaccttccttggaattcccagttgaagttacctcaatccctctaggcacctctccccaggaaaataagttgagataaaggagaactgggtgcaagctgcctacccctaactggcccattgcacaccaaggaagatcctagaagctggcagggggagcctgtgcctttgaaaacctgtcttcatttccaatttgggagagagaagcgtggaggttaccctttctcggagctggcccctggcttgggctcctctcatttctctagacccttcctaagagtctggggtgagcacctccctagaactcagtatgggggaaacaggcaggggtcccctcatcagcctcaaggtcaggacaccttgaggcagcagcagacccaggagcctgagggggaaaataccccacaaataggaaaaacaaaccaagacaatccttaaagtgtcattgtccatggagaggatccaccagctctgagctaagacagtcagtgccacatagacaccctcccaccccgggcacagccctgcactcacaccgtgtgtcacacacacacagggacagccagccagccagccatgtggagaccatgttgtggggcaggggaaccaagggccaggaggccacagtcctgagggcttgtcctggccctgtcactgagccccttctaggcttggagctgtcatctgtgatgggaggagctggctgaaatgacccctaaagacaggtccctttggcgctggcatgcaccagttgtgaccccacagcaggcactgcctctatatgcacccccactcacacctcctcactgagggtgggaacacccaactccacatgctcacccactcacacctcctcactgagggtgggaacacacgaagctctgctctcatgcgtttccaaactctgcttccgctctgcaaaccacatccttcccctcccccagacaaagagatctacaaatctgggtcccttcccaccctccaccattcactctcaaaaaagggactgaggttaggagacggtgagatcgttacagccatccccctgcgttggtattctgctcctcctgaagctttcgagacctttcccattgaagctccctgagaaggaaatgccactacctctctcatgagagatgtgggggggaagaggagaagagggctgcacccgttcatacccagcctgggccccgtcttcaaatctaacctaaccgccacagtagtccagtctggggaatgcaagcggcttgggaaagttggagaacagccacttggagatgagaaccccagcctttggtttgggctgagggagggaagaagtgttctgggtggggtgtcttggtttcaatgcacagaatcacttggacctctcactcttcaacatggcaacctcggggtagacttacttctcttcccatccagacaaaagttaagtttcgctctaagtgggccagccttgggcaagggcgtgggtgtgaatgagcaactcttctaagaatctctgaaggttacttttcttttcagtggtttggggcagggagttacacagcttaatagattaagaagaataaaatgctgaatgctatcatttctttctaacatatttagcattaataaaaagtgagtatttctgaggtcatcacaactgcctccccctcccccaagcccttgcaagtgcctaagaaattgcctttgaaggattcccacccccctccattatcagctccctaacatcttacaaagtcttatcaacaggaatattaatattattttcagtatcagaaaaaaaaaacagttgagcagcacaggcaaaaatatatctgcactacgtttctgtcgttgccaaaaatatacacatcttcttttctttattaaaaaaaaaaaaaaaacccaacaacaaaaacccaaacagaaacacacacagaaaaatccacacatgcaaagagactgacaaggccggagcctggggaagctggaaacccctaccctgggctccaaccccagtgcaactgaaacagggacacaggcttcgccttgcctctcgcctctctcctgactgtccactcagcctctgtgccaaaggcctgggcaggcggggactctttgaaggtgagaattgcccactctaccctggggaaatagctggtgggtgaggggacagttgttagtcagcttagtggctcccctggttggtgggggtggggtgcaggaggcaagctggctaattctgggagggaggcttttgctaaaagcagtggcatttccccccaccttacgccctcccccaagccctggggctccccttgtgccagagaaggaggaagctatcagtggggtagggggccctaagggggccctgagaccatgtggggtcaggggagggaaggcaggatactaccctgattcaaagccctgtgcccccagcgactctccaatattggagtactgctctggtgtttgttaaccattcatgcccccagagagggaccaaagttggtgaggtggggagggtgcaaataagagctgggaggtcccctctctggcgctgcttcatctgaccactgcgcctatccctgcccttggctgccctgggtccaggaggagagagacaggcagacagacacacacacacacacacacacacacacacatgcacgcacacacacactcacacactgagacgggcagctccatctccccaccctcggcactcctaagtccaatagtgcaaacaaagggcggggcaccaaggaaggccagagcctccccgcacctgccctctcctccccatcacggggccccaagaggttgaggaggctggggctgagtgtgatgctctcctgccccttctccagcccccaacatctgtgggcttttacaagctcagcttgtgcccctgcgctggggggagggatggcgagaaaaagtccaaggggtcccttctgccatctgcccgagctgggaagaaactgcaggtaaagtgggtccagcccttcttccataaaagatttccccgcagggacaggcccagggcctctccctccacttctccccattcaagtgctgatccatttcatgtgacaggtccaaccaaccccctacttctgccatggcccactctgctctctggggggacctccaaaacatttgctggggatggacctcctaggcgggcttgcagactgtccttcctctgagcctcacaaagcggacagtgcggaaagggaagggggccagatggagggggctcccctctcagtctcagtcctcgacaccaggagctctccacactccctggacctcagcacaggctctgggtcaaggctctccagggtctgggcgcaggcgcctgctccaggctaggacccctcaggccaggatctgttccctccacttgggggggtcaggaggggtaagggtggatttagcctttttcctggttggctgaggctcctttgtcagcg

SEQ ID NO: 5701 - DNA, 923 bp, Homo sapiens
cggacacgagctctgcgaatcactttattgcgcgcgtttcggggagcgggccgtccagggaaggaagcaaagcgggaacgcactgcaggccccatccagaaatagcagatgccaacggaatccaagaataaagtcgtttattattttcagagcggcgggagtagggctggggaccctagggccgctccagtgggacttccctgaacccggttgtagaggatgatggcgcctttggccgaggggcagagttcagcccacatctccgtctcgagcaatctctgcacgttctgtggggagacaacgagacccaggcattcaagcttgccacttctcctgccagggctgtgcccagaattcctgagcctcagagacctctgcactgtccttagggaggcatgttaaggggctgaacatgtccctggacctttcccttgcactgagggcaaatcttgtgactctggagggaattgtgacccagccaacacctcccctacaagatatgcattgccaggcctctgcaggccccagccctggcctccaagcaagatggtttgtcactctgcacctgtgtctccacaaagaagattcctgtagactcgtgggcctcgggtcccccactcaggtagtgcttcctcacctgctcagaagtcaggctgcacctggacaagaacacaagggtggcttagtgggtgaccagcccctgcggggtacctgtggagccacagctgcctcagcccactcctcaccacccaccttcccaagacccaggatcatgtacccgagcctactcactggacatagaactcggcactggctcggccagcactggtctcatttcgggcgatgcccaacagcaggggctggctcagggtgagcagcggcaggttcacctgcggtggagggtggggtggggggaggtccca

SEQ ID NO: 5702 - DNA, 1249 bp, Homo sapiens
tatacaatttgggttgtggttgctgcgtatctgtttcaaatgggttatgggctcttctcacactttcaggtcaaaggggactttggaatccatagtgtacctatgtatgcatgtatgatcatggatcagccttcccatttctgtcgctgtgtccctatatggttcatgatcatgtatgttacttcactcgaaggccatacacaatccaaacaaaataaaacacagaaactgtgttggctattttgactttctgttgaaactattctctttggtcatatatatatattttaaaaatattatatatatatatatttttaaaaaacattttatatatatatatatttttttttccagtgattatcctgcctcagcctcccaagtagctgggattacaggcacctgccatcatgcccggctaaattttttttgtgtgtgtatttttgtagatacagggtttcaccatgttagccaggctcgtcttcaactcctgatctcaggtgatccgccggcctcagcctcccagagtgctgggattacaggcgtgggccaccacgcctggagatagatagatagatagatagatagatagatagatagatagatatatgtaatctttttcagtatattctcagggtgtgtttgaggaaagctttttttttttttggccattgtccaagggtttagaactgaatgggaatgtctgtaaatggatctgatggaggttggaatgtgtatcagcttttaatcatcactgtaacaaatcactaaaatattctctttattatctctcactttagaagtgtgggagggctggactgatgactctgcttatagtcctacaaggacaaaatcaaggtgctcttgggctccttatgaaggccctagggcagaatgtgtgtccaagcacatacaggttagagcagaattcaacttcttgtagttgtaggagtgaggtcccaattcatcactggctggtagttggggcctctcagcaatgtcaggctgcctgcattgctcttcatagtgcccagttcattttctaaaccagcaatggtgcagagagacattctcctgcttctagtttctctggcttcccctcacccacacctctcttctgtgtctcttctgcctccaaccagagttaaatctcttaagtgctcatgtgattacatggagcccactgcatgaatcacgatcgtctcctaaggtctgcaaccttaattacatctgcaaaatcccttatgtgatg

SEQ ID NO: 5703 - DNA, 18952 bp, Homo sapiens
acagcgtgagggccgccgttgctggagttcagcttagggaaggaggactctgaggaggccccgagcggcggagcgcttcgggggaggcgcccgcgcagacgcgaggcccatagccaggaccaccacctagctgttctacagtctggggacgacggtttaaaaatttatgccttgcatgcgatgtgcagtgggtgatggaagaacgtctacatggctttaaaattggatttaaaaggcaaatattttaaatgaaggaaaacccaagaagtttacttgattccttatcttccaggatgcgacttttgtttatttatttattttattttgatggagtctcgctgccgtcgcgcaggctggagtgcagtgacgcgatcttgacccgggaacctccacctcccgggttcaagcgattctccttcctcaaccacccgagtagctgggattacaggcgtgtgccaccatgcccggctaatttttgtgtttttagtagagaccggggaaggtatgggccctcttttgagaaaaatgcagagtgacactgaattttgtaactacatcaggaggctcttgaaccttctgcagctcactcgtggagtttgtagagatgcgtaataatccgaagtgttaaggaagaaggttctgttgagaaaaagttggagggctgaaagggatgcctttcgctatttcgacatgtgtggctgtaccccagagtgccctggctaacacgcaaaaccatgaattaggcggcttggcgaggctcagtggaggctggggccgagagtcatgtcaaagtttgtggggttaacctgcacccagtgacagtcatggcgaagtttgtgaggttaactcgcacccagtaacgctgttccaatgcaaggtgtgtatttggtgtcatccacgggaagaggaaacagcaaattttctcatggccttggcagttccacatgatggacatttcatatctgcagttttcttcgcatgagatggcttttttgcacaaaaacactggaatccagtgagcaagaatgatagaatgcaagatggatttccacatgaggaagtgtcacgaacaagcgttttgcatctctgtcagctggattcccccatgtgtacgtatgtgagaacatgccgtgtttcctgtctgtaatggtagaggcagccctgatactggattttcacctgaggatggatagatcttcagggttcaagtgggtttgcatctggactttagggtggccctgtaggccctgtgtgagaagcccccttcccagtgaactttcccttgtgtgcccgcgtggacagccaacagggggagcagtgcgagcgtgaaggcagacagtggcctggcccagtctgatggtaagtgggccagaggcagtgagtaccatttcttgatctgactactcaagacaggcgcttccctaggtactttcacacctcattgcgaggtacgtgttgttcccattttacaggtgcagaagctgagctgcagaggcgttaggtacctgcctcataagtggtagagactccagtgtcaccctgcccctcacgttcggagcccccgagggagggtctgccgggcagctcagcccagcactctgtaaggaaatcttcagtgccactgcccaggatgtcttcccggggattgggcctgaatgtcttgaccatgccgtgctggagggagagacccaccgaccctgtggggctggtccctacatctggcgctctgacgtggggctctccctcgctgtgtgaagttgcaccctgagtgcgggatcagcggaggagttcaacgagagattcctgaggattgcagtctataaacttggtggtaagcttgagcactcagttttctggggacaccatgggacaggccagtacaaagtatttggcttatttaaattttataaaaactcttcttaaagaaggaggtgttaaagtttctactgaaaagttaattgaactatttgaggttgtagatcttctttgcccttggtttccgactgagggaactctagaacttaaagattgggttgagattggcaaacaattcaaaattgctcataaagggggacattttatcccacccaccatttggtcaatctgggcttcggttcactctgtcttagactccttacagactcaggaggacaatatggagactgatccctctttcctctcctctgagggaggtcgaggaagcgctcagctctctttcccctgaggatactacacaaattgagaacgtaatttcaaaggaggacttccactctgacatgcctgcaccacttccacctacaccagaggctactgcacccccattgccgctttatgatgatcttttaactgacctaaatatactaatctcccccaatcagcaaaactcagctgaaacatatcaacagccattgcagccagaccctcctgtctctcctcactgtttcaacgctgccgctgtgcaaatagcagatgagaccaggcagcctgtaaacgagtctataaattatgtttctatgcagcccggtacagaggctccgctatatgaacagctcagaaaagaggcttccaattctcggcccggtaatgaggccctcaatcctatttctcctaatcggactcagttagagtcacagactcccttgaagccctttcctataaatcagactcgagtagagtcacagtctcccttgaagcctggttcctttcctgcaaatcggactcagagtcacaggctcccttgaagcctggtccctttcctataaatcagacttgggtagagtcacaggctcccttgaagcctggttcctttcctgcaaatcggactcagagtcacagactcccttgaagcctggttcacacttgccgtggcagcctggttttcaggcccatgaaagacctgctcagcaggtaatctgctgtcaccctggctttcagttttttgactctccttctattcaaaattctacctctttttctgctcctggtccggtcgcaactgctgttgccaatactaccattgccgctcataagcaacaaattacatacatccctgaagatgacactccgcttatgagggctatagttcaagcaagggaatatggggatcctgaaacttggcaatttcctgtaattttacaacctccagtacctgccaccccagcagtacaaaaccacccacagcctgttgttgatcctgcccagcaggcggctgaccccgcagctcaacaagatcaagaggctgataatcaagcccctcagcccgaaactcaggctgctcaggtaaataatcagcctccgcagttgcctgctcctggggcacagccaatacctggcattcccgctgttcaggtggtaattcagcctgaccccatccatccaggccaggttcagctacgccctgctacatgggaaagtttttcttttaaattcctcaaagattttaaagaatcagtgaaacaatatggcaccaactctccttttgtccgttccacattaaaagccttaggagaagataaacgtttggtaccctatgattgggaaattttggcaaaatcaagtcttatctaaatcccaatatttacagttcaggacttggtgggttgatgctgtccaggaacgcatttgtcttagggcactaatcctcctgttaacgttatggctgaccagttactgggaatgggtcaatgggccgcaatccgacaccaaactatactaaatgatgaggttattgaacaactgcgaaaattgttgcttagatgcttgggacaaaattcaagatgatggtaaagtatgcccatctttcacagccgtcagacagggacaacatgagccctacccagactttattactcgtcttcaagacgcagcagaaaaggctattcctgatagccacggccaaagacttgttgtagaacttatggcttatgaacaagcaaatccagatggtcaggcggctgtttgccccgccaaaggtaaaattccaccgggtggtgatatactcacctcctacattaaagcctgtgaaggggtgggaggaactctccatacagcaacgattatggcacaagctatggcctctattcgaatgcctggacaattctctggccaatgcttcatatgcggccagaagggacatgcagaaagaaattgccctcggcgtgcaggtggccgtcctttacatcaccaccaacaacaaaaagaaacttttcagcaacaagacaccccaccttctgctgtatgcccacgaagccaaaagggtcttcactgggcatctcaatgccattccagatttgatattgatggcaatcctgtacggccttttaaaaatcagggaaacgggatgaggggccggccccagccccctctaaacaatggggcattcctcaactctcagccgctggcgtccagccagacaggagccttcccagtttaatccattcaacctccaccccaattcccacttcagcaatttgtgccacaggatctaatgcctcagccccaacaccaatctcagtacaatgcttgtcccccgtcaccacaggctcagcagcagtagatctctgttgtaccagaaatatttcttttgttgcctggagagccacgtattgctgttcctacaggtgtttttggtcccttgccgactggcagtgtcgggttgctactgggacgttcaagtttaaatttaaaaggtgttcaagtacatactggtgtaattgattctgactattcaggtaaaattcatattatcattagctctgcagtcccttggaatgcagcagctggggaccgcattgctcaactcttgatatttccttacattcctttgggatctagttctagtacaagaaagggaggttttggtagcacagattatcaaggtaaagcagcctactgggccagcaaaatttctgacactcgtcctgtgtgctccgtgcatattcagggaaaaaagtttgagggaatgattgacacgggcgctggtgtgtccattatcgctttacatcgatggccccgacactggccaaaggagcatgcctccacagcattcgtgggtgttggtcaggcttcacaggtatatgaaagttccacaattttacattgcacaggcctgaaggacagattggaactattcgccccctcattacacccattcctgttaatttgtggggaagagatcttttatatcaatggggggctcagattacttttcctaaaggcagttacagccagcagagtaaagatatgatgaccaaaatgggatttgttcaaggtctgggtttagaaaaatcagcacaaggcatcactgagcatatcatacctactcctaaagcagactctacaggacttggttattctttttagaagtggtcactatcaagcctccagaacccatccctttgacctggagaacttaaaaacctgtctaggtagatgagtggctgctcccaaaaaataagctggaggcacttcatattttggttcttgaacagttaaaattgggacacattgaaccttctttttctccttggaattcacctgtttttgttattcaaaagaaatctggtaagtggagaatgcttactgatcttagggcagtaaatgctgtccttcagcctatggggacattacaacccagtttgccctcccccagtatgattactgagtattggccacttatcatcattgaccttaaagattgcttttttaccattcctctggcccctcaggactttgaaaaatttgctttcactgttccagcccttaacaacgttgctcctgcagcacgttaccattggaaagtcctacctcaaggtctgctcaatagccccactatttgtcaatattatgtgggatgcatattaaagccagttagagataaatttccccaatgttatattattcattacacagatgatattctttgtgcagcaccttcacgctctgtattaatatcttgtttttctgcattacagcaagtggtcacagcagctggcttggttatcgccccagaaaaaattcacacttcatctccttatcactatttagagatgcagctagaggataaggtcattaagcctcaaaaagttcaactcagacgagactctttaaaaactctaaatgatttccaaaaattatttggagatattaattggattcgtccctccctacgcattcctacttatgctgtgtctaatctttttgcaatattacggggcaatcctgatttacgcagtaaaaggtctttgactcctgaggcagattctaaattacgacttataaaaaaatgcattcaacagtctcaggttaccagagtaaatccacatttaccttttgaagtactaatttttcccactgaacattcaccaacaggactcattattcagggacataatttaattgaattgtgttttctcccacacagctctttacgtacactaactatctagatcaaatttctaccttaattggtcaggctcgttctcgtctccttcgtctttcaggaacagagcctcaaaaaatcgttgttccccttacccgattacaagttcaacaggctttgctacttgcattgcttggcaagtgcatttggcacgtttcccaggtataattgataatcactatcctcatgtaaaattatttcagttccttaaactcacgtcttggattttacgtaacattactagaaacaccccattacctgaagctgtcactgttttcactgatgcttcctctaatggccgagcagcatatacaggacccagagaacgtgttcttaacacaggggctatttcagcacaacgagctgaactgcctgctgttatggctgtccttgaagattttcctgagccagttaacattttctctgactcagcgtatgtcgtacatgttgctcgcaacattgaaactgccttaatcaaatttctgcctgatgataacctattccttctttttcaaaagtttcagtctgtgctcagagcaaggtcttctcctttctacagtactcacattcgggcccacacacccctccccggacccctctcggcagcaaatgccagagctgatacattagttactcccgtttttacagatgcagaaaattttcatgctttaactcacgtcaatgctgcgggactccgaaacaagttcccccttacatggaagcaagctaaaactactgtgcgtcactgtcctacttgtcaagtgttaattttaccaccactgtcttcaggagttaaccctagaggactttcacagaatgctctttggcaaatggatgtgactcattatcctccttttggcaagctttcttttatacatgtaactattgataccttttctcattttatttgggccacttgtgaaacgggcgaaagtacagctcatggtaaacgacatgtgccttcctgtttctcggttatgggctgttctgagaaactaaaaactgataacggccccgcctacactagtgctgcttttaaaaagtttcctcagacatgggcaattactcacacaacgggcattccctataactctggagaacaggccttggttgaacgagccaataaaacactcaaagatcaacttcgtaaacaggatactaaatcaaagggagatgctattactcctcatgcccaattaaatctggctcttttcacactaaatttcttaaacttaacaagaaatcaacctttcacagccgcagaacaacatttcactggaaataaatttgatccacaaaaaggaatgcgggtatggtggaaggacgtaaaaactaacacatgggaattaggcacggtcataacttggggtaggggttttgtttgtgtttccccaggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcgtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatgagtttgtagcaattactttttattccaatattatgataatcctcgctctataatcatagcctaggaaaaaccaggccatacagagataggagctgaggggacatagtgaagtgtgaccagaagacaagagtgcgagccttctgttatgcccggacagggccaccagagggctccttggtctagcggtgacgccagcgtctgggaagacacccgttaccaggcggatcgtggcccagccgtagcaaaaggtgtcaaggaacaccttttgcaaaaggtgtcaacacccgctacttagcagactgggaaaggggggcggtctccctttccccgggggagtttagagaagactctgttcctccacctcttgtggagggcctgacatcagtcaggcttgcccgtagttatccggaggcctaactgtctccctgtgatgctgtgcttcagtggtcacgctcctagtctgccttcattttccatcctgtacacctggctctgccttctagatagcagtagtaaattagtgaaaatactaatagtccctgatatgcagaaataatggcataagctgtctttctctctgtctcctctccctctctgcctcggctgccaggcagggaagggccccctgtccagtggacacatgacccatgtgaccttacctatcattggaggtgactcacattctttaccctgccccttctgccttgtatccaataacagcgcagtcagacattcagggccactaccggtctccgcacattggtggtagtggtcccccgggcccagctgccttttctcttatctcgttgtcttgtgtctttatttctacactctctcatcgccacacacagggagagacccaccgaccctgtggggctggtccctacaagagggaagtggtttgttctgctcttctgagatgtgttcttatgagaaggatccagcagcagcctgcagagatgtggggcctgaaaagaggccttgggcagctcttctcaacaggtcttggccctctagactgccttcagcacagttttggggagaaacagggagtgttcctttttcaatctatgcgctcatcccctgagccgcctgacccagggtttagatgctccagggcagctgattgacaccggtgggagatggagtctggcaagcaggtgatgaactgggaagcgctgcagaaatgagggggcaagcgtggccagtcccttctgagaggatgtgtttggaagagagtgggcactggcgtggcactttccccttctgtggaaatggacttggacaggatgccacgtagtgctgcagttctgtgtggggcaggttgtggctgcagagaagcactgggtgcagaaacagtcccccaagcaggtgcgagggtcagggtgctctatgctgctccacacctgccgtgcgatgacatgtggtcaccgggctgcccagcacagttgtttagaaagcaggttcaaagggcagtgtgctgggaggaagtgctgctgtggaaactgcaagttttggacatgagttgctcaggtcttttcagccgttcattcttctacaacagaattgcattattcacttgctcagtgtgataccatgtcctttaaaaaattatttgaatattgagaacaggttgtatgttccgtctctagctgctagatcacaggcagggcacatcttctcaaagagtaacaaggcatgggttgtgtgtgttctcttctcttagtgaggagaaaggcctgtttgggttcatgatgattgttggggtctcttttctgtacctgatgttggttgcacaaagtccgtttccattctcttagtctagacaattttcctgatatttaaactggaatttttgctccaagaaattccaggtcatttagaatgtgttaagattgagtttctgggctacacatccttataagagcacccgattctggtttctgtttatttatttattttttcgagacagtctcgttctgtcacgcaggctggagtacagtggcatgattttggctcactgcaacctctgcctcatgggttcaagtgattctcgtgcttcaggctcccaagtagctgggattacaggtgcgcaccacctacattatttatttatttaatttatttattgagatgaggtctcactatgttgcccaggctactcaaacttctggtctcaagggatcctcccgcctcggcctcccaaagtgctgggattacaggcatgagccaccgcacacagcctgatttctgtttaaagagttggattatacagggacccacagaattgggaactgacagtactgtagagcctgtgtatgaaaaagatggacaagcctgacattagcagctcactgttgagcacacggccccctgcagaataaacaagtgtgtggtttccatctgatgaaggtgggcatgtagttcctggacagtccagtgacttccatcattccacagacaagatcagatgccctctctaccagccaccgtgctgggaccggcccaatctgtgtttcaaatcagcttgtagcacgcagggattcaaaatatttaaagatgaggtttgaaggtacgtctggagaccaaggacgttagttctggaggtccccgtctcctgcgtgtttgcggagctggtgacagtgccctctccccgtgctggagagggctgaggagaggctgtgtgtctcagcaggatgccagtcaggattcttctggctatgggcttattttttgcaataaattcatcgttaaagtcccattctttaacctgttttttcccttttggaattaattcgactgcagtaggaaggggttgtagctgaaagtgaccgctgtgcattgaatgccatcagaaaaggctgatgagatttgcagggaagacttgaagcctcactgaaatgcgcctggcgtgtgttgacctttgcagtggaacatgtgggaaaggggcccgcactcacttttcagttctgcctcggtgattccaggagccccggggttgggagcggggacaggaccttgctcctgagtcttaggtgtggtgtctctcgccccttgctgcattggcgggaccctcggtgccgcggcctcagttgcagggcggccagggctgctccgtgaaggaggcgctcactccatggagctgcaggacgctgcattctcctcactctggccattgccgctgtccttcctgcttccccttttctggtgagggagggctccaaggacttgctggctggtccccagatgccagcactcctgcatcttcccctcctctcctggcctgtcactttgttcctcctctgtgaggggcccaggctcggatgcccggccacggcctctctttccagcctgtgcggcccaggtgggtccaggatgttccctgctgccctgttctcagcagttcttgtcttcttcaggcttttcctccttgcctagagaaatttccctacatggaaacccctgtggctgtacagtcttttctgaccaatctgctgggttttttgttttttgtttttgagacagaatcttgctctgtcgcccaggctggagtgcattgcagtgaaagtggcaatatctggcatttgtagatggaagctggaactcagtacaggtgggaacgtaagcgcctgtcgttgctgaggtggggcagcagtcagttgccagcgcgtgttcaaacacaggctgattcaacagttcccgttctgggaatttaagatcggaaaataattaaagtgtatgcaaagattttgctactagaatatttgtcacagctttgaaataggggagaactggaaatatcttgaatttccctcaggcagagataggtagaaacattgtggtgaagtctgtgtcgtccctcaggatctgtgggaaattggtcccaggacctctctcagataccagagtcggagggtgctgaagcccttgctctgaagtggtatagtgtttgcatataatctgtgcacaccctcctgtgtactctgtcatcaccagattacatataatgcctaatgtaatgtaaatgctatgtaaatagttgctttactatattctttagggaataatgacaagaaaaaaagtctgtgcatgttcagtacagatgcaatttcttgtttttctaatattttctatccactgttggttgaatccatgcatgtggagtcaacctatggatggggatggcagactgtactctcctgacaggtggttacaaagtatttctatctgaaaagagctggctgcaaagcagcatgcccagtataactttcctcaggcccagggaaaagcttggagggaggttcccacagaaacattagcagtggtttcctgggccagtgggataaggaccaggcattgtgctagcagtggagaaacagtggtgaataaggtaggtctggctctgtctcctggagcttactggactgaagatgaacctttctccactaatttttattctgaaaaatttcaaaactaaagaagagttgaacgcatagtacaatgaatatccctagcctttcacctggattctaccagttgttaaccttttccatatttgcttgtatatgttaccctctcacctccccaaatttttttctattatttttattatttgaaagtaagtcacacacatgatagcatttcaccccagaatccttctccaggtgccttctgagctcagaagctgtctcctctacaacctcatcattatcacatccgagatagaattaacattgcattttctttttttttttttttttgtttttttgagatggaatctcatgctgttgcccaggctggagtgcagtactttgattttggctcattgaaacctccacctcctgggttcaagtgattcacctgcctcagcctcccaagtggctgggactacaagtgtgtaccaccgtgcctggctaatttttgtatttttagtagagatggagttttatcataacatggcattttctaatgcaaaggtgacatgcagccttcctcagtggtccccagtcctcctcaaagtcctttatagagacagttttactctgttgcccaaactggaatgcagtggtgtgatcatagctcactgcagccttgaactcccctgggctcaagccatcccccagccttagcctcctgagttgctgggactacaggcctgtgccgccacacctagctaatcttttttttttttttttttgagatggagtctcaaacttgtcacccagcctggagtgcagtggcacgatcttggctcactgcaacatccgcctcccagtttcacgccattctcctgcctcagcctcctgagtagctgagattacaggcatgcgtcaccatgcctggctaattttgtatttttagtagagacgcgtttccaccatattggccaggctggtcttgaactcctgacctcgtgatccagcctccttggcctcctaaagtgctgggattacaggcgtgagccactgcacccagcctaatttttgtatttttagtagaggcagggtttcaccatgttggtcacgctggtgttgaactcctgacctcacatgatccacccaacttggcctcccaaagtgctgggattagaggcatgagccaccatgcccaatctctgcaccatgcccagtatcccttagtggcccttctgactttacactgcttttccctcctgacagcggggccctgctttcgtggtctgtatcctgcttgagcaaggtgccatgaggcttttcctaggccttgactttgctgtagcttctaaggtgtcctgtggcggcaaaagggacgtgtgctctgtgggtgggtgcagccacctgtagagctgcagctatatccccaggatggttgtgtgactgatggtccttggggagcccagcagtgaggatctcagcagcccacctgtctcagagtccccgctgtgcacccaggcccagggctcagtgagtgagagctctccgacctcggtgggggcggggctaattgaccttcagacccaccgtgtgccagtgctggctggcacacagcactgcttggacttcccctgtgggaaaggatggggacagatcagtctttggaagaatggagcgctggctttgctcagccctgttcttgggaaggtttgatctggagagccgcagcagccagaccctggggaggcaggttagtgagcaggctcccaacttacgagctaggaaggctgacggctgttcatttccccccatgtggacctcatcgggggtccttcctgagggcgagcgctaggttcgtctgcgtttctctctcccagttgggcctgactctggacgccaggctgagggagtacacagctccttcagagcacgggctcagacgctcagatgctcggagcgcttccggctgcttttccatgggtaactcacatgttcttcctgcaggctggcatttgtctttcatggcttttttccatcggtcagaattacagtcttttgattgtatgtacgtacctggttattatcagatatctagtttaaaatgtgcatctgaatatagattttcttggtgaacgcattgcgttctcattccgtaaaaagtcggaagctcaaaatgatgcttaaaaaaaaatcttagcaagctctcctgtgcagatgctgctggcgctgagctttgtgcctggggcagaaagggtgaggacggccccggttggtttaggaaaagtggttatgaacagaacgggccccatgctcctggcctgaggaaatgttgtgtgaaaaagatggcttctacagcttgaagggggacggtccacctgatgctcctgtccctctctgagccccaggggcagaagggaaacagtcaatagcacggccgttgcagatggtgcccatagagggagggtagttagtgtctgagcaggagagggtgaccggcctttgtggggctgcttcagagagccgggcagagtctgggccccaacgtggactagcaggggaggagctctcctggctggggtggcgactcggggaggtctgggttgcctgagcagggaatcggcctccagtgggggaggttctgagtgggacgcgctcttcgtgtgggcctggaggacctctaggcggcctgcactcgcctgatacagctggcttctgctgggaggctgggtttgcatccaaactctgagaccttttggacaaaacatgccaaagaagttggtggtagtaagaaattcatactaaacttgttctgttagggtttttttccttccaggtatattatttcccttcagtagccctacattttaaaagttaacgttcagcgttgagtcagggtcaggttttgaatgacacaggatgttttcagatcctgagtttacctgaagctctcaaagtagcctcctaacaaaaattattgaaaacatcaactattttggaatacttttaggtatgtagaaaaattgcagacgacacagaatttccataatttcccccagccagcttcccctaatgccatgacatgaccgtgatacctctgtcactctgtcgaaactgaggtgttcgcgctggcaccacactactcaccgagcgacaggcctgttttggattttatcagttttcctcctgatgtccttgctgtcccaggaccccgccccggtgccacatcgcatcgcgttgtcctgtctcattcgccccctctggtgtaggatagctgccgtccttccttgtttgtcatcagcttggtacttttgaggagtcctggtcaggtattttgcagaatgtgccttcatttgggtttgtttgatgtcttgtggttggacaggttgtggggttaggaagaatcccacagagatgaggtgcccttagtgcgtcgtattggggtacaggacatccacgtgactcatcgctggtgacgttcaacaaaattacttacaaaacttttaaaaaattattattgtttgctttagagatgagctctcgctctgtcatccaggctggagtgcagtggtgggatcatagctcactgcagtctccaactcctgggctcaagcgacccccccacctcagcctcctgagtagctggggctacaggtacgtgccactgtgtctggcaaaattagttttactttaccaaaaggaagcacataggcctgctctgctctctgctacttgggggttttgtgtcatagattgtaggacactggtggtaatttaatttcagaagggaccttcttgctcacccagttggatccttccagtttctagatgaagacacttgggacctggaggccttctgacttttgggtcagagctggcatggagtccaggcacctgctttctgcaggcatgcatgctcctgggacactctgcagggacagagccatccccagcaaggcagactgacagggctggtttccagtcgggtggggccgcatccctccaggggatgtgaggcaggtttgagatgagtctgctccccttctgcctgctgctcctgtctttttttttctttttctttttcttttctttttttttttttgagacggagtctcgctctgtttccaaggctggagtgcagtggcgcgatctcagctcactgcaacctctgcctcccaggttcaagtggtactcctgcctcagcctcccaagtagctgagactacaggcatgcgcccccacacctggcttattttgcgtttttagtagagacagggtttctccatgttggtcaggctggtctccaattcctgacctcaggtgatcctcccaaagtgctgggatcacaggcgtgagccaccgcaactggcctaggagtaacttcttaatgaatattttaataatataaatcttagtctgaatttctgactgtgtcgcctagatgccatgtaggggaatgggcaggtcagagggtgtggcctgcgctgtggcgaggcactgaggattaggtgctgcagttttcctccggcccctcctggttccctggtgaacacacatcagcctcagatgggcgaccccctactcatgggagggctgggagtgtgggccttgtagttggattctgcttcagaattgcgtgtgacctcactgtggagtgtttgactggacaaaagcctgctgtatactcagtgtccccatctgtagaaaggatgccgatggtacccacccccagagttgttttgaggactaaccacgataatacatgtaaaatgctcagaagaatgtgtggcaaacagcaagcacttaataaattttttttttagtagagaaaaatggcattttatttattttaaacaacagcatttaaagttatacctataaggggcacacagaagatatatggagagtttaaagaatgaaaataaactcacacgtgcccaccaccctacttgaaaaacaggattttaccagaaggctcgagtggccctccagattgtagtttctggcccctcccgttcagaggtaactggcatcctggttttcatgttgatcagtggtgtttaaagtacacctgtaggaagttccaaagtgcaggaagggaacaaagcctccttgcagagaaatcttgtactttggtgtttcatcatctgtttgtgtgacaaatatacaacgttaatgttgaagatgtgggttagtgaaattgagacctggcgcttcctgaggctggcagcccggttgagcctgaggaccagacttgaggcagttggcagtccgcgcctcgttgccctctgtctgccctgggtaagtgagaggctccttgggaggccagtggagatggctgtgggaggacagattgagtagctgtccttggagctgctcctccctcccttcgtggagaaatagaaacagctttcctccggccctcacctgttgccagggctccacgctggtgggggcgagctgcgttttgctgagttgcaccgtgggagagcgttggtgaccacttgcctgctgtgggccagctccccgtggccaaggaccagcgtgggcagggccttcgggcacgggttgctggtacgagcacaccgagaatcccctccgccatagggcctgccctgtgagctgcccaccagattccacggagtgcttcacactcctgtctggtgtgggtcccgcagcccttgtgggtgggcccatgtcattagcctcattttagagaagagtcttgatgggtcggagagcggtggcttacccacaggtaagctgtaaatctggaactcaactggggcattggttttgctagtccaccacagttgtccttggtggtggcagcctgaggggtaggggaaggtggcggctgtccctccctaacacccccttcctccacctggttttctgtgctgggcctagctttgtggagttttctgaggtgagaggaggtttttaccagaatgctctttgccagtgagcacagctgacctgagggcaggatccctttggagatgagctaggtggattgtggcagcctcccacaactttggtccgggggcctggagagagcagttcctgcttgccgcgtgtgagagtgtgcgggcgctggctctacctgtcgcactgcattcccaggctccagagcacacactgccatttaaag

SEQ ID NO: 5704 - DNA, 8693 bp, Homo sapiens
aaaccgcagttcgccgccgccgccgccgggcacccagccccaggggggcgggctggagggagggggcgggcgctggccgggggacccccgcaaccatggcgggcggggagtgggctgccgagccgcttcacctgccgcagagggggcggccggcgccgcttcacctgccggagcgggaggccaccgaggcgaggccgaggcggcggcgcgctcggcggcgcctccgggtcctagaaccgcatcctcccgctcgcctcgggcgagggattggccgggtctgggtgaaggggatcacggcctggggattggaggggcacatcttctccgcaccgaggatctcagcgactgcgagcacggctcggagacccacggtggtgcagcgttggggcgccagggctgcgttcccgtctcgcgtcccggactgagaaggtgggaacccccttccaggccccccaccttttatttctctcctcccctgcttagcccagagacgagctgaggacgagggggagccatctccaaacaggaactcctaaacagggtggggggcgcggacgcaggccagtggagacccccgccacctgtcccacctcgaccaaccgtgcgcctgtgcagggcacccctacaggttttagaatgggggcacctatggaatatggcaggctgcgagaagctgggcccgccaaggtggtcccaaggaggagtggggggttgcggaaaggaggatgagagccagccacaaggctggaaaaggagtgggcaccgcagaggagggaaaaagaatcttgacactgtcaccgccagggatctaggggggcctcttaccttggagaataacaatctctgatgtctgctaattacagaaatactttcagagctctttcattcatcctgacaatggccagagaaggtaggtattggtagccttattttagagatggggaaactgaggctgagagtaggtaagtaagctgtccaagggcactcagctaacaaaggacagaagcaagcctcctcactgtctacctccaaaacctacactggcttggagttgctgtcctggccctccactgcccatctcatgtaggacgggagagtatggggggctggggtcccatctatagcctgaatttgagactttcagttgctcctctcattccccatttaatttgtggggatccccaactgacccctccctacacttccagggcactgaggagggagggcccgctgaaggagccccgaattatctctaggccaggtcaggagccattagtgtcccctcccctgacagcatcctcctccttctgccctcacattcagagccactgacaagactttaagcaagagacggagagttaacatctaatctggaggaagaccctggaaggagccagccccttcccccaggctgacctggtttaagcctttcttctgccaaggtcaccagcaccccagatgggtgagagatgtgatcactggtttcgtggcctgaccaaggacctccaaggtgagtcaaagcagaattctccttgggcatgcagggaaaatgatccattccctgcacactgccatattctccttctcagacagaccagagccttgcccttgggtccttgcccttgagattagctaggacctcctcctcttcttctccttctttcttcttcttcttgtctctataagataactgtcgtggaagacttttttttttcttttaagatggagtctctcgctgttgcccaggctggagtgcagtggctcggtctcagctcactgcaacctccacctcccaggtccaagcaattatccagtctcagcctcctcagtagctgggaccacaggtgcgtgccaccacacccagctcatttttgtatttttagtagagacggggttttgctatgttgaccaagctggtctcgaactcctgacctcaagtgatccgcctgcctcggcctcccaaagtgctgggattacaggcatgaggcaccccgtccagcctggaagacttttttttttaatgaataaaaacacatttttttaaagaatggattccctgattcctcaatggctgtctctttcaattgaacaataaacctttacttagcatcagctacatgcccatcactgtgcttggtcctgcagattctgtggcagatgagaaatgccttggtccttgggctgcttgcagcctagcgagggacagacttttaacctctctaggagagtggctgcttcaagtcatcctatgggaccagctgttcatgcttcctcttgcccagaactacttctgtgagaggaaaagagaagggtaggagcgtgccctgcagctggaaacccaagccaggcggggagccacgaatgcagtagttatcagactgtatcttcaatcctgggggcttctcaagccattgccagccactcttcacccaaggcctggtggaataaagctgggctaagtaacacctcttctgtggaaaattattgtttctgcaagcctatattcattctccctctctctcatgctgatcagaactgtgagttacaaaaaaaatgagaagatggaatcaattattacgtagtaaatttcatttgcttggcaggaggtatctttcccatcttggcccacagaggaggaaatcctagaagggatgactgaagcttgggactaacacattggtggatctgtgctaccccctgctggccgtagacggtatgacagccaagatagggcaaggcttcgaggggcgatggatggattcaccgcagcggcgacatttctggactgttgtcaccttcagtgcagtcactgggaatattcagaacccaggtgattgataaggttttcccagggatctcttctctccccttcaccattactcagtaggagcttccttaaaaacggaaaacgagaggccgggcgcggtggctcacgcctgtaatcccagcactttgggaggcggaggcgggcggatcacgaggtcaggagatcgagaccatcctggctaacacaaccccgtctctacttaaaatacaaaaaattagccgggcgtggtggcacgcgcctgtagttccagctactcaggaggctgaggcaggagaatcgcttgaacccgggaggcagaggaggttgcagtgagctgagatggcgccactgcactccagcctggccgactgagactccatctcaaaaaaaaaaaaaaaaaaaggaaaaaggggccgggcgcggtggctcacgtctataatcctagcactttgggagaccaaggcgggcagatcacgaggtcaggaatttgagactagtgtggccaacatggtgaaaccccatctctactaaaaatacaaaaaattagccgggtgtggtggcgcatgcctgtaatcctagctactcgggaggccgaggcaggagaatcgcttgaacccaggaggccgaggttgcagtgagccgagatcacgccattgcactccagcctgggcgacagagcaagactccgtcttgagggaaaaaaaaaaaaaaaagaaaaaggggccaggcacctgtaatcccagcactttgggaggctgaggagggaagatcgctaaaacccaggagttcaagaccagcctgggcaacatggtgagaccccatctctacaaaaaatgcaaaaaaaaaaaaaacaaaaacaaaaaaaaaaacagctgggcatgatggtgcgcacctgtagtcccagctactcgggaggctgaggtgggaggattatttgagcctgagaggtcaaggctgcagtgagccaagatcgcatcactgcactctagcctgggtaacagagcaagaccctgcctcaaaaaaaaaaaaaaaaaaggaaaaaggttattacacagttcaaaagagaaacaaagtgcaaaagcatgtgcaaagaaagtaaagtccctcctggccaagtgcgatggctcaagcctgtaatctcaacaccctgggaggctgaagtgggtagatcatttgaggtctggagtttgagaccagcctggccaacatggtgaaaccccgtctctactaaaaatataaaaattagcttggcgtagtggcgggtgcctgtaatcccaggtactcgggaggctgaggcaggagaatcacttgaacttgggaggcggagggtgccgcgagccaagatcacgccagtgcactctagcctgggcaacagagcaagactccatctcgaaggaaggaaggaaggaaggaaggaaggaaggaaggaaggaaggaaggaaggaaggaaggggaaagaaaggaaagatctcttgccaatcagcctccctgttgccctgtttcccattccctccccagaggcaaccactcttaacagtttttttgtttttgtttttgtttttttttagacagagtctcactctgttgcccaggcggctggagtgcagtggtgtgatctcagctcactgcgacctccgcttcccagattcaagcaattctcctgcctcagcctcctgagtagctgggactacaggtgtgtgccaccacgttcagctaatttttgtatttttagtagagacggggtttcaccatgttggccaggctggtcttgaactcctgacctcaagtgatccacccgccttggcctcccaaagtgctgggattacaggtgtgagccaccgcgcctggcctcttaacagttctaatgtatctttgcagagctatttggagcatatgctgtgtatatgtgcgtgtgtgtgtgacacaaatgatagcacacgctctacactgttcagcacctgctattttcatgtcataatatacctgcctgtagatagtcaacatagttttccatcgtatggtgtgtcacaatttatttaccattcccctcctagtggatatttatgtatgtccgccttttattactacaaacaatgctaattacaggaaatatcttggtacatatatttgcagacatatgtgtgtgtgtgaaataaatttataagtatggcaattctgggtcaaagattatgtgctcttaaatgttttataggttttcacagaattgccctccaaaaattttgtaccaatttacaatccccaacaacggatgagatcacctgtttccccaaatcctcacaaacaggttaatatcaggccttttgatcttaggtgatgactctttaaaagtcctgctcacagagcagttgatgatctgtctttttctttgggccgcgggtttctccaaggaagggactgtgtctttctcatacctacatccccagtgaaggacttgacaccatccttgggagttactcaagaagtgtctgctaaatattgagtgaaagaaacagagctgcattttggcaggctgggagggagagggtaaaaggttaggtttgaacaggaggcctgctttttttttttttttttgagatggagtctcactctgttgcccaggctggagtgcagtggcgcgatctcagctcactgcaacctccaaggaggactgctctttagggccactttctcttccagaccctggtcaagcctctgccccaaatccaaaagccttcctcttgcaggagcctcccaggttgcaaggtctgaggttgaaggcccagaactcccagtgcagctttcacccagctctgctgcattccagggatgggccccatcatccccaagctgcctgagaactggaaacaaactaggtgtccagctttaggggatcagttaaaccactgtcctatagaactttctgcaatgatgaaaatgttctctatctgccctgtccaatatggcagccactggccactcgtagctaccgagtattcaagctgtagctagttcaactaaggaaataaataaatgttacttaattttaattaatttccatttaagtagccatgtgtggctacatattggacagtgaagggttcagtaaattatgatatagccccacaatggaaaactatgcagctgtaaaaaaaaaaaataataaggatgccaagaaaaatggaaagatcttcaggatatattttgaaacaaaaatgtggtacaggctgtgtgcagtggctcacgccaataatcccagcactttgggaggccaaggtgagaggccgaggcaggaggatcacttgagtccaggggttcaagaccagcctggtcaacataatgagacttccgtctctacagaaagtgaaaaaaaaaaaaaagacagcatggtggtatatgaatgtagtcccatctactcaggaagctgaggtgggaggattgcttgagccagggaagttgaggctgcagtaagctgtgattgtgccaccacactccagcctgtgtgacagagcaagaccccatctaaaaaaaaaaaaaaaggccaggcacgatggctcacacatgtaatcccagcactttgggaggccgaggaccgtggatcacctgaggttgggagctcaagaccagcctgaccaacatagagaaacctcatctctactaaaaacacaaaattagctgggtgtggtggcacatgcctataatcccagctactcagaagactgaggcagaagaaccacttgaacccaggaggcggaggttgcggtgagccaagatagtgccattgcacttcagcctgggtaacaagagcgaaactctgtctcaaaaaaaaaaatgtggttcagaacagtatacatagtatgtcatcttttttgaaagaaaggcaggtaggccgggcgcagtggctcacacctgtaatcccagcactttgggaggccgaggtgggcggatcacgaggtcaggagattgagaccatcctggctaacgcggtgaaaccctgtctctactaaaaatacaaaaaattagccgggcgtaggtggtgcactcctgtagtcccagctactcgggaggctgaggcaggagaatggcgtaaaacccgggaggctgagcttgcagtgagccaagatcgcgccactgtacttcagcctgggagacagagcgagattccgtctcaaaaaataaaaaaaaaagaaaaagaaaggcaggtagaggaggctggatgtggtggctcatgcctgtaataccagcactttgggaggccaagggggacagatcacttgcagaaatgtgagaccggcctggacaacatggtgaaaccccatctctacacaaaatacaaaaattagttggacgtggtagtgcgcacctgtagtcccagctactcaggaggctaaagtgggagggttgcttgagctggggaagtcaaggctgcagtgagccaagattgcaccactgcactccagcaggggtgacagagggagacagcaggagtgacagagtgagaccctgtctcaaaaaaaaaaagaaaagagctttgcacagtggtagtatcgtagccaatgaatgaaagggaggtggaaataaaaataaatgtttatatttgcttgaatttgcatagggaaagcaataacagtgggtgacctatagggagctggggaatcctgttgcgggggtaggcaaggacagggtgggaacagagctttccagtgaatttctttatatttcattttggttgttgaaacatgtacatatattacctattcaaaaagttaaattaaggtcaggtgcagtggctcatgcccgtaatcccagtactttgggaggttgaggtaggaggatcactttaccccaggagttggagaccagcctgggcaatatagtgagacctcctttctacaaaaagtttacaaattagccataagccaggtgcggtggctcacacctgtaatcccagcactttgggaggcggaggcaggcagatcacttgaggtcaggagtccgagaccagcctggccaacatggtgaaacctcatctctactaaaaatacaaaaattagctgggaatggcagcaggtgcctataatcccaactacttgggaggctgagacaggagaatcgcttgagcccgggaggcagaggctacagtgagtcaagatcacgccactacactacactccagcctgggcaacagagcaagactccgtctcaaaaaaaaaaaaattagccatatacggtgacacgctcctgtagtcccagatacttgggaggctgagatgggaaagtcacttgagccagggaagttgaggctgcagagagccaagatcgcgccactgctctcctgcctgtgcgacacagtgagactatgtctcaaaaaaatgaaaaggtggctgggcacaaggctcacacctgtaatcccagcactttgggagactgaggcaggcagatcacttgaggccatgagttcgagaccagactggctaacatggtaaaaccccatctctactaaaaatacaaaaattatctgggtgtggcagtgtgtgcctgtagtcccagctactagagaggctgaggcagaagaatcacttgaacccgggaggcagaggttgcagcgagccgaaattgtactactgcactccagcctgggtggcaaagcgagactccctctcaaaaaaaaaaaaagtaaattaaaattaaagcaaattgcttgctatttaaccacgagggctgctctctccctcttcttggcaactcgtgatagtcactacgttatcctttcttttttttttttttttttttgagacaaagccttgttctgtcgcccagactggagtgcagtggtgtgatctcagctcactgcaacctccgcctcctgggttaaagcaattcttctgcc

SEQ ID NO: 5705 - DNA, 5021 bp, Homo sapiens
cttggctggcgggggagggggtctccccgggctctacctcccgcggccgggactaccctcagagccgcgaccgccgcggcgtgcgtcccgggcctgcaaaactgtttccaaactgcccgggccggaggcgggcgcgcggggcccggggagatggctggggtctggggggccgagggtgtgtgtggacgctgggagccgcggggggaggccggcgtcgactcagaggagttgcaatcgaggtatctgcgctccggcttcctcctgcggcccgcgaccccctccccggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggccaatcagcgcgcggcttccattttgtgagttcaactccgaggctcccgggcttcgcgaggacgcgtttgcagccccctctgccgctcctctctggcggccgaggcgcaggagccgcctcgccggggctcggagctggtgtagctcatattggggctcttttcggggtttgtaatttggccgtgggtaggtaattggctggagcagggcggcagggcgcggcagccaatcagcgcgcggcttctatagggcttgagttattagacgctgatctcaaaacatccttcatcagacacgaaggagaggccaacagatgagggaagccatttttctgcaatggaattaaatggccaagcccaaggactcacagttggaagactggagaagactttttaaaaagatctggatttttccttatgacttggaatccatctttgtcttgtataactaggtcatagcacaccattcatgtcagcagttaacagttttgaattccaaaaaaacctaaagcagtaaacagtcctcagcgaagccgcctttttgcctacccaaccctggaaagtttgcagaagtggaaggagcagaacgtgagggtgtaacttacaaaaaggtaataagaacaaagacaccaccataacccccaaatttcccaactaaatcaaaaaatatatatgtttttacaataacgtctccaaaaccaccgcccagcttgatcttctagactccatggcaccgggctgagcgggtaagtaagaaagataaaaagtgccttttgccccttcgaggaaacccttttgcaggccaagcaagggctgcaagtgtttgggagctgagaggagaaggaggattctggagcattgtatttggcagccggagcgggcagtgggcggggggttgggacacgaagggctcttcggacccctgtgcctcttctgccccaagggcgagaagacgggcttcgcagcgaccctcgggggtccatggagccgcctgccttcgccccctcgctcttcccaggtctgaacctggatggggagaagaaattgaagtgctttggagacgggggggcttaaaacactagggagcctcatcgcccagccttgggcccactttcctttcgatcgtgaggattccgcaccccgaagccggcttctcggggctccggggcgcgcctgcgctggcaacgcgaaggaggacaaaaggccggcgtccatgttggcaccatgacgcagcatctccgcccgcagcccggagctgctgtcctcccggccgcgctcgctcctcctcccaaacaccagttttctttacaggcttcgagcccgtcgcggctgggccgggctggtctggcaggcgggcccagccgggcagggctgctttgctaatggcggcggctctctttccttccttcctcctttcctccgtccccccggtcgtggggagcccggagcaggaggcgggcccgcggccaggtcgggccccgagagcccgcggggcgcagcgctggcgaccgggtgtcgggggccgtttcgggggccgtgggcctcgggggcgtcgcgcgccgcgcctcccgcgctcgcctcagccgggcgcggcggcctgatgggcgccatttcgcgcgctgcccgtggctggggcggtggcggccgccgcgcgccgggcgggaggagcggcaggggtagggggctgggcgacccggcggcccacgcgggcaccaggaggcctcgccccggaccgcttccctctttcgtctttgtcctgcgcgggcgcccgcagccgagggccacggggtcggcggggcttcgaggccgccccgggtcccaccggctcctccggaagccgcggaccggcctggccctgaccccaggccgccccccgctgcccacccagctctgggcgcccaggtccgacctcccagtcgccctctgagagccgagtcagcgcggggcggggggtcgccccctttgtcctcactcagggcgggaggccctcggggtggccgcagacgccccgttgggcagccctccagcccagctctccaggcaggaggtgggggaagcctgggaaagcggagggggggccccgggatcccccgaggcgcggggctcccggcgaagcctcagatctccggcccttcccggggagggtgcgggcggggcgggcctttggaaatgcagatgagccgccgcccgggccggggttgaaccttctgactcagccacccccggccgcccgggccgctgggggaggggcggcgtctggggtgctccctttcagccccggagcccgtctgctgtgtattcggccggtcacatctctctcccccaacgccctgatccgccctccaccttcctctcctccaggttctgggccggagaaggggcgacgttcgggcaccccccgaatggacaatctttccttctgtcaacggcaggggcaggcctagtttgactctgacagtcctcccactaaggtaggtgtgagtacttgcccagaccgtgagggagatttggggggctctggcctgcagcccagggagggccgaaccccaaacacgccgggctggttctgcggccccgccccaccccacccccccccccccagctgcgagcgcgtagggccgcctgctgggccgccggggccatccatccccgtctgtcagcttctgttgtcaggcatttggggcgtgtaagtctctgccgaatatagcagcatacgagaggatccacttgcaagtatttcccagttgtgtgttcttcggcggggggagggccctgggtgccgcctacttctgaaagacacaggtcactgtcagaaagcccaactgtgctgtggccttccctccagccgcccccgtggggcatgtggggtgacagtgtgagccgtcctctgatgtctggctgctagagaggcaaagaacagagacccgaggttccggccacctttctctatgaaagggccttccttgacgcttctccaccttcctgggattgttttcttctccagtccccgaatgggcaggcctgtatataagccttgtttctagaaccagacaaagctggatttgaaacctggcgagccattgaacagctatggccttgcgtaagcggtatagcctccaagcctatttctccatctccgaaaacagggctagatcagtggttcttagtctggaaccggcatcagaatcacaccggaaggggggctcactgaaaatggaccaccgggcctggtgcccaagtgtctgattcagtgggttggtccttaggactggcatttctaacaagttcccaggtgaggtgaggctgatgctgtggtctgggaacacattttgagactccagcccctagcctggtaacacctggggttttgacgcagaagtgccacgttccacgcttggcacatagtaattgatttcattctaacgctagccgacttcatgtattgaatagtttcccatctcagtgtctaagaagctccacagctggagatggcggcccttggtctcggagcccccctccttgtgatttctgctttgtgattgctttgatgaaccatttgggtccaggtgctcctgatcacaccacctcccctatttgggacttgtgccccactcccgctgtgagggctacaccgagctctgggggcctgttcggattaacaaggagatcttgctaaaggtatcttggtgctaagttaagggagatagttcgccatgggctaggatctctcagtgctggtgaccttgggtgagtgtctccctgtaaagtgataaggatgcctgctggaaagggtggtgggaggattaagtgcgttaaagaggccctcctcccaagcttttagttggcctccattgtgatcgtggttattgctgggagtggctgcagggggtgggggctgggctgcctcagagcttccccccgcaccagcccacctgctgaagcacgtgtccctgcctcagggcaaaggggaatctggcgctccctgggaaggcggccaacgcggttctcctctggagtggttgagtccagctgcaggcctttccccatccacaggggctgttccatgatggggtcaagatttgggtcacccacccatggtccggggagaagtgactccccaaggtcacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtaactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacctgataaaaattgaggttcacattgttaatatcccaaaagc

SEQ ID NO: 5706 - DNA, 422 bp, Homo sapiens
tcgctgcagccccatctaccacatcttcatgtggacattgagattcacatgctggctcctgaagggtgctcagtctccttggtgattaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagca

SEQ ID NO: 5707 - DNA, 1457 bp, Homo sapiens
ctttggtgtagtcctgaagcttcctaagaaagttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctgcccgcccagtttgagaattggtgtaagacatcacaatcccattattcagagcgcgtatggagtggaaacgcttatagggtttcaccaggatccacctctgatgttcagtgaagagtaccagaaaagtctgctagagcagtaccatctgggtctggatcaaaaacgcagaaaatacgtggttggagagctcatctggaattttgccgatttcatgactaaccagtgtaagtggcagtttagcgcatgggataatgtacccgtcctcattttttcaggttgccttgcccattctggacattttggctgtaagaatattggaaacaaagggggaaagctggtttattccatgtaggttgcgttgagaatttcctaggaaaagtaagttgtgcttaggaagtaggaaagcagccaggcccccgcttcccacatacagtcaaaaagcaagcatgagagtctgctatagtgagatggaaatggctagcttgcctttttcttgtctatttcatagccaaggaggaaggaaaaactggacctcattatgaatttacttttgggatacactcattattccagaggagggtaaaaggctgagaagcttaaggtatttcagtctgttttatgttactcatttgcgaaaagcaggctcatcgaatacaggtgagtttcaacgtgtcttgaatatggcagcatttaaaagtcttcagaccaggcatggtggctcatgcctgtcatcccagcactttgggaggccgaggcaggcagatcatgaggtcaggagatcgagaccatcccggctaacagtgaaaccctgtctctactgaaaatacaaaaaaaatcagccgggcgtggtggcaggcgcctgtagtcccagctgctcgggaggctgaggcaggagaatggcgtgaacccaggagttggagcttgcagtgagccgagattgtgccactgcactccagcctgggcgacagtgagactgcttctcaaaaaaaaaaaaaaaaaaaaa

SEQ ID NO: 5708 - DNA, 3706 bp, Homo sapiens
cattcagcaattcagtttaatctcaggatactcagagcaggacaacaaagcctggtctgagcccatgggcctctctctgggggctgcacggagacgtttgcagccccgggtgcaacaccacatagtcacgcatccctcccaggagcatcctcatcaattcaaggagacacatggggactcggggcctagtgcagcttctgagccccttcctggaaaacatctctatgctccttgcccccatggagactgggcccctatctctgggatctgtggtggggctgggctggggccctctttgtaaaccataggaaactcagaataaagacccattgtccagggacagtcactgcagaactggtctgtgcccctggcggacttggagtgtctctggggcaggactggccttgggccccagctccttggttgggggtacacagtcaacctgtcattgtcagctagttgtgcccaggaaggctatattccctgcccaagtgcagttaccgcccggagcaaagcctgggacagctggtgtgctaccctacccccccagcgcccaccgatcagtgacaacagctcagcagaccctagtatatgggccctcctgcagcagcactggcatgggggtccagttctgcccctcgcaggacctctgggccctgaagtgtcagaaactcaggcaatcaaagcgccggacacttgaggtttggaaggggcctccagagtcatccagtccagctccccaactcccctccaccagctgtcaagaggtagcccagactctgcttgttcatccccgagacagagggctcacacctcttggaggcagcatcctccctggggctgctatctggggccgggggagggctgtggcagcaggtttggcttgatggatggagaccgaggggtacaaggtataacgtttccttccatctctccaagggaggcctctcagctccatggggaggtgagctgggagggtgggaaaggggaaagggagtaggtagagcaggaggccagagggtcagagccaccccaggagcctcggctggccccggcctaggctgcgctgatgtcatcgtagtcatcgttgtcggtggagtcaggctgagggctgggggaccctgtgggcagagaggcccagattagtgggagacccagtcattgccctgctgccccacaggacggagctgagtggttctggctccacatcactatccccgtgggatgctgcatgaagccatctgatcatcttgcttccggccatgtccctgactagaacatcagcactgagggaatagcctcgtctgtctggttcagggctatggtctccacaatggcacactgcacgacacggtggacgattgaatgttggaagcccctctgctaccacagtctcccccaaggagccaaccagctgcttctgcttgaatgcctccactgacagggagctcacttcttatcaaagcaacctgtttgactatttctccatcccgtccacatccattttccccacctcttcatattcttgttgtgcttgtgtttgttttcttgtagaaagagggtcttgctctgaccctgcaggggcatgatacacagtgatacgatcatagctcactgcagcctggatctcctgggctcacacgatcctcccacctcagcctcctgaggagctgggactataggcacgtgctacccttggctaatatttagtttttagttttgtagagactggtcttgctatgttcccggggctagtcgtaaattcctggcctcaagcaatcctcctgccttgtgctgggattacaggcttgagctaccatgcctggccttgctttgttttttaaaaagttactttccctctcttcttttacccttcctttctccttttccccttgagcgaatgcatccaatagttccccactcatttactccccagtccctctctgtccccctcccacatcccttccccagatattggcacctggacagccaaactgctcctccgaagggggctggggtggtggctggaagttctggtaccactccccggatgaggtgctggagctgtcatcagccgggggccctgctgaaaaggctggctgggtgccggccagctccaagtttgggggctgctccaggaaggaactcctctctgaagaaaacacctgggggttccatggaggcagcttgcttttgggactattgcagtaatcctcccctgaagaggtgctcgactcactgttgctcctcgggtgatactgagggcccagggatggcgggtctgtaatgcagtgtccagggttggcagttgggatgtgggaggcatgcaactcttcaagtcctaaggcaggaaagggagaatggtgacgaaagaagcagtgcagcaagagggctttaagtcagacttcagaaagcacttactgcctataggatttgtgaaagtcaggaaagactcattgagggaggttcctgctggaaggtctcaagctgagctgagctactctctggaggtgggactgccattcacaccccttcccatcctgactcaccttcctccaagggtggcatctggaacctgctttgctggacctcctcatctgtgacccgatgccgctgggaatctgcaagcagaggcggtggtggggaggggtgaaggctcaacctcatcatttaggagcctggagaagaggctggatttcccggggcctgggtaggctgaatagggtgggaggacaactccggaggcagagagggcttagcatttcccatcaaattccaggttcatatcccaatccagcagagccttcgccttaatctagcctggggacagaaactctagtgccctacaaccccccagcccccagccccagctgtccctcctgctacttagagaggtatcaagagtcttggttctgtccttgtgacctggcagctctgggcaggagaaggacagatgtttgctccttcaagaagccttcctagagtgaaacccagatggtctggaatcactgcatcacaggctctgtggcaccttcacgtttcagaatcagagatttatagagtcttgaggatatgagtgtctgggatcttggagtcagctcttttgaaccgggtaccactgacttttaatttcaatgttatagcactgtggactctcagtcttgcatcttatatgcctgggctcggaatctcaggttttcgttctgggtgctgggttgtgagcgggaatctgtggccatctccagcatcccatcgttcccttgcccttgcctggaatgtggacatggaggtgagccattctggaccatgtagatgaaggcaacatcttagggactgcacagcagcaagaaagaaggggcctgggcccctgccaacctctcaagacactgtcatttggagctttctgtcacacacagccaaattctcatcctgactgataacattaggtgtggggaggggctcaggaatttttgacaagctcccaagtgattccacaataaggtgtgggacgctctggtctattccaacctcccagcattgccagggaactgccttcagcgttatctttcctcttcctatccccagaaggcaatgaaaagagctggctatgaggcacaagctggcaagagcgtggaggtgaggaagtgagtggggctgatggggtcagacagggcaggatgggacacggagggatatggcatgcgag

SEQ ID NO: 5709 - DNA, 582 bp, Homo sapiens
aaagcacggactcattcatcacatacacgcagcacggctaagggccccgcacagtggcgaggtctctgctcccgggacgctcgcgccggccacacaacgctaggctgactcctggtgcctcctctaggcccggtgggacctgaggacttccttagcgcaacgtctcactgaatgacagccacaaccaccgctgtccaggcgaggagtttccaggactgagaggctggcactaggccactgctgggaggacgtctgtgaaaccaggtgcccctgagagccactgtccccagcccgactccgacgctggactggcgagagggtgcgcccgtggcgtagctcctggccgccgccgctcccgggaagggcccagaggcaacatcctggacagcagagctgcacgaagtccgaggcgccgcgagcccagacagtagttggggtgtccccagcgggaaggagaaggaggctgtctggaaggaggagaaccaagaatgcacaaaggcctggcagtgggcagtcagcgttagggaagaaggtgaaggagcagagaaaagggggaagggccacggcaggtggggacccaac

SEQ ID NO: 5710 - DNA, 813 bp, Homo sapiens
cctcatggaggacgcgccccgctccggctcccggccgcccgcccccccgcccccgctccaggcccgggccctcccggttgcgtcatccaggcagacgcggcctcgcgccccgggggagattttcacaatcgcgcagccggcagcgccagcagccatttgctgcgcagggtaaacaggccccaaagttgcctccattttgcacggcccccaaaccgcggcaccgccagcaccgcggcccaacctcccgatccggggctgagcgacgcccacctcgggggacgcagtcgggaaagctcgaccgagaccccgcgggctcccccacaaccgcagctggcacccgcgcccccggaagcgggacgcgtcttcccgggaagcggcgggggtcttcccagggcgctgccgggctgtcggagtgcgccacccccagctccccggcggcccccgcggagaagccctgggtgccgtctacgtgcgcggcctcgcccggcgcgtcccgggccatccagaccgactcgctcaggggcgaaaaacggggcccacgaggtccgtcgcgtgcaggggccacatcgaggcaacagggacccgcgggagctcgtccaccgcaaagcgctccccgctcccgcagcgcacgctcgacggccgggaccgaaaagtgcagattcaccagccccgcgggccctgcctgtccgcggaccagccccccaaggccgaccccgcccccaaccagattgccccatcctgcgcctcccaaatccgacccgaccgcacacccttcctccaaaccgaattcccagtctgcgccccgcaaatcca

SEQ ID NO: 5711 - DNA, 2198 bp, Homo sapiens
cacggactcatccaaggcccgcgtcactcaggcctcttccacaactcaccctgctgaggccacggggcctctgtgttggcagcctcctgagtgctgccaaccccacctcatgctctcagcctcagctcagcctgccggttctgcctggagcactctccccacatctgtgtggctccccactgactggatgggccctgcctcgatcaacagactggacacaaccagccgcctccaccccctcctcctcacctcctgtgaggtttgcttccgtagacctctcctccccacacgccgggcacctgtgcacttcactggctgaagtctcccaagaacacaggacacagcctggcccatcacaggcactcactgagtttgtgttgaatggacttgggtgagcatggtcaccatctgtagcaaggaccatgcttcctacctctgaccttcacaactgcactaagtcgcacagcttgaaagatgatgcaactacggctcagcccgccctaaactgacagctggagagaacctcatagacgctcttgtctgagccccttgaacgtcaggtgtgaggccgcagtggtgtggagacaacaccatcacacccgtgtgtgtgtgtgtaagagcccagagctgggcccagcccatgccacagcagtacacaacgaggcccgaaagcggtctgtgagccaggcactgagcgtgacaggggacagcctagcacgcaggcagatggcacaggaaggggtgaaagaactgctgttcgggtcaggcacggtggctcacgcctgtaatcccagcactttgggaggccaggagggcggatcacctgaggtcagaagttcgggatcagatcctcccttttcaagtggctcaagttgtaaatgtctgattttccatttttccatgacagtggtaccatgagccacaggactgcactgggaggatacggtgttctctggtggttgtgctgcttttctgatcgatgaagtaatatgcacatagcaagcagctcaggcagcagcacagacacacagcccgccacggcctcggcaacacagagacacacagcccgccacggcctcagcagcacagagacacagcccaccacggcctcagcagcagagacacagcccaccacggcctcagcagcagagacacagcccaccacggcctcagcagcagagacacagcccaccacggcctcagcagcagagacacagcccgccacggcctcggcaacacagagacacacagcccgccacggcctcaggagcgtggacacagcccaccatagccactgctccaacacgcaggtcctcttgagacctcccaggcactgacacctccttccagaaacctcctgtgtgcccaagagcacacccacacacgcctggagctactgtagggcaagcggccctcttcaccgccctgtctgggttcagaactggagtcaggccttcagcccttctggactggccccatccacaatgacctgggcaagtccctcagccgcctcatccacgagatggctgtcatcaccacaccctgcccagggtggtgagggttacacagggtactatggcaaaaacgcactctaggctacaaagccacatacaatagtgagctatgtttaaagctgaaatgacttccaatagaaaaatccagagactaaaaagaagcaccatctagaaaatgcaccaggaccaggcgcattagagcaggttcaacatcaccaatgtcaagatctgaaaccacagaaacagcgtctttcaatttttaatcagcaaatgcaagtatccacttaagtcccacaaactgacagggtgtgtctcgaacctacgctacggtctcgtggaggaagaagagtttttaagaacatggctcatgccttagaatagaaatcatcgaatacatctttcccggcctcctcaaacctacgctacggtctcgtggaggaagaagagtttttaagaacatggctcatgccttagaatagaaatcatcgaatacatctttcccggcctcctcatatcatgaaacctcattgccggggaaaggaagcctctggccctgcagttctcaaaacctggtaaactcctgactggaaggggcaaggggtgggcgagatcaggaatcctaagaaaaaggccccacaggatgctgttttctgcctaaccacttcccgctgccgtgggccttcc

SEQ ID NO: 5712 - DNA, 353 bp, Homo sapiens
gctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctc

SEQ ID NO: 5713 - DNA, 5367 bp, Homo sapiens
aggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtgagggccgaaaggccgcgggccgtggagctcgggccggggagactcttttctagcctcttgggtcccgctcctcccaattccctggagaggcgtcgagcttgctgggaagtgccctcgggtaaggggcgcggagcctcctgcggcgatcctctgtcttcgggtcgccttagcaggacgcggcaagcgggacactgacctggccggagtcccgcgttctctcaccagctgctttgtccacgagttgctgctgggcgtcaggggtcccacggcccggagggatctagagcaggggggctcggggtcctttccataccctcggatcctctcccactctctccacgcctcgacccggagatgatttcaggctccagatctctttcataaatggaaagagtttttttggtttgttttgtcttaattatgtaggtgttgcatgcttggaagagaaaatttagaaaattaattggaaaaccataaagatagctttctcgtgatagccacaaggcttgctccctcattctgctcatatgtcaccccctcaaggaggccttccccagctctgtaaacaacctgtgctcggcgttaacttttctccctaatgtttatcactacctgacatatacgtgtttcccacgactcaacgataagtgttcatgagggcagacactttttaatgccctatgacaagcacctagaattgtgcctggcacatggtagatgcttagtaaatatttgtttaatgaatgaaggtaaaaaacatttctaatacgaccatccaggaataagtactattcatgttttagtgtgttcttacagttttactgttcagacagttatatgcctgtgaatatatattatatatgtgtgtatatatatatatatatatatatatatattttttttttttttttgagacagagtctcgctctgtcacccaggctggactgcagtggcgcgatcttggctcactgcaacctccgcctcctggattcaagcgattcttctgcctcagcctcccgagtagctaggattacaggcatgtgtcaccacgcccggctaattttgtatttttagtagagacggggtttctccgtgttggtcaggctggtctcgaactcctgacctcaggtgatctgcccgcctcggcctcccaaagtgctgagattacagacgtgagccaccgtgcctggcggaattttcatattttaagtcccccacccttggacatttagattttttccatctttctgtatttgcagatatgcttctacgtacacctttattcatttgcttgaacatttccctgagaaaaactagaaatggaattgccagattactttgtgtacatgtttccaaactgtcctccagaaagaatgtaatgctttgaacttccacttgagaatcaaatgtttaccttcctctgttcctccagatttggacatttacagtgttcagccgttgttgtggcattccaattcaattgggaaacagcttgatgtagcgtccccataaggtccacagtaattaaattttttttttttttttttggtgcggtagtgcaatttcatggctcactgcaacctccacctcccaggttcaagcgatcctcccatctcagcctccctagtagctgggattacaggtgcacgccaccacaccaggctaatttttgtatttttagtagagatggggtttcaccaggttagccaggctggtcttgaactccagacctcaagggatccgcctgcctcagctttccaaagtgctgggattacaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtcttgctctgtcgcccaggctggagtccagtggcgcgatctcggttcactgcaagctctgcctcccgagttcatgccattctcctgcctcagcctcctgagtagctgggactacaggcacctgccaccacggctggctaatttttttttttttttttttgaaatggagtcttgctctgttgcccaggctggagtgcagtggcgcgatctcagctcactgcaaactccgcctcccgagttcatgccattctcttgcctcagcctcccgagtagctgggactacaggagcccaccaccatgcccggctaattttttgtatttttagtagagacggggtttcaccatgttagccagcatggtctctatctcctgacctcgtgatccacctgcctcggcctcttttttatatttttagtagagatttcactgtgttaaccaggatggcctcgctctcctgacctcatgatctgcccgcttcagcctcccaaagtgctgggattacaggcgtgagccaccgcgcccggttatttgtttatttatttatttattttttgagaccgagtcttgctctgtagcccaggctggagtgcagtggcgccatcttggctcactgcaacctccacctcccacattgaagcagttctcctgcctcagcctcccaagtaactgggattacaggagcacaccaccacatctggctaattttttgtatttttagtagagatggggtttcaccatgttcgctaggctggtctgaaactcctgacctcatgatccacccgccttggcctcccaaagtgctgggattacaggcaattctgctgcctcagcctcccaagtagctgtgattacaggtgtgtgccaccatgcccggctaatttttgtatttttagtagagacgaggttttgccatgttgcccaagctggtctcaaactcctgacctcaagtgatctacccgccttggtctcctaaagtgttaagattacaggcatgagccatcgggaccggcccactgttttttctcgctagaaaatacagtctaaagtggccaggtgcggtggctcacgcctgtaaccatcctggctaacacggtgaaaccccagctctactaaaaatacaaaaaataagccggacgtggtggcaggcaccttgtcccagctactcggcaggctgaggcaggagaatggcgtgaacccaggatgcggaggttgcagtgagctgagaacacgccactgcactccagtctggatgacagagcaatactccgtctcacaaaaaagaaaatatagtctataaataatgaagaaagtaaagtgaacctgggaggtggaggttatagtgagctgagatcatggcactgcacttcagcctgggcagcagcaagactccgtctcaaaaaaaaaaaaaaaaaagaaatatgcgagctgctaagctaggcagttctggctcaagatctctcatgatactgcagacaccacaccaacgaggaccccagtcctctggcactggaggacccacttagaaggcggatgactcacgtggctcttggcaggagacctcagttcctccccacataggcctccctataggactgcttgagtgtcccgtttaccaaatgatctaaatatgttccggttttgattggctgctctgcaatgtgggccgttatctagctgattcggtggggcctgaagtgtcagttcctgccgcagggatgttatatggaacctttggcaggccgctacagacgaatcataatataaacctgtgctagttattgattacgtcccagctcctgcgttgcctgctctgtgaaatggttctggccctttagtttttcctttaccagctggcatgatcttaagctttgtcagtagagggcgctggagagacattgcaggagacgagtttcccttcctgcttctggtgtgttctctctaggctccggcatgacgggtgacttcttccgagtctggcttctgcagcacacagggcttcgccagcacccagctcctgcagcatgggcagctcctgtgacagcaggcgcccgcagcctgcaaagcgtctccagtgccgccgcctcagtgaacctcaaccagcggcacctagcagctttctctgccaccctcttcaggtagttctgtagcagcgcgtttctcatgagacacttccctgtgagcagctttttctacccttgaggatggatttccagcaaattctgcccatgtggtaccacagccacttctctgccattcagtgaaactgccgttgtgccctcttcaaggtctggatctaagcccagggaccaggaaacctcttgcttgagtgctggaactcaggccagaaggacatccctgtagaagttctgctgcgtgtggtccagccgtccccactcctcccgggagaggtacaaggccacatcctcgaaagtcactggcatctgaaacaatgtgaaacatccactctccaggacatgacgtggacacggtggagggacaccatggcatgagatgtgtggtgagaccccggactcccaacccactgtgtcgagtgaggcctgccacttccatctgatcgggaagcaggtgagccacccaaggccttctggggagttgagaaagaacaaagaccaagaggtattttcagggatcacagttaagacttaggatgtccatgcagcccccagcctcagctgagacctcggaggacggttcccaacggctaccagcgagaggccctgtgtctctaattcctgctgcttctcctccagctttggcccaggcctgaccatgggccttgagcctggacaattccagcaacactagcaagagccccaggcttcaggct

SEQ ID NO: 5714 - DNA, 1146 bp, Homo sapiens
gtcagctgggctgctggctgccagtccgcctgcgttatcaaaggctgcagacactgccctgcctggtgggaggcagggaagctagccctacctatctgaggctctgtgctgccttcagccctcccactcagcctcctcctagcaggtggagtgctccctggcctgcctggagcaggagaggcaccagatgcagggatcccagggacaggctgagtggaggaggccagaccagaacatagaagacaagagatgctggtgccaggcctgcagatccaagagcagagctgggatggaggcagggcccaggagcttcgggacccagagtctccatgccagcagctgagacccctgcccaggctcaggacacagtccgtctgcaggagcagttgctgatactcactgaggtgaacaagagactcagaagagctgggccagagccaccagcaactaggggcctgcttggagcagctgcagcatctgcagggagagcagatggtgttggggggccattgcaggccctggaggcagagcacacctggctacttcaggagaagtacactccaggtcctggaggtaccagtgcccctcaggaaagagctagaggcacaagaatcacatcccaggcttcatgaggagatggctgaatattggaaggcacgctggcaccggctggcagttgccctgaaatttaaagaggaggaactgcagagactccagaggcagagtgggacctggcctccccagcatgcatttattgagcatctgctacatgcctggccctcttctgtgtgcagaagcaatgtcaaatcagatcactccttgtcctcaacagcttatggtttgggggcacccggtaattgaggcagaccgcagcagagaccccaggccagcccccggagtctgcaaatgaaaggagctgtgggagcccaggtctgccaaggagctggagtctgcagtgtggactccaccagaggccaatgggaggtgggttcagagctggctgagatgcagactgagctcgagaaggtctgcaatgtgctggaagcttgagactcagagctgagagctgagcagtgggccctggaggctgcccaggaccaggtgctcagcagctgcccccctgcactgtgcttccgactggcctgc

SEQ ID NO: 5715 - DNA, 908 bp, Homo sapiens
atggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctaattattcaagagaaatgaaactgtatatccacaaaaaagacttgtacacaaacattcacagcagctattatttattggtaatagctaaaaactgtaaacagctcccatatccatcaagtgtatggataaacaaatttggtgtatttatacaatggaatactactcggcaataaaaagaacagttgatactctcaacaacctagatggacctcaaaataattcggtttaatgaatgaagccaaacttaagaagagtacattgtatgtacttggagaactaacttcttgcaatagatttttaagcactattaggagcatatgacttaaacagtttttaaaagtcagggagtaagtatgcttaaataaaatacaatctgtgaaacaaatctctgaattattatcacttcactggacactctaacttgaccatatttctgactttaatgtaactcactcttattccgtagtcacatgtttgcttgctcattggttcacattacatttattcagcatctgcttgagccaaggcactgtaactacatgttttttttagttacctacttttgtaaggtcctgtttctttggctacatctgattacagtaaacataggaagtttaataaaacaattttcatgaccgag

SEQ ID NO: 5716 - DNA, 2517 bp, Homo sapiens
ctttgcctttctttaattgtgtcaccttctttgttagagaaacccaaatcttctgtttcttgaagaagctgctttttttaaaaatgtatcttttagatacctattgtggaaataaaacaacttgtggttttttttttaagagaaatgatggtttcttatatggagagaggctagtagcgaggcaaatatttatgcaaagatgtttgctccaagaacctaaactgaaaataaaattagactgaatttttagttaaagctgcacctggattgcatgcatatttgaaaacattatataaggtttaacaaatgtatgattagagcattgaccagtgttattctgttaagtagttttgcaggattttctcttgcaagaagaatttgttgtactcgcattattgtttcctttgggatcgtagacaatgactctgtagtgtgattcattaatattggttgtcttcagcagagagtatccagatttgacctgccaagtattaaatttttaatgtattactagttctttcacagagtaaggcttgtctttgttctttgtatttttgtaccagtatagcttgaatcagatacagatttaatttgtagtatcactaaatatgcctcatttaaaacacgcacaatacacatataaaaatgtttattgatgaaaatatttcaatatgaatagctacctttttaaatatttgaaagtatgcacttccaaatttattttgaaaagtgccagggggtgctgtgtgctatgtgcaataagttaattattatgctattaacattgatgatggtgaatgtatattagttaatgtgttaacgacgtgttaattactgtacatgttgtgaagacccttcaggcttgttctatgatgcagcatgtcaacttgaactagaccaagtaatctgcaaagcagactgtaactcttaaaaataacacttgtaaacataaattataaattaaattatgctttttattattctttttctttctggtagaatgaataagtaattcttctgctatctgcacctgttagaacccaatactgtcagactctgttttccccaagaggattgaaagagatttgttatgcaataacttccgctttgtttacgctctggcatttagtgtatattttatatagattcatttgttttgcagcctgaaagatctttctttttttgtttaccagcttgatttgaaatgaaagacactcacacttagtctttgtgtaagcaggtgaaaagtggccttgtttgattaggactactagttgatactaaactaatctgtatatacacatgtgattcagttatagctcttcaagtttagttggccaaatagttgaaatctcaagggaccagacataaaaacaaaaaactcaatgacagtttcaaatcatttacaacagaggccagaatttgttgctgtttgtgagaacatggcattatatatttgttgtccttttcatcagtatatcttgatgccttgaaaatgtcaaatatttgaattttattactttaacttttgaattagtggttgcccatttctttctaattgtcagtatttttgaaaaatacacctgatgataatcctcaagagactaatttggagaaatacaaaattatagaattcgatgttattcatacaatggtatttcttatttttatgtcttcaaaatctttgtttcatattaaacaaaagaagtaagttaacaaatgagagttcccaaatttactgagggtcttgtgaggatgttttttaaatgacccaaaaccaactcttgaaaatacaaaaataaaatagaaatgagtgtttctgtaaggcatttactctgtcttttagattcttctaacataatatgtataagaggtggtaaagagttagttcagactgtaaagccagactgtcctgcatccagttctagctttttcaccttccagctgtgtgactatgagcaatggatctaactgtggtgtgcctcagtttcatgataattaaaatgggcttaataatagtacctgccttacttaggggtgattagttaatacaggtaaagtactttgagtagtgcctagcacacagaaagctctcaaaaaatgtgaggtcttattattaacctgcctttgatattatactaaaaattatttggaagcatttaattttcacaaactctttgatttccctaggacccattttgaatgtgagtttttggtttccagtcattatagtctcgtacttcatcatagaaaaacaccttatttttaatgatggttttattactccagtgttgtttacatccacctggagtcatcccagatttttccattcgtctaaccttgcttgatttcctatagcacagctcttgttgaagatttatattggtgtggaaggatattctgaccaggattttggtttctcttgcaaatatttgtgtatctcttgtttacagccccagtgtcctcttgtaaaacccatgcaaaatgggattctaataaatcttgtgctcagcatta

SEQ ID NO: 5717 - DNA, 364 bp, Homo sapiens
ttccagaaaacacgagatttttctcctatttcagcagttggccacaacttcattgctgggaaaaggccaagaaagaagagagaactctcaccacaacatttcaaagggaatacattgccagaacttggaatactctactggacaaacatttcctccaaggtaaatattaccattgtaccaataaagggacacatcactagaatttttgaatggcagtggtacagcacaaaggtttaattgtttagtctcatacagacctagagtgacataagagaaagagagagagggagagagagagaagaaagcagtgctgttggggtatcctgcagcctcttctaaatgtgttaccaggagaatgccatca

SEQ ID NO: 5718 - DNA, 4679 bp, Homo sapiens
agagcactttccactacatcacaagggaagagcaaaaagaaaaaataacatctaattttaccagaaaataaaatacaggcaggcctgaaccacagccagagttaaatgtggagcatacctacctccaaacccagctggaacctcaaagcactctgcatctgaggatctcaaatggcctgacaaacgttaattaactaagctgcacaacactcctgtgagggtggcaggcagcatgatcctctccaagcgacagatgaacggagatcctgggaggcccttcctttgaaagtcagtggctcaacttggaactcaacttccagaacttggaactcaactccccaggcccatggttgagcatctccgctgaagccaagtagcacaaaatgtagatgttacaactgacagacttttctaaagaaatttaaactggaaaccaagatcaatctcaaggagatttatctttcctctagctgcaagaaaaaagtgctctaataactacagcatttgaacctatggaagaacctgagctacaagttatctataacattccgttttgacaaataacatggaggagtttacctgaatgttgattttccatgagctccccctaaagactcacccaataagcttaactgtacttccgtattttattaacaaatgaaaaactacacaatgttggttaatttttttgtgaaatttaatgatcgatttttggatccttattcatgtagttatcagataaaaagccaagttttctgcaatggaatatccaatctaaaaattccattacaaaaataaaatccagaatttcttattcaggaaacaataaaattaatacagttgcatctgcataaatttatctaaaaaataaatacctttgtgtagatgtacatcataaaaaaaaaacttgtcagaaaagtatacaactttacatgaatgctgactatactatactacttagtttaaaatgattaagaaacatctattggaatatataaaataatttacttatactgttggtacaggtaattttaaacatgttaacctcttcacagacctaaactttaaataaaaacactgggttttcaaaatattattagtaaatgttggtaaccattttcaggaggtgattcatgttctataagatctattctagaaatgttaagataataaagttgtcatataagcttagactatttctagcaaagattctaaagcccttaatacttcttcctactaacacaagaaaatactcaaaaattttgtagaaatattgtgtgattaatatgcaaaaaaaagcctagttttcctagagcaatttataagatcaagtttatggcaatgtggcttttgtcatactcaaagcacagaagtcaacacagaggcatatgcaactgaaaatttttatatcaagatcaattccatactaataacaagggaaaaatatagacatttactaaataaaaatatacataaatgatatcatattgaacacaaaactaaaagccaaacactgaccctgacataagccaaaaaaaggagaaaaccactaatgttaatgaagagaacatttcgaaattttagctcttcttgtgattcttatatttccttcctcactttgagaagtacagcaaactttcattgctaaaaccagtttaaaaaaaaaagttatcagaaagactaatatgctgaaagcaacattttaattatgtgctttgtaacacaatcctaactacattcagccttttatttcaaaatgtttccattatttaccagcatagtattgaactatattaaatcaacattttctgttgggcaagttttccatacttaattcttgatatcactctgtatagtatttttaaatgattaagttttactttagtattagaaactgtatatataaatgtattaatatacttgctctattaatgctatattgaaaaaactatttaattaaaaaggtacttttaaaatctgatagtttacatttcttaaattgcttacaatttctgaataattgtagttactttcaagttctattttattgtttcaaatataaacatgcattctgtaggcatatatttatacactactgtaatttgggttcaaaacatgtaaattatatctgtatatttctatggtgtattttaaattattacaggacatcttcactaataactatgcctctgaaactataaacttatagtactttttttttggcctttagtaaacatgacctcaaaattctgcttttttttttttttctaccactggtagggtaatgaattagaggtaggtaattcggtatgataatttcagaataccaactaataccaccaaagtagaattggtgtcaaattcacaatgagaatgggctgtttcttaattctgttaggtgtcttaaaaagctcatcatctaagatatgtacacattgaaaatttcatatacagctaataacctaaatgttgcccaataaattaaattggctacccttcctattccaaatatccagtaaaattggtgatttccaaaagcactattcaaatataaaatgtgaatcttaaaagatttaaattttattgcaaccacagaatgattcaatattcttccttttatatatgcatatgcatgtatttgtatatattaatgtaattttatcagatctctgaaatttagtagattacagcctttgaagataataaatcatagggttggaatttggctattattgtagaacacagctaaggaatctcttgtttaaggtttcctacttcagcagctaatgtggaggaactgaaaaggctgttaaaatgatgcaatagaaacttgaaatcagggatttaaggaagtggaggaattgagaaaaacaactttttagaaaagtattaacatctccatcttgctcaaaaaatgcaaccactacgctcaggttttttataccattgcttaataaattgtcatttcaaagtcttagagtatataaacaatggcagaaaaggtaatattccagaaacagtcaaacaatatggtgtcaaatgaagatgtcatggatgaaaccaattttaagtagaaaaaggaaggaaaggggttccggtgatatagatataaggcccccaaatataccatactctcaaaatgcagtatgaatttaataaaacataggacatttcattcccgccttataaccagaagccatgagtcacttgaggccagaagagtaatgacatgctgagaaaacaacaaatattgacaatgataaaaatgcagctccatgtatattcactggaggggagttccctaaattgaaccccctcttgaagggcacagaaactgtttctctttttttcccgaagttactcctaataaacttgcttcttccctgcaggaaggattctttgtttctctctgtacagggggcatctcctcttctgtattcaagtccttctcttagctccagggcatgactacagatgggaaagctaacagcttctataattaactgtgcacctctaaggggcgtttttcaactccgctagagaatactgagaagcacagataggcttcagagaatctgcaggaaatgagagcagagcagccaagcagacattgggaagagcaatttttctccccagaatacatccagagagaactcactggtctatgacccgcaggtcaaagcacctggctaatggaactctatttcccaactggatcttttgtaaaggttagctggtttctgatcctaccttctatgcacaaacaaagcttcaaaatcatccagagaagctcaaaactttcacagacttaaggtaaaatgtccaagaggtggtgtcttaggcatcgagcaactatcacttattgggagctcatgaattttcaaaatctaaaatactttttaacaatgctgagtctacatagtatgaagagagcaatcgaggatcttaccttactcagaggttttgttttctttttccacatggaactaggtctttccccctaaaagatcctgttcatatcaaatgcatggcactcttctttggccgcttttcacactattcacacttagccttttctcatttttccccctcttgttggcaactcgacaacaacaagcattgtcatttatacataattatatcgtgggttttaaaaaactccgtattttggtatgaacatctcatcaaggacattacattcttagtgatttaaatctcttctgacttccttattaaccatatattgtcatagcagcctaaaatttaaaagtcatttagttatttcagtgtagcagatgtacatccttctgggattctaaacctcccttctccaaatatggccttgttgttttgtatagtcaccaggaatgattaaccaacattcaatctgagctaagagcaaagacaaacaagtgactgcctaacactgtatcaagtaagtgcacagcacacacaaacacacatgagttacttgctgccactttggccttaggagtataaatccccagattgagacagatcattaagtttcacttcacacacaacacaatcctgtagagaaagaatgtgtgttcctccttttgcccttcaaaacaaatgaattatttaaaaatgaaaccatcctacccgtaacagggactgggattcatccttggacttgttttctcccgatgcaggat

SEQ ID NO: 5719 - DNA, 1009 bp, Homo sapiens
gcatgcaggtgagaagggaagatacatgtaatctgcatgtctgccaccattccttgttaccctttttcatatcccatgagcacagcactccagcggacctacccaaaatatgtgggagttcagtgaaactcaaacagcatgcttctggtcagcctatacagtctctgtcctggtgaggagcatgatcaccaacaggcaagatcttctggccttgaagtttcgcttgagttaaaagagctcatctcaggactttctgaattttcagcccatatgacatggaagaagagttagaaggggaatctgactgcttggatcagggactgtctggctggtggaacttgaatagatgtacagtgcgccactctgaggatcaagtctgaccctgcctttaaatttggattcaaagtacttagattttctggaatcccattctacaatcttctggtcgaaagtataaaaccagtctctcattgcaccttacgagaaacacccacaggtgtggaggggcaacccaccccttcatctggtgcccaacgtggaggcttttctctggggtgaaggtacactcgagcgtggtcattgaggacaagtcgacaagagatcccgagtacatctacagtcagccttacggtaagcttgtgcactcggaagaagctagggtgacaatggggcaaactaaaactaaaagtaaatatgcctcttatcttagcttcattaaaattcttttaaaaagagggggagttagagtatccaccaaaaatctaatcaagctatttcaaacaacagaacaattttgcccatggtttccagaacaaggaaatttagatctagaagattggaaaagaattggtaaggaactaaaacaagcaggtaggaagggtaatatcattccacttacagtatggaatgattggcccattattaaagcagctttagaaccatttcaaacagaagatagcgtttcagtttctgatgcccctggaagctgtataatagattgtaatgaaaa

SEQ ID NO: 5720 - DNA, 2435 bp, Homo sapiens
gaggttctctgtgagggctccatctctgcagcaggcttctgcctggttactcaggctttctcatacatcctctgaaatctaggtggaggttgccaaacctccttcacccttgcactctccacacctgcaggcttaacaacacgtgttagccaccaaggcttatggcttgtgccctgcacaagtggcaccccatgccttacttgggccctttagagctgagcagtgtcccaaggctgggcagccccttctctatggctgcttttacatttttttctttcatttcaaccttggaaaatcttatgcctatgtgcctcaggtatggtcttcttgtgaagtatctcccagggcatttcctcagtttgaatgttggccattctagtgaggttggggaaatttcatgaacaatatcctgaaatatgttttccacgttgcttgctttcttcccctttggtttcctttacataatcccctatttcttggaggttttgttcattctttttgttttagttcagtgagccaatctttgagctctgagattcttttctcagcttggtctattctgctggtaatactcgtgattgcattatgaaattcttgtagtgtctttttcagctctatcagatcagtttggttctttcttataatgcccatttcatctatcagcttctgtatcattttattgtaatccttagatttcttggattgggttttgacttttctcctgaatctcgatgatttttgttcctatccatattctgaattctacttctgtcatttcagccatttcagcctggttaagaacccttgctggggcactagggtggttgtttggaggaagagactctggcttttcaagtagctatatagcaatgctccactcctcagtaccaattttctgtggcaggccatccttatattgcaaaaaatacctgaggctgggtaatatataaagaagcttaattggcttatggttctataggctgtacaagcagcacagtcccaggcatctgctcagcttctggtgaggcctcggaaagcttacaatcatggtggaaggcaaaggaacccgatgtctcacatagtgagaatcaagagtaagagagagtgaaggaagaagccatatacttgtaaacaggcaaacctcatgagcacgcaccatcacaaggacagcatcaagtggatggggctaaaccattcatgagaaatctgcaccaatgatgcagtcacctcctaccaggttccacctccagcactggaaattacaattcaacaagagagttagaggggtcaacttccaaactatatcattctccctgcagttctatcagtttttgcctcatgtatcctgatcctctgttcttgggtgcatacatgttaaggatagtcatgtcttcttggagaatggacccctttcatcattatccctgatagtaattcttgctgtatagtctgctattctataatatacctgtttcttcattttggttagtgttagcctggcatatttttctctctttaatttgtatgtctctttacatttcaagtgggttgcttgtaaccaacatataattgggttttgttctttgatcctgctttgacaattttttcttttttaaactggcccagtttttccatataataatctatcttttaattggtacatttacacccttgacattcaaagtatttatatatttggataaacatctaccataatgttactgttttctatttgttaaccttgttctttattcctatttttgtcttccattcgtcttgtgcctttgatggtgttaatttggcattttattattctctcttctagcgtggttttcttgtggttgcccttgtgtttgcagtatagatttacaaataatgcaacccctctttcaaataataatatactgcttcttgggcagtgtaccttatagtaacaaaataatcctaatttctctttcctatcccatgtatcattgctgtcattccacttatatataagcacccctaagtatgacgactatacacacacacacacacacacacacacaaaaatatatgtgtacaaaatcaaatacattgttgccattattttgaatgaactgttaactgttagattaagaattggtaccatatggaacaggttagtggaacttactataaaaggcttttctttgggggaaatttttaattactgaaactatttaggagctgtgggattacatgtctatcttcaattagtttgagtaaaatactcgtagtaatttgtgtattttgtcagttttcaaatgaattgttcataatatcctcacattttcaaatttcaactgcgtttataaaattttcatttttccattctctatttgtgtcttcttgctcgatcttaccaaaatattttgttttagtgctttttcaataaacaagttctggcttatttt

SEQ ID NO: 5721 - DNA, 10869 bp, Homo sapiens
cttagtcgcctttttgccttggcattaattctagcttcgttaatggaggatgctgaaatccaatttccatttatttcattctttatttcctcagtcccagcattttcttcatcaccggaaaagagagagtcacttaagttatcaggatcttaaagagaaaaatgaagaaaaaaattctaagtattttaagtatctactgttttatagatatagtggtaagttagattaggttgaatcacatgacattaccatttttgtaggtaaattacagtcacatattgggaatttcatctacttcaatctaataaacaactaaataagattacttttcacattatcaaggaaagtaaaccaaggcactgaattttaacaaagcatgtttgtttcttaccaaaaacaaaccaaatttgtttgtttttaccaaaagaagcatgttatttcacgtttagatcataaaatctatgctaacagcaacaccaaatataaaacccttagacttttatgagctaattggagatattaagaaaagacaaagcatcttgagaagagagataaactaatatttatagaatgcctactattaggcactgtgctagacactctatcatttatttatgcacaagtttggcagttaattattataacattgaagacagataaggaaactaaggctgagaatgtttaaatgatttgccaaacgtcccataactaggtataaacacttaagaactattagtaatccaaaagagaatgaaaggcatttagcaaataatcgcatatgattgttgagctgaactgctgatgctttactgcctcaagacaaagtttgctttcaagaaaagccaacatctcaaagtcctaattcatctccctaaacttttctcctattacttaccatcctgtaaatcttccagcctatataaaattgattcttctgaaagagatcaacatactggagttcccagtagaatgtcgccctcactgttattttcagttatcaaaatcctttaggatatagcccaagtcttactccctgcattaaaacttcccttacaactctaggtacaggaacactaattgctcacatactattcattcaacacgtcatggaaatcactttctttttatatagcagtctttttcttccaactaagtcataagcttcaaaggagaaaccacaactagactgtatgtccttctttgtatccccatcacctagcagagtgtccttcatactcaaattccatggagatcaagtggaggcacttggctttgccctgaaagctctttaagtcagaaaggctactgaattagctaccactgggccacagttttgttcattattgttaacgcaaatcagagctgaatcactcaaatcattttctatatgcctaaagataattataacatgtcaggtctatgtgcatgggctttaatatgttttaagacatgttgaaaccaaaaattttcaccaacctataaaaagcatacatgtgtttaaatctttacaattcttgacatacttaggaaggtaggaatgttttgttttaaacaaaatcatcaattagagccaaattatttcactagtctcataagtagtctccctgcctccagtcttcaaactatactgaatgaagactgattttctcaagcatgccctcactgaagatcctttaaaagtagtcccattatgtcacaaaaaatgtaaacttttttttttttttttttgagacagcgtgtcgctctgtcacccaggctggagtgcagtggtgcaatctcagctcactgcaagctctgcctcccgggttcacgccattctcctgccccagctgggactacagatgcctgccactacgcctggctaatttttttgtgtttttagtacagatggggtcaccgtgttagccaggatggtcttgatctcctgacctcgtgatccacctacgtcggcctcccaaagtgctgggattacaggcgtgagccaccgcacccagccaaaatgtaaactctttaccttgtaacttaaggtcctttatgatcttgcccctgcttacctcaccagaatcactgctaactactcccacactcaaattgtcagagcttaagttagatatcatagggaagagatgggagggattcatttggcagaagaatactgagtatattacaaaaagagaaagtataaagtaggaaaccgctaagaaaatgcttcagtaattcagtcacaagctaactggtaaagagcaagggtagtaactgtgggataaataataatgttacacttttaaagaaaataatgaaggacttttaagcagaatgtatctaggattaaagagaagtcaaacaatgccttaaaagttttcaaactggtaagaagccggtgttaggatggtgtgtttgggacatcatcataaccatcagtagtaattatagtcttagtggaagtagtcgtagtactgtttctttcatcattaccattactattgtcatctattagataccaggttccacactacctggtacctattagattccacactacctggtacctattagctaaggcactttacatatgtggtctataagcttcaagagctctagaaagaaactgtttatcctcattttacagaaggaatgtgtttcacaagaagttacatatctagaaaggattatggctagaattcaaacccacatttttaatcccatataactacagaaaatacaaaactagaatacagcagagtattgacagctaaagagacgaacaagggcgtgaatgtaaagagagataaacaaaaatgattaagtggaaggggacagaaagatcaggatcacataaattagatgacattttcgtgtaagagtggatggttgagaaaaacattaaacatctacctgtaacatagtgctttcatcattgtgccattaaggtgaaccacaaaactggtccagaagacacaggagtcagaactataataaaatgtcttaaactgtcccttggagtattcaatttaaatacatctatttcccataatcgagttttcttttcttcaacaattttaacatcctttcaagtatgtttgtgtctctgcagcagtaaacattctctcagtataatttatatatttgaccttatcatttttaacccatgtttgtattaattgctttatattttgttactcatactcacctaactgttggagttccataacccctattgagctgactttaagaaaaccaaaattaaaatgataagctgagtacagaatgtgattgacttcaaaattgtttcctactgtgtactaattccctctttctgaattctgatatctcaatagtaaccactccaattgtatatgaccacagcaccagaaaatcacattttcaattactggtgtccaatgagtggcataattagaataacattaccacactttcatgtattacatacctagtatgtgcttcacagacttaacacacatatacaatatctcactaaatcctaattataaatctatacagagggtatttatatcccaattttatacatgaaaaaactgaaggtcagaataacctacttcctccaagtaaaagagtaagagtgtgacttggactatttgctatgtgaagaatttactacaaagagggtctatcttaggcctattcaaatattgaagaacaagtcttttattttaaagcagtgctggacacaagcaccaagaacagggttagaactaggtcttattgtagttaggaaacaaaaagtacacattttaaagctgtgtttctatttctaatagaaatagaatgcaagccatataagaaattttaaattttccagtagccacattaaaaagtaaaaacaggtgaaattaatttaaatatattttatttaatctaatataaccatatcatctcaacatgcaagcaatataacaaattattgagatagttgaccttcatctcaactcagagtagccacatttcaagtactcaacaaacacatgtggctaagcacagtggtgcacacgcctgtaatccagctactgaggaggctgaagagggaggatcacttgagcccaggagtaataaccacatgtagctagtggtcaccatactggacagtgcagaaaagaagcaattacctatatgtaaaatatattctaaactgtattaccatccccatctcaattaagtaggtacatattatccatttataaccctaaagcatactcatacagctattgtatacagcagcacagaaatgatcattaattacataaatttttttcaattttttaccatactttaaaaagatctgtaaataaacaatggtaaagaagcttcaaattcaacatgtttgttcagatcaaagaaaactatgtacattgtaaacaatagtgagttaagtcactgaggaaagaaagatgtagtatttagttacgaaatacacttaaaatgacagaaaatagctttcaatattaataaaattataagacaaagaattatccaaagtataccaatatgaactgttctcactattcagatattacacaattctaattaactttttgggagattatttttaaaactataaatacattttaaattatcttgagttactcacatttggtcatctattccacaaaactgttcatttttatgataataacatgctattgaagcaccatggagaattagggaaaataccctaggtaatttagaatataaaaattatttgttaggaaagataccaaagataccagtaagtttatattacagaaatcactaactagcccatgtgaaaataagcaggctcactattcttctctattctgtactatataacagagaataggaatatgtggaatgtgaaaggataggcagaaaaataggacatgtaatgaatttccatgaaaataaaaatcacaaacttgactttaaaaataatatagcctgttttcttacagcatgaataaaagagtatttaaagatagtttttctatcatgtttttataaaatatggaatggtctgaagcttcctcacaacatagtcaagcttcaagatatttcagcctaggcaacatagtgaaatcctatctctacaaaaaataaaaaattagcctggtgtggtggcacacacctgttgtcccagctgctgaggaggctgagataggggaggatctcttaagcccaggaaagtcaaaactgcagtgagccatgatcacaccactgcactccagcctgggtgacagagcaagatcctgtctcaaaacgaagaaaaaaagaaaaaaggatatccttacttacctgcagggtttacattcagtatctgctcattttctacatccattttcccttaatttcgcttgcactgattaaacaaattacctaatggaaatcttccttcagaatctgtttttttaaaagaaaaaaagaaagcttcaagatcttttaaactgatgtaattaagctgaattaaacttacttaagcacactgtaaaaacaaacgacaacaacaaaaaacacacaattccattaaataaaacagttcactttactttcaaagacaacttaccctaattaacatttggttccaatctttttgataaatttatcaaagtcaaaaaaaaaaatcccagatttcagcatgtgccaaagcacccctttaattggaattaaaagatatgtttgtgatacatgtttacgtcaagttaaagaaatacacacatccaaatcttttaggaataccaagcctcaaaattaatctgatatacatacataggaatataaatactggatagttccctaccaatgaattatgagaactactccaaaataaaaacaacacagttttagttaataaagaatatcacatgactgtgttatttttcacattacggcatatctgaaaggcagatatatctgccactcattacctaggtctctataattactagaataagactttgggagaaacttttaaaatcagcttttttgataatattatttatatgagaaatccttttttgataatattatttatatgagaaatccattttttaaaaatctgatcatttcagaaaggagtaagtacaacgacataagcatttcagtattttaggcctcagtttcaaaatggcttaaaaattattaatactggaaggtttgatgaaatcagttaccttttagacaattaacttagtgatacagatccaataatgttatatgaaagaaatatcaaaatagttttcaaaaaatatattaccagaaagtgcaaccaaattaagatttcagaatctctctagaagtattttttaaatagtggtttagagtacttaagtgtatgtttaagtcacataggttggatataagtccttctggtcatttacaatcaggttgctagcagtgtgctcttcagagatataaaatgcacaaattagtgaaaatgcctaataaattaattacagaaaagcacattttttcctatataacttaacctactgttagatgtcattttaggataacaatgatatatacagagcctcctgggactcaaaggtgaaactgacttttaaattcctcattatgtactactatttgctaacataagtttatagcccttttcttcagaaaacggtattattttgtgaaacaaaaacaaatggaccttatgttaaaattataggcttcttactatggtataatcctcagactaatatgctatcatattgcttgggaacttaagaaaatggtgagatcattctctaattctgttaagaataaattaatatatgtgaatctttataatcacttttcactataactcccgccaactttagatatgaaaaaaaaatcttaaaaatatgtagagattcatataaatatatgaacaaaaatggtttgcaaatctaaacactcagcatccttcatggctgaaaaggctacattctgttttaattccatgcatgaaatacatataggaaaggaataatgtcatatgatacgtgtttcagttttttagagttccattacaaagtctttttcattcttgatgaaagtataacttttgagagaatactttctgcagaacctaataagcgaaatgattataattgatgttcataaagccctttacaattcaaaaagaattgtacatgtattatttaatgtaccttacagaaaaaccttcgggtaggtattccaccttacacacaactaaacagattcagagagggtaggtgatatgtccaaggacagacagctgcttagtggaacagccaggatgagaatccagaccttccaaatccagtactgtttgcacaagttcaatccaaaattttaatatcccacaggaagattcttttcaagggttaacagaagcttcttaaaacagacttctgctgttcaaacttttaaatgctgttttccaaacactaaaaataattattttaaactattatacagaaggcattccgtcagacaaaactgtcaggaaatgactatcatctcttttattaagataaaaacaaagttatcttaataaaaaaaatagtcctgtgtctttaggcaatgataacccgatcaggaactcaagtcatatttgacagcaacaaacacgttttaagagtttagataagacatgttccacgtttttacgctctttaaagtagtaggattttttccaatttatttaacaacccttaattggcccaaacaagaaaatataaagcaaaaaatccaaacgctatttccttcatactaacctacaaaaatgaattttcgatgagaaaactatacatacaagttagaagaaaatgaaggctgacattaaacactgttcttttctccagtgtgttacacgaaatatacaatcagaagtattcaactgccaagacattccctaagagacagaccctccactcccccacgaaatatatacatatgtatttcctgaaatatacctcataaattgctctggcattttggggagtcaagctttggccatttattaactaggattacttgtattcattcttcggctacgaacggctaattagcagcttaaaaccagctaaaagcattctactacagtaatgcaaaagcaagcactacagataatattcaagcggcatttatttttgcagtcctaatattttttcctttcacattagtaccacagaaaaagccagtcaattataattcaaatacacttactgagatattaacgtattcaataagcctataatgaaggaatattaagggcataaataccagtaactccttgcttaaaaagcacttggtggtttcccaaaaaagtcacgttaagaatatcaagattgtaacaattaaagtaaaaatacaagttaaaaacaggggaaacccttttttccccgacacctaatcgcatttctgatcgttttcatcatttgtagacactacacagttgctggctacgtagcgagttctcacaagggggaggggggcgaaattgacgtctgcagacagttttgaagctcttgcaaaaccccatgtacgttacagcatcaaactgacaaatggagaagatggcatgcgtttcacagaaagggggctcccttcccggctttgttttctctgggagattttattttacctaaactaaaaaaaagagaccctttgccggaagacgggcgcgacgaagttcgcgcagggatggggcggcgggcacgtgttcgcctcccagcgcccccggcgaggatagcgcgcggcccctccccacagcggccgggcctgttctcccgcagcgggctcaggctaggacccccgaagtcccagcccgggtcggcccccggaaggggctgggccggggccgaggccggggctccgggttcacgaaggacagggggccgcatcttcagaggattcccagggagggcagggggcggggagggcgcgaatcttcctcacaggatttcagtccagccggaaacacgccttccaatcccggcccccgaattcaacctccgccagagggggaggagggctgagggggaccttcaagggcgagcgcctcgcgcgcccctctcagtggggagatggctccgggagggggcgggcccgcgccgacacgctccaggctgggctcagaaagagggaaccaggccggatgcccgcagtccggggcgttggggagggcgcggctggacctgcggggctacaagaaggcagccggacccccgcaccgcaggcccggacctgacaggaccgcgacccccacgcctccgcccccgccccctcccatcttgcggctgcctccgaggagggatgggggagagggcgcagtcttcccgagcgtgtgagccgcgcctactgggtttcatcatgttgtccaggctggtcttgaactcctgggctcaagcaatcagcccacctctgcctcccaaagcgttgagattacaagcgtgagccaccattcctggaccctcgtagtttttctggagcctcgtgatttgatatgatcttcctgccgctgattcctcacagtgttggcttgccacacctccaggggcactgatcacattctacctggcattatttcatctgagtccctgtcctagcccttctgcccattagactgtaaccttgtttagggaaagacctgtgtcttactcatctgtgattttgttgttgttgttgttttgagacagggtcttgccctgttgcccaggctggagagcagtggtgcaatcttggctcactgcagcctcaacctgttggggtcaagccatcctcccacctcagctttccaagtagctgagactacaggcctgtgccaccacacccagctagttttttgtatttttagtagagatggggttttgccatgttgcccaggcttctcttgaactcctgagctcaagggatctgcctgcctcggcctcccaaagtgctgggattacaggcgtgagccactgtgcctgacccactcacctgtcattgtagtacttaagatgccttgttcatttattgtgcctgtgcaataaatacaccttgatttgagtttacaaagattctcagcagttggtggtcatcctcatctcctgggcgggggcctcctggtgtggccagtatctgaattagtctcataactcatgttcactttttaaaatcggagcttcccagacctcagttttgttttgttattttccattatctgcagctgtctcctttcccctctctcacctatactctactgatcagtgactgctggctcctttgttacccatccttctctttctccacattttttctcttctcatccctttcagttctggactgtttccttcttcctccctgtctttcatttagtcattcattgaatgtacttactaagcacatatagcataatcaggctgtgttgggtaggcatcccgagcaattttaagaagcatctaaaacaacctgttatgttttagcaaattgcccccaaaggacccattagggaggaaaacgttcatgtcctttttgcgtatcatctcaagcagtacccatgatggctgggatcccagaacccacctttgagaatgctgccgtatttgcgtgtggttgacaaggttgggccagacactcaggaaatagggttgtcgtcctacctcccccactaacttcctgtaagaacttcagcccctctcaggacctttttctttaccaataaaattcagaaattgggctcaatcagtaattcccaagttattttccaaagaacatgaattttgtggaactttaatagatatcatgcaaaaaaaaatgtgggagggattgttccatggtcaaatggtcttggaaataactcgtttaaacaaaaataaaactgtttctttacccaca

SEQ ID NO: 5722 - DNA, 36659 bp, Homo sapiens
gccattttgcttgtgggctgccgcccgccgttgcctctccgcggaggctcgaagatagcaaactggaggcggtgagggggacggaatctctgtctttctgacaacagatgcattcaacaatccaccgaaggtttgaggaagtgtcggtattcggtgggactggttctttccccctttcccccagtggccctcaagtctggatataggtgagcttgggcatgccagtattgggtgcacgaacaaggacagcagggcttgggaacgaactccctcccgtcaccctccgaaagcgatacaccttctccccctcccaaacaaccccagtcccgtctccccgttcctctccccctcctcccccagcccagtctggcctccagcgctgggtgaacccggttggggtgtcactcgacgcccactaggggctgaggaggctccagtgcgcaggctccgggcaccggataaaagcggagctggcgagtctagtgctgtctcgatggaggagcaagaaacggaagaggtcggggggagaagcagccggaaaaatgcagccaccgtcaacgccgcctccctgccaccgtgcttcggggtaaaaagctgccgttgccgtcggtgcagttgccgtcgctgcctcctatacttctcttggcctcggggaaggatttccccaccggtgggacaatgtgcggggaggggagtgggaattcctttatatggcggtgattaaacgagggagggacagacagtgatctcgaagaaaaaagggggagaccaaagaataaaagaagggtttccccactaaaatgacacggcgattccggctcttgttttgggggtctttccccgaaatggtttccgtcttccccttgccccgcagcgacccagagcgctgggggaagcggagtggggagaggcagaggcggtctcggcagccaatcagcgcctgatgtgtcctgtcgggcgcgtcgtggttggctggcgatgacctcatcctgcagcagcgggtggggccaaagccgtagggggaggctgttgcaaaggtagagagggagaagtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctctttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgattcctgttctttatttcagttttctgtctgtacatcccttaagaatatagttttgtcggtgggattcgctcttttgtgcccaggctggagtgcagaggcgagatctcggcccactgcaacctccgcctccccgggttcaggcgagtctcctgcctcagcctcccaggtagctgggattacaggcgcccacaaccacaccctgctaattttttctatttttagtagagacggggtttcaccccattgaccaggctggtctcgaactctcgagatccgcccgtctcagcttcccaaagtgctgggattataggcatgagccaccgcgccgggcctgctttttttttttttttttttttttgcactgggcattagtaatacggaataaaagccgtgttttaaactgtattaagttgtaagacttttcagtactttcaagtctgctttctttctgttgcccttttgtagtttttaaaaataaaagatgcaattataagcacttccggtgaatattattccttaaggttcctgcatcatcatgaaatttgaagcacttttatagtagtacaaactatacttttagcttttgaaatctcgataggagaaaatatccagcagttttaggggctattttggcatattcattaaggtagactaagtttgtttttcgtttttcccacttagccaaactagttaaagtagtcaaaactagcaaataatttttaaagggcttctccttttgggtggtgtagagggtggggagttattcaacaaacacatttgcagccaaaatctggcctacttcttggcagagcgcttatacttggtgctacgagaaaatgattgctggacctgaaaagaacctgaggtcaaggttgtgctatttccttaagtcttagttgtaggctcttggtagtttgaaaacaagattgggtttttaattcatttgtgtatccttaaatcctcactagtttttgtggatttcttttttcagttataagcaactgaatgtggatgagctataaatatttagtacaaagaatgtaatttgtccactctgaatagaaagtaagcattaagaactcttgaatgtcttcaagggttactttgttacgtgtaagatgtctccccttccttcatagcagtttttattcctgcttaaaaagggaactaaatatgaagtcagtagattttaaggtaattttcagaatgtttctactttcaccgtgccttaataaggaaaaaaggccattttccaagcgaatggaaacaccctttccttgttttgtgcctttaatcagcgtgtaccttcattgttcctgattgccaaatccacgaacttcttgagctctcaatttttcttgactttcctatggcattttaaatactgttcatacttggaattacttttctttgactgccttcatacattcatatattctgcctgggcaatttcatttgggcctattatgttccaatacctctccaattttcacctccatcttagctctgccagcttcagtgccacaggtaggcaatgtaaaagtttactggggaccacaggctttctgagctcaataaaaatactaagcttggtacttgttttttaagaattttcttcccccatcccctcacaaagattatttgagtaaattacaccccaacctccttttccttgtttttgttgaaattattgtctcttaactttggaacattgcagttgcggtaagcttactaggttcacatagcatatcttctggtgtgttaaaattaaaatgcacaccatctcaaaagtgctatgccatttcatacctttgtgcttttgtcctgctacctggagtgcgtctttctcacttctggataatacaatttgaaccttttctttgcctcttgaaactgcaaaatccctactcgcaagtaaatgtgtcattctttatgttgataacccagcctagtgcttgacacttgatgggcattcaggtatacatggttttttagagattgataagattaactgtgcagtctataaactgtaaatactggcttttaaactcttttaaaggagctcttttgataaacaatttggataagagatgaaaggttagggaggctccaggcaaggcagaagactgctgatggcccagagatagttctgccccaaaaaggtgggaagaagaaaaaaactgagctggatatttttaaggaaatatattttatagcatttttctttaatgcctagttttgctgcaagcactgaagtttatcctgcatttgtatttcttatttgaaaaagaaatggcctttggggtttgttttgttttttgttcctttgtaagcacactgcaaaagcggcgttgtcagcgttgtcttttgaggtatcaaacgtgctttcagtcagcaaatatcttgtatatagtaccattcctaataaactaaattggttatcaacctaatacaaacggtacttcatacaacttaagcctaaactagattagattatgtagaaacttattcttagagaatatatcgccttaatatttcttatcctgaaaagagtatttcttaagtgcccctctcaaagtatatcgattaatatttgtctcaaatttaaaactatatcctggtttttcccttacagttgtttagcaagtaaatgtttacttactaatttattttctcccagacttcattctaccagtttaagcttagctcagttttgttttttggttttgagaaggagctttgctctgtcactcaggctggagtgcagtggtacgttctcagctcactgcagcctccggctcctgggttcaagcgattctcctgcttcagtccgtgagtagctggaactacaggcgcacaccaccacgcccagctaatttttgtatttttagtagagacagggtttcaccatgttggccgggctggtcttgaactcctgacctcaggtgatctgcctgcctcagcctcccaaagtgctgggattataggcgtgagccaccgtgcccatcctaaacttagctcagttttaatgctacttccatttctttatgtatagtttgatgtaagaataacagttggaagtaaggatttaggaataacaagagtttgggatttttgtttttttaattagcaaggtaatgccacatcaggtcattagtgacattaatgagagaacaggggaattattggaaagtcttgacttaaggccagacgagaaatccttaactgctagtgtgacttccctccccacaaaagagaatgctctcgtaatacaccgaactgttggatgctgttgtatatactttatatataatcttacccaaggtggcagagcattaactttaacatctgtctccctgacctcaccagagttcataatctttgccctacttacactgtctgaaggatgacttggcctttttttttttttttttttttttaattgagacagagtcttgcacagttgcccaggctggagtgcagtggcacgatctcggctcacggcagcctccacctcctgggttcaagtgattctcctgcatcaccctccccagtagctgggattacagacgcttgtcaccgcgcctggctaatttttgtatttcggggtttcgccatgttggccaggctggtctcgaactccccacctcaggtgatccgcccatcttggcctcccaaagtgctgagattacaggcatgaggtgtggcacaggacagagaaagacttactttaaaacatacctgtcttcaacccagaagagactggcttttagagccctcaatgtagcaagaagagcctgaatcagagcaggagtgataaagaaggaatctaagttattacagaaacatccgtaattgttgcctgggtgggtataaggaagaagaaggaattgactttcaagaaaaataattgacatttgatagtcttcacagataaaagccaaaacagggtagattcagtcttaataggagacaaatttagcaagaaagctgagatcttgggtcggtctacattttaggccaaggaaaaggaactgattgcatttgttttttaagatagattatacgccagtgcataacatatttaacctaagtctgattagctttataataatttttaaattattcataactatcctaagcaataccttttattgttagattattatgtaatgcccacaaatgatagatagcatttgaaagtaattgctggctgattataggcatggtggcttatgcctataatcccagcactttgggaggccagggttggtggatcacatgaggccaggagttcaagaccagcctggccaacgtggcaaaactctgtctctactaaaaatacaaaataattagctgggcgtagtggtgcacatctgtaatccagctactcaggaggctgaggcatgagaattgcttgaattggggaggtggaggttgcagtgagctgagatcgcaccactgcattccaacctgggggacagagtgagaccctgtctcaaaaaaaaaaaaaaaaaaggaattgcaagtagcctgtaatcccagcacttttaggagtccgaggcaggaggatcacttgagaccaagctgggcaacatgatgaaacccctgtctctacaaataatttttttaaaatattagccaggtgtctggcacacgcctgtagtcccatttacttaggaggcttaggtgggaggatcaccacttgaggccaagagatcaagatcagcctgggcaacatagcaagacccccacctataggaaaataaatccgagcgttccaagtgttcagctattcacccactttaggtttccaccttccttagaaagtagagtagtataaattatttctgaaatttgtgaaacgatgtaccacataaccctctcaaaccaggttgctactacttccaatgacttcattgataaggggcaaagtaactcgaatgatgggtgagctcatgacatggtttagctccgtatcaaactctggatttgggaaaattgctactgatttattaaacacttgaattcttatatgctaggtcagaatttggcaactaaactctcagaaatttgtaaacttcctttttacatagaaaagtgaatccaggctgggtatggtggcacgtgcctgtaatcccagctgctcaggaggctgaggcatgataattgcttgaacctgggaggtggaggttgcagtgagcccaagattacactgctgtactccagcctgggcaacagagggaggctctgtctcaaaaaaaaaaaaaaaaaaaaaaaaagtgaatatactgtactgtaaagcctgtgcacctcttcatcacacataattgcctgtacattatgcccagtgcctggcccctattggatttctgacaagctttaatgttgttaggttaagagagaacctgttcctcaagtttagtcttatctctagtatttaaatttttcatgaaggaaggctgtgctaaggcgatacttcattcctgaagaacacttacttaaataagtaatgttcaattaattttcctcattctatgaaaaacttgaaaaggcaacaaaaatattcactattctctggttcatttgataacaatattgtggtagtctaggcatctctcccatgtcccaagcacagcttatctgaccacatctatacaacagacattctgtagcgactctctttgttctattccatgctcctactttatggccagtgaaagggcaaatggaagtcaaaagggtaagaggacacgttagatagctttgattgaagcattcttttagaagttaaatgactgaaaaaggttttacaaatgacatcgagtcaagggttcatctgaaagtatctaaaagttaactagttccctttctccacaaactctgcccatgtaggtaagttttatttttctgaggaataagaaacatatgcagttatttgcatttataatattttgtgaaagttctgtattttcttgttttttttgagacggagtctctgtcacccaggctggagtgcagtggtgcaatctcagctcactgcacactctgcctcctgggttcacaccattctgctgcttcagcctcccgagtagctcggactacaggcgcctgccaccatgcccggctaattttttgtatttttagtagagatggggtttcaccgtgttagccaggatggtctcgatctcctgaccttgtgatctgcccgcctcggcctcccaaagtgctgggattacaggcgtgaaccaccgcgcccggccaaaagttctgtatttttatgagctccaggtggtcttatataacccatagcatttgattcctaagaatacatcctcttggccaggcgcagtggctcacacctgtaatcccagcacttttggagaccaaggcgggcagatcacaaggtcaggagtttgagaccagcctgactaacatggtgaaatcccgtctctactaaaaatagaaaaattagctgggtgtggtggcgcacgcctataatcccagctactcaagaggctgaggcaggagaattgcttgaacccgggagacagaggttgcagtgagccgagacgcgccactgcacttccgtctgggcgacagaaggaaactccggctcaagaaaaaatatatatatatcctcttaaaactcctttgcttttatgctaatactcttaactagttgatttcttcagcttcttaaatgttggatttcccagtgttgtgtccccaccaatgttacgttatccattttactaactgcaataatcaattcccatacctttacctgtcgatgactctagaatttgtaatctctgaactcaactgaaactactaaatacattacttgtcctatgaagtacctcaaactaaacaaatttaaaactgaccttggccgggcacggtggctcacacctgtaatcccagcactttgagaggctgaggcgggcagatcacttgaggtcaggagttcgagaccagcgtggccagcatggcgaaaccccatcactactaaaaatacaaaaattagccaggcatgatggcacgtgcctgtaatcccagctatttgggaggctgaggtgagagaattgcttgaacctgggaggtggaggttgcagtgaacccagatcacgccactgcactccagctggggcaacagagcaagactttgtctcaaaacaaaacaaaaaaaacctttctttagataatggctaaaactattttctagcttcataaaatcaaacacttttccaaaaatatgtttccagaaaaatctttttaacttaaaaaactgttcattgaccagagatttgagggtcgagtcaaaacacactgtgacgtgccaggtccttcatctgacccctgctttaacctcccaaagtgttaggaacatcatgaacgctgcttggaactagaataatccaagtttgaataccacttccacttcaaggaagacttaggtagtttgctttctgggactcagttttataatccatacagcaggtaaaatattaactatataatggcgttaagaattaaattagatataaaacctttcaggagcaattattgatttgtaatcccaattttttttggtccagaaaataagacattcccttctatttgttaacatgtgttcctatcatgctgtcatgttcatgttcctcttttccattagtatatgagatcttgatagacacaatgtttttcatctttatggctgaagtgcacagttcctggcatgtaataggcatgcagttttgttgcacaaatgaatagataatctgctttgatgccagatgcctgaaaatgttgcccatagtatgtgtttattacaatagaaagtcccttgaatataaaatttgatgcaaatggtctggttgattctataccatcatcttgtaagacttcagagggttttcccacacttttcaaaaacatgtatctattttgttgcaagctagaaggactagtccctactctattcatttataatctagtttgggattaagccacatcagtaagtaaccaagtactgtaagcattcagccagatatcccagttcatggggtaatgtgtttcacagaggaaatagaatttttggattaggaggcagatagttctgggtttcattagggaaagggtggggcagtagagtacaacatatttgcagtcagcatggttttatgtgtaaaggcataaaacagtaacagagacaatgttttaagtaaaccaatttcactgggcttgtgtgacctagtacattgagagatgagactggaaagggggcggattggaccacataattttattttatttttaatttggagtctttttttctgtgagtcttaggccactactttctctattttgtttcttttatatttaaggaaacagtctcagggaaatgactgactgagtcgcagtgtaatgggggacagagccaggcctgaacccctaaatattgctgttctacctctaagttgaaaataggacagtcagtaaagagtctgttgtatactgggttataagatctcatttctaatctaacttggatggaatcaagattagaaaaagtacttgattcttacatttttttcttccttgttgtacataaaaagagattggcctggcacagtggctcatgactaatcctagcactttaggaggcagaggtgggtggatcccttgagtctaggagctcagaatcagcctgggcaacatcgtgaaaccccgtgtctactaaaaatacaaaaattagcttggcgtgctggcatgctcctgtaatcccagcactttgggaggctgaagcaagcggatctcttgaacctgggaggcagaggttgtagtgagttgtgatcacgccactgcactccagcttgggcaacagggcaagaccctgtctccaaagaaaagaaatgaaatgaaattaggagcaagcatgagttttaagtgtcagacttcctttcccagtacactcacctactacaggctgcatgatcttattacttcactgaactgtttccttatctgtaaattgtttgattatctacaaatgtgtagcttgctacctgacagcattagatattggataattggttgtcattgctattaataaacacggacttagagagttcttgaagttttagttttatgctgagaatccatgtaacactggcaatctgtgtctatacctgtatctatagcaaaagccagaatttaccacaaattttgctgttgtatcaggaaatacatcttgacaactgatacttattcttaatattattattctgttatttcttattctaggccccaaaaacttttattaaaatgcttcaaattttaggttagcatttttgttgatgtttggacatcttaaattcattatactcatgcaaaatttttttttttttttttttttggagacagggtctctgtcacctgggctggaaaatatatctttatagttttatgcacatttggcaatcagcagaaataataaattgttgtactatgtctatgctttgctatctttatgtgaccaagacattactgtgaaactgaatactatctggccacatatataaccattgctattaagaaagttatgattgtgacttggaaatagtcatatggagacagttctgatttaattcccaggtaactttcatattctcaccattttgcagtgtgcatttcaaaataatttttcatatcaatttgtagatgtgggaacacatcgattagaaagctgaagctaacttattctcagataacaatcatttaattgtaacattgaattttaagaggaaaaatacagtatgctgtcttgtctttttctgccctttcttttccatgtatggctggttcatgttttgctttaataacattttttgcctgggcaaatgtccatattatacattctgatcactttaattccatcacccttgaaattttaaaaagcaaacgtttgatttagtggcttttaagttaaaaaatatttatcgacatctctcatcattttatcagcttcgttggtacttaacatggtagttctactttatgaaagaagcccgtcactaaaatacaacattcaaaattaaaacataaattttcataaatttcacagtgcttttttgtgtttgttctagaaaccgtatctcactctgtggcccaggctagagttcagtggcagggcagtcatagctcattgtaacatagagctcctgggttcaagccatcctccaccgtcatcgtctccagtagctaggaaaggcatgtgccaccaagcctggctaatttttaaaagaatttttgtagaggtggggtcttgctgtgttgcccaggctggcctgaagcagttttcctgccttgacctcccaaagtattgggattacaggcataagccaccacaccaggctataagagtgcatttttaaaaaagataaaaatgtctaagccctgtttgagttgtaaggtgtcatcagatatgatgctgggtatatcagcttattcctttcttctgaaggttgtttttatgctatcttaatgaaccatcaaaggttctgaaatcaaacattttgaaaatacttgacttacggccattttatatcaagtgtatatgcttttattgtttgtgtgcttaaaactggttattttcatgaatgtactttctatggatcgctaaaggtcagaaccagctaagaatgaaaatgagtaccatttatacttactgtcagctgaacacttgcattatttttacctttatggtgtatcttacagaaattagtttttaggtcgtggtttcatacatagcagagcagctccctccctgccatctattcaaagtcagccctggacacagggtttgtccaccccctcgcgcatgcctggcgtctccgttgccatccgtctctcttacttcctccctctcaaactccctcccaacacccctgggggcctccttccctggtccacgcttgcccaccctctccgggatcccagagcaagtggcgggtatctcgtcgaaaagcgcccgtctccatccgatgcctttccaagctggcggtgctcaggggcatggtgccatgctgggggtggccgaggttgcaggggtgcccatgcttggtgtcccacctctctagttctagtctcctcccccaaccctactaggggcttgtccctggtctgggacaggcttggaaagtgtggcgcgagtatggctgaggcgtggttgtttgagggtgtgaccctgcagtccctgtcccagggataggggtggccgtgtggcccaggggtggccgaaagtggcactggggtccagccctctcccactctgtggtggagtggggcagtcactgcccttgagcccttttaaaaaaaaaaagaaattagtttttagtgataggagagagaatctttttgccaatgaggtagttgagataaattgagataactcagatataggtactatattttcctgggtattatcaaatttgatctttttttatctatcaaattggattcatatgaatcaatttattcaaataagtggttacattaagtttttttttttgttttcagtactttatcctgtgtcttgctctcatgggtaatccttaacgtagtcacctaagttttagttcccattcttttccatcctcctccttttttccatccctgtactctccagacttccctctggatcaactatgcaatttctgtatgttaatgtaacaacatatactccttctgcaaatattaatagatgtatgtcatagtgttctaaatttgttatctttacccctgggggcaagaattcgttttctttttaactggcaagtcatactttggtactataggaagccctcaagcctctgtgaccagaggttagcatagggaaattgagacattttaaaacgtttttcatattaaggtatgaagaaaactgaccttcattgtactttggtagtagaccgcttcctaattcattcctttaggtccaagtagccttctctgaaattaaaaacaaaacaaaacatattgaaaaagattgtagggtgaagttatatgccatcaaaatgatgatgacatacaggtatttttgtgtatctctgtcttttttgacaaccaatcaaattgaattttttttttttttgccagttaaatagaaactggtggccaggtgtaatggcttatgcctgtaaatcccagcactttggcaggggccaagaaggatggattgcttagcttaagagttcaagaccagcctgtgcaacatggtgagaccctgtctctacaaaaaatacaaaaattagctaggtgcagtggcgtaagcctgtagtcccagccactccagaggctgaagtgaaaggatttcttaagccccagaggtcaagactgcagtgagccatgttcctgctattgcactccagcctaggtaacaaagcaagaccgtttctcaaaaaatatataagtaaataaatagaaactatcaaattattttcaaggataaggaaggactaatcagtagtttagtcagaggcctagatcaaaacataacatgtatttttaaattaatctctttaaatgcatggttaagttacctgtatatgtgctcagtaaaatcggtcatttgtggggaaaaaaatggctatttggttttctatgcataaaattaagatagaagtctttttcctcctaacagccttcatcatagtggatttaaaaaaaccagtgtcacttaggctgtgtcttatttgtttctaaaacaatggaacaagtcagatgtttgtggaatacattttatatttgcaaataaagtaaaaattttttcttgccttttttatgaaataactataatttgtgtgaagattaaaatactctaaaacatgaattgacaaagcaaaatgaaggagccagatttcaaaatcaagttgtggggtgaggcatgaggatgggaagaagagaattaagcattgatatatggagttttaatttatttccttaaaattcatagtgaaaagaataagattttgggggggagggcacggaatctcactctgtctcccacgctggagtacagtggtgcaatctcggctcacagtaacctcagcctcctgagtagctgtaactacaggtgcctgcaaccacacctggctaattttttatttttagtagagacagggtttcaccatgttggccaggctggtgtggaactcctgacctcaggtgatccgcccacctcggcctcccaaagtgctgggattacaggcgtgaaccaccgcacctggccaaaatttggtactttataactcaataattgcaaccagaccagctaactttttgaaaacttggggctctgtaatgttcagatgaaggtaaatgtagggaatagaccctctttagattgagggagtaggagttttgacatcacaggtcgtttggacttaaaggtatgaatttgaaagtagtttggttatacatgtcctttgcaacctagcctctctttcattagcggaattaattttggtggagggattcattcatattgttagtatgtatcgagggaggcattgtataccagaaggctttgaactggttgggagaagtgttcttataagaacagggtaattattaatcataataatctttgtcaaggtgcctaagtaactcccttatgtaatagcagccagtgattagatagcttcacatcaagcaggttggatttgttccttttgaatcaaagaaccctttgcttcataatctaggtcttgtgtctcaccgaatcctttataatatagaataaatggttgaaaggaaaggctcacattctgtattcctgaaattcaaataggataactttctcaaagttttaggatagaccaaataatgtatgtccatgtagctctaagatatgagtcaacaaagcaaaataattatgaaactcttgtgggatttttggtagagtttttatggagatccagtgtatatgagaagcaaactaaagagagttgccaagggttttagagccagtcaaattcctagactttaggatttgttgaatgaattgaatggaaaccagtatagttgtcagttttaagttcactcagtattagcattcaattagatactgagttttaaaatagttttttttttttttttttttgagacagagtctcactctgttacccagactggagtgcaatgttgcgatcttggctcactgcaacctctgcctccaagttcaagcagttcttgcctcagcctcccaagtagctgggattataggcgcccaccaccatgcccggctaattttttacttttagcagagacagggtttcaccatgttggccaggctggtctcgaactcctgacctcaggtgacccacctgcctcagcctcccaaagtgctgggattacaggtgtgagccacgaagcacagcctaaaatggatcttttaataccaaataaggacattgtcttatgatttaaaaagtgtctttttaaaacctggctacattgttcttattctcactttgctatagaataatgaaaagttatccaacattcattttggaatattgttttggaataattcatgtatctcggctgtctgattttaccaacatggaaagcataactcaaagacaattctttaatcagtttttaaaatgaaactacttttctcagctgttaaaaaaatagatttataataatagtcatcagcattcttttaaattgtgacaagttagtcttagaaggatacaaaaatgtataaaagacttgtgaatttctgacaaatttaaattaggatatgtccataaatagcaattaaaattgtttccaaagagttatttcaaagcatcacatattacaaaaaaatggtgaaaatataaatataggtcacaatttataggacttttgtatattgtgtatgtttccatagaaataggtaaaggaaataatggtttctttttgggttataggcttacagatggattttctatagcaggcgtatgttaccaaaaaaatgggaatgggctgatgcttggatattaacttaaaaatgggatacaaactggccgggcctggtggctcatgcctgtaatcccagcactttgggaggccgaggtgggtggatcatgaggtcaggagttcgagaccagcctggccaagatggtgaaaccccgtctctactaaaaatacagaaattagccgagcgcggtggtgggcgcctgtaatcccagccactcgggaggctgaggcaggagattgctcgaacccaggaggtggagtgagctgagatcatgccactgcactctagcctgggcaacagagcaatactctgtccaaaaaaaaaaaaaaatgggatacaaactgaaaacagtatggtctcagattatcagaagcctaggaatcatcttcctttctttaatacccatgttccttatgtccctaatgtctgttctaactatagttcttggcctatctcccctcgttgtcttcactcccactgccactactttaattcaggtctggaaaagtgtattcagtcactcactctgaatatttgctaaatacatgagtttgtgtatagaactgtgtagtaacctcctagcttaccctggcttttaatttttctaatccatctgttaacacttcaaagtgattttacttaaatgtgtatctgatattgcttgaaagcttttaatgaatcccatgatctgcctcttgcctttttttccaatcagaagtacccagttgctgctgcttttgcttccagccatattaatacagtttgagcatccctaatctgaaaatccaaaatctgcaatgttccaaaattcgaaactaccaacatgatgccacaggtggaaaattccacacttgaccttatgtgataggtcacagtcaaaacttagtgtcatgcacagatattaaaaatattgtataaaattacttcaggcagtgtgcataaggtgaagcatttatgaaacataaatgagcttatgtttagacttgcatcccacccccaatatatctatctcatgtatatgcaaatattccaaaatccagagcacttttggtctcaagcatttcagataagtgatacgcaacctgtactattatctcttcatagaatacccctgtctattttgtgaatgcaagtgtttttctgtgtagccttctctgatctttttccaataagtcttattttttataattccatgtaccccagctctattatagcgcttaactgcagtttattacaattatttatagcctctttacccactagaacagcagtccccaacgtttttggcaccagggaccagttttgtggaagacagttttttcccatggatgggatgtgggggtggtggtggttttgggataaaactgttccatctcaggtcatcgggcattagttagattcatgagattctaaactccccactttatgtaacactctacttctttcttttcattgatagagataatatttatgcatatttaggggcacacgctccttattctactcctgtaacatagtagaacttattccttctaactttacttttgcaccacttaaccaacttctatacatccctccttcccccaccccacttaatataagcatcttttattttttatttttgagacaaagtgcctatctcaggtcatcgggcatgagttagattcataaggagttagattcatagatccctcacatgtgaaggttcacattcctatgagagtctaatgccacagctgattggcaggagacagagctttgggggtgggggtaatgcttgtccacagctcacctcctgttgtgtggtggggtaggggagggtgttggggaccccagcactagaatatgagcccctgaagagcagaatatctaacttgcattgtctccctcagataaaaggattcagtttattgttaaacgggtagtgcctgcatttgtacctaggacatagtaagtgcttaagtaaattttgaattaattgggtctgttgtctttggtgtaagtataaatctgcaaaatatctcctaaacctagattgtaaagagaagaaaggttagagatgcatttctgtagttaatgatgattaatgtccaagaacgtagccatccttagtaaagaaaaaataataccaagaaaacagttgggcatatattcctcttaggtttcatcaggcacaattatcttgaaagactagcaatcccacatgacacataccctggtactcatgtgtccattgcaactgtaaaggtactttaacttcaagggaacttcaaagaagagaactttcccacagttcactttcttaacagttcagtggccttatttacaggatgaaagttcaggtagattttctggcatcttatttcaaaagaatagatactgtcctccaagtatggatgcagagacatcaacacttaccaacatgcagcaacagtcataggaactaaacagatttgtagcccaaaatggcactggtaaaaatacatgtcagtctgcacagagattctgaatgatttacaattaacagtagatgatgatgttaatacctgtttttaaaaagttgagtccatcaatgtgctaattaatcccttccacaacgcaagcaagtttgtattctttggaaagatttggcaccaagttaaaagtcacttctaagttttgcaaaaataaataagttgatttattctgttacatagataccaacaaatttccaaagtggtagttgtaggtactacataaagtacaagtttccctgctatggacatattaaaatgctgcaagttggtagttcccaagccggtttgatcaccataatcatttctgaaacttattaaaatactcttaggcttcttacccacaggtcccagaaacaagatgttagatgtcatcattcataattttcttacagtgtagcaatttttgaagaaccatatgctgcactatttaataaaaatctgcatttttgacaaacccctcattcccaggtatttaatttgcaaatgctacattgataacactgatatatggaatggattgcttctctaaaatgtctgtggaaagcaacagtgcaaagacattatattttcatttctttttgggggagtgttactgtaatattagacatccgacctgagaagtttggaggtactattgccatgaaccatttcttccgtaattcaaaagttatctttgaagtgactctgattacctgggacgagaaggcctcatttctgggatgcaggcatgcattttaacatagacttcaggacaaattaagttgatgtttgctgcaggttgctatgaaaatttaaattccactgaactcaccctcaatctttagtgttcctactgggtgatatttaggattggctctgggaacatgtgttaatttttcttagtaaaacttatttaaagcttcaacactaatacttctctaattttggtatcatgattcattctcagctttaaaaataaagtgtcctggatcagtttccttttgcggtaactccaagcatatacagttgactcttaacaactcaggggttgggctctgacccacttcccatgcagtcaaattcacatataacttttgactccccataaaccaaacctaactgctaatagcctactgttgactgtcagccttaccaataacatagtcaattaacatatattctgtatgttatatgtattatatactgtcttattacaataaagtaactagataaaatcaaatgggctgggtatgatgactcatggctagtaatccctgtattttgggaggccgaggtgggaggatcatttgagctcaggagttcaagaccaccctgggcaacaaagtgagaccctgtctctacaaaccaggcatggttgtgcatgcctgtagtcttagctactcaggaggctgaggcaggaggattgcttgagcccaggagtttaaggctgcagtgagctatgattgcaccactgcactctagcctgggtgacaggatgagatcctgttgagttcaagaccagcctagctaacatggtgaaaccccgtctctactaaaaatacataaaaattagccaggcatagtggttggcgcctgtaatctcagctactcgggaggctgaggcaggagaattacttgaacctgggaagcaaaggttgcaatgatgaggaaaaaaaaatatatttactgttcattaagtaggagtggatcataaaggtattcaatctcgttgagtaggctgaggaagaggaggggtctttctcaggggtggcagaggcagaagaaaatttgtgtataagtggacttgtacattttaaacccatgttgttcaagggtcacctgtatttaaaattccacattcaaataaatttgacccttgtgtatattattaataatatacataattcttagaataataaatgaatgttagattgtaaaatcattggcctagaggagttgcctaaagattgaaataaaccagcttcttggcttctttattttttaaatgaggggcagacacaaagtaaatttccaagtcaccttgaaatcaggcactttgaagcctagctatgagtaaactcagttatactgtctaatacccattttagcttttctgtttacagcataaactttaaggccggttttagttcttttaagaagtcaaaagcagaacctctctagcagaagtgtttttcaaacattaaatcctaaaccaaaaaaaaaagtgaccaaattacagaactctaggagtttatcttacctacctaccgctgaaagaggatttttctttttaagaaaattagaatattctgatggcctaaacttttcttgtcaaacaggtaaagtcttgttagcccagaaagtatctcttcttaggagtgtttagatttgttgagagagagaaggctttatttcttttttagtagagacggggtttcaccgtattagccagaatggtcttgatctgctgaccttgtgatctgcccgcttggcctcccaaagtgctgggattacaggcgtgaaccaccgtgcccagcctgagaaggctttatttctaaactccccacttaatgtaacactttacttctttctttttattgatatagataatatttgtgcatgttttaggggcacatgtgatattttcataattgtataccatgtgtaatgatcaaatcagggtagttggaatagctatcacctcaaacatctttgtgttgggaacattacaaatctggctattttgaaatatacaatataaattattaactataattttcctactgtactgtaaaatagtagaacttactccttctaactttactgttgtaccatttaaccaacttctatacatccctccttcccccaccccacttaatataagcatcttttttttttttttttgagaaaaagtcttgctctatcacccaggctggaatgcactggcaagatctcggctcactgcagtctttgcctcccgagttcaagcatttctcctgcctcagcctccccagtagctgggattacaggtttgtgtcaccacacccagctaatttttgtatttttagtatagatggggtttcagtatgttggctaagctggtctcgaactcctgacctcaggtgatccgcccacctcggcctctcaagagtgctgggattacaggtgtgagccaccacacccagccataagcatcttttaaaaaggtggaggggggctatcaactgttattttaagcatagtaagagttcaccctactacttttacaatgaattactgcaagatgtttagacattgtgatctttttattacggttactgttttccctaaaggtcaaaccaataacttgagatcctgaggtgcaactcaagagtagaagcatcacttaatactagtaacttaaaagaatagcagatctggctcgctgtggtggctcaggcctgtaatcccagcaccttgggaggctgacacaggtggagcacgtgaggtcatgagaccagcgtggccaacatggtgaaaccctgtctctgctaaaaatgtaagaattagctgggtgtggtggcacacacctgtaatcgtagctactcaggaggctgaggcatgaaaattgctttaacccgaggggcagaggttgcagtgggccgagattatgccactgcactccaccctgggtgacagagtaacagtctcagaaaaagaaaaaggaatagtagtgggtcttcagatacttagatgtcatgagctgggactttaatgggccatttttaaaatttgacattaaaaattccgtcctaatgccagtaaataattttcatcatttaattccgcatgtttttggtatattcatctagcaccttctgaatgttattagacctcctatatagttaaccttggatatcatatggtggtttggtagacttttttttttttttaatacacacacgtcttttagcttggttgatatgccctcagcctgaaagataacaacttgcttatttattacacaaccagattacttgactccctatgtttgaagtccccagtttagattggttattaagtaagcattcattagattttcaattatttataaaagctaaatataaagaaccacaaactatttcaacaagttaatacagccaaagcatatagataaatatatgaaacaatacagtaaatacatgagaccaaaaattcagtctttcatcagtctggaaataaacaaatattttgtgtgtgattgtttctgaaactgcagacaggtatttttaattcttaactcctactgtgttcagtacattattcagaagattagccaggaacagaaaatgtgcaatttaatttcccttaggttcaaggtataagctaaacagagtctttccctgcacaaattatcaagttggctgtgtttcactggataggagatgggacagtgggaatcttgtttgttcattgatgggcgtcattatttagatggtgaggcatttggctaccttgaaagtcatctttactccctgttaccctcactttattgaatttctttactttgactttcagagctctgggcagaaatcacatattagtttggaggactttgttattttattcaagttaaagtatagggtttccccaaattgaaaaccagagtagcctatgatcattccctgtgggattctttaactgttaaggcaaaagaaaatgcagttgcacttaagagtatatggataaaataaagaactgtgaagtgaaaaggggagagatttttttaaagatgactatattttaactcctcctgactagtaaattcaaggataccaggaaagatgaggtgtagactttaaaccttccaacattccattgtgttaatcattcttcctcatcaaagaggcagtaagggataatttagagtgactacagttacaaataatgtgctgtataagcacccaagagcagagataaggatggaattaagggtgttaaagaaaatatggcctctcttctttaccatttgattgtttttgctgtccctggagactcatatctctctctattcctaggaccaaagtttacacaactgccaaatatataaacaagaacaccccttaaaattcctgtgaaacattgtacatcttaagagagcagatgtgtctatgggctgtcacaaatatcagtcttgctatgttaagcataaacttaacaaatattagtggagacacactatttaggattcgcctaaaaccctctaagatagaggtccccaatcccggcccctgatcggccgcacctgcaggaggtgagtgatgggccagtgaacatcatagctgagctcagcctcctgtcagatcagtggccgcattagattctcataggtgtgagaacccaattgtgaagtgcacgtgtgagggatctaggttgtgctctccttatgagaatctaactaatgcctgataatctgaggtggaagagtttcatgccaaaaccatccccttgccctgtccattgaaaaattgtcctccacaaaacgggtccctggtgccaaaaaggttgggaaccactgctctaaggtgtccagtgttggctgacccctctccctacttatgcacccattggcttgcctaacagctgattgatttctgtttaaatagacacagtatattggggcagtttattgcatctttggtcatctcttttcctctgggtccctaggacggaagacaatatcctaagttgattctgtctaacaaaacatgagtaaaatgaggaattggttaggtaggtggcaaacagcaaagattatatggacttgtagcttgctccataagtagactttaaccaagtaagctatttgaaaaacaatcttaatttttttcaagtgttatttttaattctataggaatattttcataaaaataatgatgtccattatgttagcaactagaattacaatggcaagttttaggagatgcttgaaatgtgagatgttacatttaaaactataaagttatcgacctaagtatatgattgtacccatgtggcagtaaacttaaaacttccagtttcaggttttgttgtttgtttgtttgtttgttttaaagagttgttaatgggggaaaggaaaggaatatgtgagggagattggcttgcaaagcctaaaatatttcttatgtggccctatatagaaaaagcttgtgtattctggacaagagcaattaaaggaaatagtttggacttaaaacttctaaaaataaatagtgctcaaattgcacttggaagtcagagaccttgctggtcatcaaagggttcagttcagtcagtagttagaaaagacagaagccagcttagccaagagtcagaatacaaatattcagaaccgattaataggcaaataattatatataccatgtcccagccagtagatggaataatatgccaccattaaatttatattaacatgtaaaaatgtttggagtttagggctctttacccatatcttagtgacataggaagaaaattaagataaatcacaagcaactagaaaatagacatgttaactttattttagtacatactctggtaggatttttacataatcttacgtactagtcagccttcttagaagtgtcacatagtcaatatccttaaagagaaatggaagctaatcaggtaagtaaattgtgagctgaggcctacatcatgcttgctattcaaagagaataaagtaattggataaatgataatgcctccttgttgggaaaacagtcttcaaaaatggcactaagttacagttctaatgcaatagagtcactaattactatgaatacttgttttacttggcagattactaacaaagttaattggatacaataaatgtaaagattttcttttaaaacgacagattcttcagtgaggtgtaaacattttatagaacaattatcaaagctatattggacttaaatattggtcatgaatgtatgcacaccccataggtagctgccctccttgggcagcttttgactcctatgccaaattttaaaataaaggccgtggccaggcgtggtggctcatgcctgtaatcccaacacttcaggagtccaaagcgggcggatcgcgaggtcaggagatcgagaccgtcctggctaacacggtgaaaccctgtctctactaaaaatacaaaaaaaaaaaattagccgggcgtggttgcaggcgcctgtagttccagctcctttgggaggctgaggcaggagaaggatctgaacccgggaggcagaccttgcagtgagccaagatcgcgccactgcactccagcctgggcaagagcgagactccatctcaaaaaaataaaataaaggccatatgtttaatcacattccccaaaaggagaacttcataaggcactaatgagtaatgtttattttacgaatgattttacgggaaaaattacagaggatgtttaaattgcaaaaatactcctccccttttttctcctccaccgccccccaaaaaaaatcctttgcagttatcacctaagctttttgggtgtgtgatttaaaaaaaaaaaaaaaaaaccacaagacctaccttaacaatttaagtatgcagtattgtttcttctcagctgcccagtctttgtaattcttatttcttatgcagaacaatttagcatttgaccctactatcaccaaaaaaaaaaaaaaaagaaaaaaatatatagcagttgagggcagtatacaagcttagtaagtatattctggtacttgcttaggaagtaggaaatgtgatcagattctgttctctaccatatgacactgatttgcaaggccccgggtacaggactactggtaaaaagaaccctgtaacttcctgtcacagagggacacagcaatatatataaaacagcatctgccgtaaatctttggggaacgtcttactagatttaaccagctaattttactaggtatttaggaaagtgtgactgcagttcagggtctttgttttttcttttaagacagggtctggctttgttgctcaggctggagtgcagtggcatgatcaaggctcattgcagcctcagcatccctgggctgcagcgattcttccacctcggccacccaaaactgggattatgggtgtgagccaccacacctggcctcttatatcttgattaaggtcctgtctgggcctacaaaggttcaatttgcttaaccccagcactttccctcaacatggaggtccttagtcaacattaaccaaggtaataaagagttgaaagttttaatcataagtaggtggaggagcatttaaactggtttaataaacttgaaatatgaataccttaaatattcgaataacaaagcactggtgaaacaggtttttctatggaaagaccacaattttctatccagcacatttcatttgactgggttcctttgtttctgtaataaataggactttgagaattccaaatcaaatttgcacttttgcacaaaaggttcacttggtgactctcatgcctccataagtgtgttccatctgattctgcacaacctactgccttcagggtatcctgggaccagccaaagagatgattccaaccagtggaatcatcattaaactagtggttcttaaaatatggacactgagtcaacctgcatcagaattactgtagattctggacaaatgtacgaagtcaacatcaaatcagtgctacattttgaaaaggtaactgtaataaaaagatttttttgagatactgaaattgcagtgaagacaatgttcccacctttttaaaatggtgtaatattaggttcatttatggaatgttttatgaagcagatttgtattttaacaagccttttaggaatgcagatattataggggataacatgaatggtggtaaagaggggggcatatttgagcaatgatttttcaagagctatgaatttacagtgcaatcctagcaggaaaagagagggagaaaagaacatctattttgagctgcagacataattgcatcacagctgagatttcatagtccccgtcctctctattcctgttgaattacatgattaaaggtaactatatatatatgaatatatgaagatgtttaattgttgcaggttggagaatttgggccagggagaattcacttggccaatgagttaaaaatgagaaaaggattagcagtcatcaaaatttctaagtagttaattatctgcatggtgggttcagtataaacaaacatggtactctcaaatgactgttgatgggctattaaattacattagtatcctgtgaaccctggtcatagctggaaaggagaatcttttgagaaatggaaaaaccaggttatttgtacataaggaatatgtcttttaaacacccccaaagtatagattaagacgtgattgatgaaaagtctccattttctaatgatggttttatgaaaccaaagtatttacaactaagaaccaaccatctgatcgccagtagagagtggaaaataggaaagggtaacgtctcagtatggtatctggagtagtctggctaggaccataaacttcattttgtttacaagttcccagaaaataagcctgaatgagcttagagcttaatacttccagtgatggttctctcttccctcaagtatacagattaactatttttgtgccgtgggccttttgacagcccccaaaagcccgtggatcccatctcagaatgttttacatgtgtattacataatgctcacacattctaaattttatctaccgactcctagttagaaatcccttgcaaggggtgttagggttctgagagaaggctggtaagtaatgaggcttttaacttatttcagtatcctgttcaggtcgggaatatgttgtgttctaattactctagtttccagctcaattggtgttggagaaactagcccacttataagtggctcaaatgaaaacccacggggaggcatttttctttaataagcaaccctaagccccctttgaagtcagtctgactaatcaaaagaaagaggttatatatcccagttttgaccttttgtgaaaatagcccttttactgtatgtgatatattattggcatctcattctgcacagtccaaatgatgtagacaaaatagtgattggtatataactatggacaccgaagatccactgcaaggcctgccgatcactttacacagaaggagcccctttcctgaggtccgcttgctcgctcggggtggggtggtactttgccctagtaaactaccaagcagtccgaacgttcgctcctctggaagaccgagttgtgggcggctgcgctgcgggggcaaactcgccgcatgcccgctggccagagcgagtcggggcctggcgttagggcaatccagactggccggcatggtacagggcgtatccctagccgccttctgtgtcatatggggcgccgccctccagcctaggagaggcggccgctaggaggggcagaagggccttgtctgccccggtctgaataccccaggcggggtcggaaagcgggtcacagaagagcccagtaaactgcaggggtgcagctcgtctccaggaaccggcaacccccagggccgcacaagccggtaacaacccataatccgatcctgtcttcgggatcagaagagaggacagctggcccgcgcgccagctcagttcctcctccgcattcttcaggaggagccccagaaacgcacttccgccgcgcgggcctgcctccacgcagggcgcgtcctaggccggttcatttccgcccagcgctttctgtggctaggggagtcaggggtttccttttcccttattcgggctcttatgttacccccgttttccgttgaacccttttctcccctcttgccctccaaaaaagcagtctgctgccgctcccgacttttctcgctgagacaccgtcagctcactccgagcccagcacagcggccatcttcggtaaattctggcagcagcccgcctgttcattgtcctgtgtgcccagaggaaagaactactcatttttcgtgatcaagctaggggaggcaggagcaataatggccctgctataggactggcttttatttgaattccaactcttctgccaccttaaccagctgtatccagattttaaaagttaatctatccgagcctcttattaaatattaggttgatgagatgatgcatgcaaagcgcttagaacagtactaggcataaagcgtccgacataaaggttaagtaaaagtaaggaaaagctatggggatgtattgagtatctctttgcccaatgacgtattagtcgtattaaatatggaaagtgcctttgattcgccgtgcccatgggagaaggcataggaatggccttttcccacctgtaatcagagagcaggtgtttcaagaacgcctcaatatgtttgcgatctctcacgcagcctttcaggctcctaattcctacgaagtttccgcttttattcaaattggctcactcctttttgcagggctttgtactgaatgagtattcttttaagggtggtggacaagcaaaggtttggtagcatcacatttttaatttcacagggaaaatgggtatgaaacatcttcccaagtacatcttagactgccagctgacagcaagccataatgctccccagctcttgggccctacaccccctctcccccatccccgctttagttctttgtcattgctcatggacagctggtttggggaccaggtgcagatgatgggaggtgtctgaaaaacagcaagtgagaaatgctagttttgttgttttaagttgcactgatgactccagtagttatctgtgctgcttgtgataatttataaggcaatgataacgaattaaacatacaaaagattattatcttccacaggaaaaaaaaactgcaaacttgtgacaccatttatgatccacttagtcttgagatactgagtaatagaactttctccttttaggctgagttatgaacttcggtttggtttctttctgcaatccctgcagggccataaattcttggcccttaagactgggtggcccataacagactcagtgataccatcagtaaccacaattcacactggagtcaagttatctgattcccacaccagttggagaactggagattccttagaacttttaactgtcatgttttcaaagttgacatggaaaattttacatgaagcttaaaaatacaactaatctgtggtgatagagacgagaagagttaagctctaaaattagaagagcagttcgttttgaggcagcactgattgggagggagcatggagtatataattacacatttctatgtaatgtaaaaatgtatagatttaagatttatgcattttatgtaaattttactacaataaaacgaaaatgaaagaagacagatcatagtttaatcaaatattgtgtacaaagtaatttctgttaaacatttatatttttatgtgtatatgtatcttttacatgtatgtgttaaggatatgcattaaaatggtaataacttcctctgcctgttgggataatggagagttttgttactttttgtctttttttaaaacatgttcttcaataataatgtattgcttttgtaattatgaaaaacaaaagttattttgtaaatctttgttactgataagagatgggtattctgttaactactcaattctcatgtaggaaaacaaaataaataatgtctatttgataaatcgagaaacagaagcattacttagaaatctgagttacctctaaaataatgactggcatttgaagttgaggatgggtcttgagttcctgtgattttaagctcttggatatgagggttgggtgagttcctctttttctcttttaaaatatatgtatgtttaactttgctaaataaaatttaaaagatgcaatgtatctcagtgcaatttttaaaaatttattttcatccaggttactctaccctttccctttgtcattcagcaggcagaacaaggaaaaattaaacttctaactgaaaggaactttgaatagcaatcaatatcaaattagagacaaaatataaatattgctcaatataaaatgagggtttttcttaattgaggggacagaaatacagcttctcagttatcataaattgcatcttttttggggagggcctttttggcttgcatccattaccaattatatatctttcactactgtgggaactgcattatggaaacagctaaagcttgtgtatttagcgccctctagtgcattatcttataactgataatactccaaacagctagaaaaaatgtaaatctcagtccacctcccctctttgcacctacatgtttcctagccatgagacattaggctgtgacctcacagtagttctttaatctctaggcttcaattttctcatttgtaaaatgaggacgataataaatactagatagggtcctgagaactaactgaatggtctatgcttgtgacatgaatgcctggcacatagtagaagctcgattagtgctagctactctaacatataaatagatcgagtcagtactaacatgattaaagacaagtaatcttgactcagatgtcagaatctgctagtaggaaagtggaaaatgttaaagaggaaccaaaaaataaagaatgaaggcctgggtttgatactcatctttggttcccttttgagtcaattgatgccaattctgaagtctgggaacatgttaaattcctttgcatccttcacagtgcatataattgcacactgtcaacaaatatttgtgttaatattcaagctaaatggttagcaaacaagatgaagaatgacagaaaataataattagtataaaaatttgtatttggattcaactttctgttatttgaggcagaagccaaatgccattttttggattgtagcttcggaacaggctgtggacaagatttgtgttacccgtgtgcaaatgagcagcataattatactgtgtgtttcatatgttcgctatgtgacttttgtgactcattactgacaacgacaatagtaggttctagaatcctgccgtcatccattctcacccattttcagcattgcataggctatacagctaaaatttacttcctcagacacattccaagagataccttctctccacatagtctacatgaccatctatagttcttttcctgcactgacagacatagactttggtacttaataccagtacttcttgggctctccaagaacccagttgcttgaggaaagcattgggtgcttctcaccctgagtccctggaatctttggttgggcctgtatataataaatgtccccattgcttatttttcttgtgtgctttatattagacatgtcacagtgttgtctctccttcccttccattgcctcagtgctaaaccagaccaattttctcatgaaaggtacatgatacaggtaaccatgcattgtgcctctattaatgcttatacattatgctaagcattttacatccactacttctttcacaaccacatccagtaatagagtattcccattttccagaggggagaattgccctagttcacacagataaatggcagagccagacttccaacccaagtctgcctctagaatctgtggattcaacactgcatcagaaactccaaagggaaaattttgagttgtctgtctccagaaattcctgcaaggaaaatcatgaagctccctttaggcactaagccataagttctgaggcttcatccttttcaagaaaacccacctacctagccctgataattattagaactgcgatgactcacatttacttggcacctcacagttttcaaaggttggcccatggggtatctcattttattttccagaaaatcttttgcgttcatcatcaactgagtgtccaagctggtgaagcaagttcttttctggcagaagattgcagctcctattatttaccccccaggggataaactgcaaatcccaggccttacagctgggaacacagagctagctgtgcaagcatataaaaaaccttgacaaagcaggaggggggttcacatactggctatcctcattacagtgcattgggcaaggagctctcccactggaagctgtatcacagaaccacaggcactgccttggcgggcaaaaccacattcagcagttcttcaatcagccagggccttccctgcccgtgtgctcattcatttatgctacgcatgtggtctcttataattgcttttcctctccttaactctcttttcataccccagcccctacccccaactccctcttgtccttaaaagcttcttcctgctttacaccttaacctctttgtaggatcccagtaaatgccaaggcttgtgggggtggaagattataaatcaaagccacagacacagacatgggggaggagccacccagggggtggaagggccacaacttcaaaacaaatgagcctctttcatcccagtgggatttttgttttttaaggtctgcagttccggtggggcattaaatcagaagctatggtttctgggatttataggaagaacaacaactagagagttgtccatatgtgttccctgagtttcagcaaaacttgggggcctagagaagtcctgttatttttaaaaaagtgtcgtttctccgttaacaaaataggtttcacattttaaaagcagcttaaagcatagcatcaaccattcttcctccacaattgagaagttccattaaatgatagaaggggtcagatttgagatatctgactaaatattatttaagaaaagttaaattttgtcagttctcaattatctgtgctagtggaggggatccagggacagaattccactgggactttaattcacttgttgatttgcatttggcattatgaggcattttagtaatgaacactttaatatgggtgtgcctgcagttctggaaatttacaactgtttatagcaaataacaaagctactcagtgaagatgctgacagggctggaatgctgtcaaatgacttttccagcctctggaccaactctgtttactgaggcctggaaacaaaataggctttggcttcagacaggaacgtttaaatccttagactcacattatcaagtagtttaggaaaaaaaaaaaaatcctgatgctgctgtgtaatttttcagattcttcatttgaaaaatgggaaaaagaagtaatatcacgtaccttgaccatggtatcagagaatgacctcagaagttgtgagggaattctcagacaaaactttgaaatataatccaggattcaatcagtataaaggacgctcagcataacccaagaaggtcacagaccagaatcactggctgaaacctctggcagtgaccaacctcaactcaaaagcaagcctgaaatcccaagaggaggttggtgaataaagagaaatcagaaagggactgtcagataccaacccccaaccaaccagggcttttccccacatcaccactccctgaaggaacagcgacaactgagggagtggaaacacatttgggacacgtgatgcaaaggtaacctggtggctcatttaagggctgtgtgacttggattggtcatcatcctttctccagatggagtttccctttttacaaaaagatctagaaaatcagctgtactagcatagacagtgctgcagtaacaaattagctctggagtcttggcttaacacagtaaaagtttatttcgtgttttcattaaatgacacatacaggttggtggtggaatgggaagtggagatgggaattctgcttaagcaccctggttgatagaggctctggcacttgcagctatattactggagccttgggccatcaccatcttggccgtagagggagagaatgcatagagaattcacatgtgtcctatacttcagcctggaagggacacatatcacctctgtctcagtggttggacagaacaaactacagatggactgggacagatggggaagcctatggatatttggtgagcaatacaataaatgcctctgccacaacagccttttaatgctgtgtgcatgttactacgtgttatggcatctcagaattccagacagatcttttggatcctaatctgctgggatgtctcatctaagattcttatttatttcctgagcacctaataggcagtcctcgtgtcaaaaacagcacaccagtgggttctgcataatgattttacctctagagttttcc

SEQ ID NO: 5723 - DNA, 683 bp, Homo sapiens
gccgctgcggctttttctctggcctccgccgcgcgctcctcctcgtcccagcgctagcgggcacgcggttcctttttgcgagctttccgagtgccaggcgccggccggctgcgaagacgcggtgggccgcccctccgattgaaatcacagaagatattcgtgttcttcttaagagaaaaagaggacatttgtaagtatttgtcctttagaaattctaaatgtgtaattttattagctttttgagaaaattaagttcccacactaacaggcatcttgaccctttttatagaggaaaaactctaccaatatttatgattgtgtttaaaaaggcagtattttatagagcaaaataggaaaacattttaccctgtgcagcttctaaaatttaaaccatttgccactcatttgtaaaagaacaagtggtaattaaaattcaaacaacgtctttctatttgagtcatacccaaaactggagtcagggattggagttctggttctgactactgaggcttatagaatatgtgtctttggtaaactacttagtctctcattatctcagtttccttatctttaaaatgggtttaacagtaagtgcacaatcaggggttcattattattattattattgttgttgttgagacagagtctcgctctgtcttccaggcttgagtgtagtggcgcca

SEQ ID NO: 5724 - DNA, 5740 bp, Homo sapiens
ggaattctggaagatacaattcaaggtgagatttgggtggggacacagccaaaccatatcattctgccctgatacctccaaatctcatgtcctcacatttcaaaaccaatcatgccttcctaaccatccccaaaagtcttaattcatttcagcattaacccaaaagtctgcagttcaacatctcatctgagacgaggcaagtcccttctgcctatgaacctgtaaaatcaaaagcaagttagttacttcctagatacaatgagggtacatgtattgggtaaatatagctgttccaaatgggagaaattggccaaaacaaaggggctacagggcccatgcaagtccaaaatccagcggggctgtcaaattttaaagctccaaaatgatctcttttgactccaggtgtcatgtccagttcacgctgatgcaagaggtgggttctcatggtcttgggcagctcctcccctgtggctttggaggatacagcctccctcctggctgctttcatgggctggtgttgagtgtctgtggcttttccaggcacatggtacaagctgttggtggatctacctttctggggtctggaagacagtggccctcttttcacagctccactaggcggtggcccagtagggactctgtgtgggggctccaaccccacatttcctttctgcactgccctagcagaggttgtccatgagggccccgcccctgcagcaagcttctgcctggacattcaggtgtttccgtaaatgttctgaaattgaggcggaggttccaaaacctcagttcttgacttctgtgcacccacagactcaacaccacatggaagttgctaaggcttggagcttctaccctctgaagccacagcctgaactccacgttgggcccctttcagccacagttggagaggctgggatgcagggcaccaagtccctaggttgcacacagaacagggatcctgggctcagcccacaaaacaattttttcctcctgggcctccaggtttctgatgggagggggtgccgtgaaggtctctgacatggcctggagatattttccccatggtcttggggattaacattaggctccttgctacttaaggaaatttctgcagtcagcttaaatttctcctcaaaaaatgggtttttcttttctactgcatcattgggctgcaaattttctgaacttttacgctctgttttcctctttaacaacaacaaaaaatctttttgagacggagtcttgctctgtcacccaggctggagtgcagggaaccggcgggcatgcctcgggggttgggcagcagagagggggcagacaccccaccgtgtccatggacgctccagcaacgcgtccgtgcccgggtgccagggtggctcggggtctctagagtgctgctcacatttatgggcgctttgctccctaagcatgagccagtcatcactaggggctcagactcctgagatgggggtgccacggtcccagtgggctctctcagaacggggtcgtgttccacgctcactcccagatggaaatggcctggaaatgaaaaggcaccacagaaccacccagtggggagagggtgcctgggctggaagagcagacccacgcccactgccactgttgagggaggagcacctgggacttccctcctctaattcaatctgggaagcaaaggccaggcttggtctgaaggtgtaaggttcctgctcccagtctgttgacgagtgaactctgattctgactgattcgttactcctgcgtattgtgaattaagttaaaaaatactcgggaacaaacatggtaaaccttcccttaaaggactttatttctctatttttatatggatcatttattaaattagaagactaaaaagtaaaaatatattttacaatcaaagaaaaatctggacaatggaccccagtaaaataatcagaagcgcacgttctgagaccactcctgcctggcaccctgcagggtagcgcccagggagcatctgcagaggggagaggagaggagggggagcctccggcgacctgtcttctatctccggagccccgcctgaggctccaagatggcacagtcaggctgtccttagtgaccgctgccacggagctggcgatcggcctgcatcttcaaacccaggagcaggagcagcagaggctggcaaggcctgggccctcagacaccaggggcctaaacccagctcccaaacccactgcagcctccccttgtgagctggcagacaagcctgtccttctgagtgtgacgacctcatccacacctgacacaggcgggggcgggggagggtgggggttgtgaaccagctaattctggggaccgctcggaggggctcagcaagctgcttctacagtaagccacttctacagtaagccttcaaacaggaaataaagcataaaatgaaggaaagaagaatcttatttaattaaaggccttgcaaaatgtgatttgtctattaaaaaaataaagcgcttgtgaaaaagaaaactaagagatggcggcaagcgtggtcatcggcaaagggttgctctccctccagcgaggctggcccccactgtgtgggtccctcgggcccccacacgggctgctcaagggctggcagcaggggccacgtcctctctaggagacacccacagagccacatgtgcacgcgtgtggcagtctcactgcaccccagcaacgcgaaggcagaaaccggtgctggtggccacacctgggcgcctggacaccgaagcccccagcacagtgaggcctctgagtgtggcttgtggtctgtcctgggttagagttgttaatatcacggaacataccatctagaacgttccagtcccgcctgacaccttcattcccaatggagaagaaatctacacaggcgtaagaccaggccatctgagacagggaatcccaggggcccctccgtctgagtggtcggcgtctgctgaacaaataccatgtctttcttcttcaaaggatcaaaggcctttaggacccacagctgaagaaggcgcctgctgccagcatgtccctcccccacggccaccacacacttcaagtttacaaaaataaatatttatcaacagtatatttgacaaaaaccacccccaatcgatggcagaaagcagtattttctagctggcactgaaacttaacctatttttttgagggagaaaaagactaaaatgtaagcactaacttcctccttctgcatcttccacagaagacccacttgtgggcattctctttctgtccgttatcagtgggtttacatccgaaggccggcggcaagacacttgaaccacaaacaccagacatgcaggtgtctcaatggcatgcagattatttaaagtgcatcacttgtgagaagcttctcaaatttctgactgtcataaccaggtgtcacctaaaatctgtcctgtaggccaagatgctacacgcagcgcccaggcagtcagaggtaagtgagcgcctcccgcctcagaaagcttttacagggccacgctcgccaggctttcctcgcccacgctgaacccacgtcctgggcacagcagctcccaagctgtcagcagtcggctggcagtgccaccacaccctctcggaatcatgcacagtgctgcctctatcacctctcaccccagcctcgcaaggcctgttgagaagagaagctccctgggaggacacccacggagctggcacgagcgcagcaggagagacggacggcagcctccggcgggcgaaggacccggcttcagatgcccgctggctggcaatcaggcagagcctggccaaccgtgccaggcccccttcctcactccaggtgtgggttcattctgccttcaggccggagtctgtcacaaggctggctggacagtggccaggtgagccaggccagaggccggccccacaccatccacaggaagctgctcagctcaccagacccaagccctgggcaggggccaggctcacagcaaagcgcgttagggcaagggcgtgagttttcgtctgggaagttctaaaaaaaacccacagtgtgagggattgtgtgtgccttaaatcaacagctctattccaattacatcacatcacaaaatgccatgaatggaatcggaaggcgctccaccacctccaacaccctggcagaagcagctgctctctacagcaagagcattttccagaacggcatgagaaggagagacgcacgtcccagggacaggagagcgcgctgagacctcccagcacgagatgggaggggagcccccgccccgtcctggaccgccaggaaccgaaaacccacatgcacccaagaacaggtgtggacggggcggcacagaagtccacgggagggggcgacacgggtgctctttcacgggaatcttgttgggacagcattccttggggagcgccgggtcggcgtgtccaaagagcgggggcaaaacggcatcgaggcagaggctctatggctcctcccccatctgcagcagggagttgatggcggcatccttgttccctcgctgggcttccagcacggagcggatcacctcctggtccatgttggggaacatgtcctggatggctttcaggtcctcctcgctacagcggggctgggcgttcacggcggccgggggcagggccacgggcaccatgccggggctacagacagcgggcatccctggaagcaaagatcaagtttggtaaaaacgtcggaaagttccagaagtgccacactagctcctgctgaaggaagaaaacaacgcatcccaccggcctccctgaggaaggggccacctcgggtctcagcaaacaccagtcccgcaagacaccctggaaaggcaaacccccaaacagcaaccccaggcacagccacggggaaggtgggcagggccctctgtgacgcctccttcactaactcatcttccttccatataaaaatcaaagtttgatctttcaaatctcacccgagtctgttttataactagcaggctgggggtggtgttttgatcccttcagaactcgtgaatttgcactgcacacgctcgtcttcactgaccagtgggctcacagagtcctctgcatctggggacggactacacggaatgtcacgcccgctgatccaaacactgcacggtctgagcctcttcctttatcaggcattctagaagatgcttttgcagcttggcaagtgtgtcactaaactgtgtgccggtggggaacaatcaccacaggcactgaagacctcagcaaagctgcagccgatgcccagaatgacaaccccacacacacatacaaactacaccaagaaaatgctcacaaaactcaaacaagtggggcagcaggtgcggtgtacagtggaccctcagtgcactggggccaccgtccagggttcctggcatctccaccccacagctacgcaggcccctcgccccatgtctgatgcgggaggacacactgagatgcaatctatcgagcaggagacgcacggcggttcagccactgcagcacacacacccctgaaggcaccgtgtggccggacttaagactcgcctcccagcctggtggccgctccctaaaaccacgagcagccctgagcacaggcagcgtgcgcggggctcagcgaccagtgaggcacagagcacaggcagcgtgcgcggggctcggcgaccagcgaggcacagagctcctcctgcagcagcagctgcagcagtgcaagggttcactgctc

SEQ ID NO: 5725 - DNA, 2780 bp, Homo sapiens
accaaggtcccagagagcaggcggggcactgggccctcactccccaatatgcaatcagtcaccaagaatagttgcatgtccttccccaccctccatcaagtccatttgcctgctgggcccctcttcatctccaccaccatgacccgtggcaggctgctgttttttctcaccggcatagtcctagcagcagcctcctgactggccccaacatgcagtcccaccccacttgggcacctgcgtgagccttctgcctgcacatccatcatgcgtcccgctggctcagcacccttcagcaagtcctccactcccccaccatctgcagaattgcagccgcaccacttacaaggttacaagctcaggagtcagacctctgagaacatggtaaggtgctgcctgggccggagcccatgagtgactctgctgagctcctcccagctgctttcgccagccacagctggcagccccttgtgccctcactccttccctccctgcccactgatttgggaccaaaagatccagcaggttccagtcccagcaatgtggacatcttcaggcgcattccgaggtgcatttcacagcccctctgagcctcgaatgagtgaaataccttctctgtcagtttaaaaagcttaggggcaacagttcgggacctgcagagcagcacgcaattatgagatgatgggtgttggtgtcagatataagcctgcagtaagacatggtagtggggagtgacattggctgagagctgggtgaccctgcagactggggctgttgcatgaaaacctgttttcctgctgtggctactgcctcacaccccaggagacacacacaagtcttcctgggctgtgctggggcctggctgctgcctcctgagtgggccccacaggagacacaaccagggcttgctggtctggcccatgaaaacactcagaggcaccgaggacagagccacctgtgccataccaggcattcagagtgtcccctcacgctcatcggactgctgcagaggctagaagctcaggagtcagacctctggggacctggcaaggtgccttacctccctatgcctctcctgtggcccccagccactcccctgagctgctgccgggagcttcaaggcatcagaatctacataaagtctgccacctacagtcaaccagctcatgagttcacttgcctttagatcaacccaaacttaccctagcagcgttaaatttcccttttcctccaccagatcagagaaggaaaattttacaaattgacttaaatttctcgtcaattcaggtgacgttccctcagattaaaagctgaagatggaatgagagtagctgtgttcaatgctgtgcggcagatgcacacggcgcggctggctgcatgctcctgggcaaacacaactcgttccaggtgccgaatacgccgctcccaccgtgcaggcaaaacagaactaactctcatgtccacatttccttcgcctcacactcatggcctatttttctttcttggagacatgaattcaccttttgtagcatctgctatagcgccttctggaggcaaacaatagcctctaaaataaaaccaggagtaggcttcagtcttgccttggaatccctcacaggcagaagggcgcgtggtgactgccccttggctagggaagaatgcatcgcacgcgaccttaaacttggctaagttgccctttattaacgaaaacatagagctttcggtcaattccaccacggagaacacaaaccagagataaaacccacaccaagggctatttcccaagctggggaatttgagaacacacgggcagagttcacgccacacaactacactgggctcgtccttgggaggcgttcacaggaagcaatcacgagcgccaagccacccacaaggcagtgcggcaaggctcccgggatccttacaggcatccaagcgaggtacagaaacctccacagcagtggggataaggggaaaatattttctcttgctaaagaatatccttagttctcaacataaacatgactacgtatatattcagcttcaaatgaaaaacaagtttacaaatcactactggatacttaaactctatgttgcttttctttttggcagcaccagcctaaactctgtgggtttgcaatatttcagaaacttcaggtacattacagtcttctgagaaaggcccagaacttcagaattcccggagcggctgtgaagaaagaacattactggcaacaaatattaaaacaacatttcaagaactccaagaatacactgagaggtttgtaaaggtgcacatatttaagcattcaagctatatcctaaatcatttttctgttaacgtatttatttttggcttaggaaaaacatgtactttattggcaaattgttttagctgtagacggatggatgattctacagccacactcccctttccgggtgtacatccggggcctgtgcacctgcgcggaatcaggcaactttgtttttcccggtccccaaaaagctcacctttgacacaccctctatatgcacaggaaaactgctcttcttattcagggtctctttttgtggtggaattcagagaaactgggttgcaacatctttttagggagaggtcgagtatgttttttcattcgagtgactctgcatgcttaaggaatctgagtcggtataaaggactagaccactgaattgcgtacagcgtcccaggatgcctgcagccccagagtacaaactgtagatgctctcgtggcctgaatgtggaattttacccaccagaa

SEQ ID NO: 5726 - DNA, 5785 bp, Homo sapiens
tggggcagggagaagccatggatccagttgaaatgaccaggaagggttttacagaatgattcccctaagcaaacatcccagagagaagaaaagcaaaagacacacagctaaatggacaacagttcccagcctcgtcacaggagaactctttggagccaagtgaacccctgggtctcctttttcccaccccatcacttcagcgctttgagatcaagttcgaactcagtcccaacacagagtgtcactgcaaattgtttattaaaacacaaagcaatggacagtgaaaaacatcctgattttgtactttttggtgggagtggggtgggacatggaaggggtagggtcagatggagacagcccagaaggaaagccagctctatccacccctacagcttccccggccaaccaggttcaaagcccatcagttatatctcactgtgccgctgtcaatgcatgttgtggctgctggcaaagagttggtttggcctccacagagagaggatgggaaactagggtagaagctacaagggctaagaacttgatgctttttctccagtacttggtacagaatagagcagccaggcccaatgtggaagggtgggcttggtttcctgacaagccaggttagaccaataatggttgaagaggctgccctgggctcagaatgggcagctggtccttgcctgggagaactttgtggaaggaaaaggtaagattccttaagtccaaggagagaaccaatccagggtcaaatttcttttcattccctggatcacaacacaccagggaagagaggagtcaagaatgtctctccctgccagtgctcccctcctacctcgcaactcggctctcccttcccgacagttgtcctttgaaaggacggaaagcgcacttcagtttgttgttgtttttcctcatactgaaataaagcactgaagctcaaaatagaggtgagaatggagttctgctttccccagtgctatgtgcccccatctcacaagactgcctggatgcaagaggtgccaaggccctctctgccaactcaaacaggcactactgtttccttggctgccagcacaatcctggctccttgtgtttatactcctgggggaacctgtcccaagagatccatcctgctcttttcctgccaacccagctagtccccaaatcacctgctcttatcaagataatctggccccccatagcaggctagacaaaaggcagctggaaaggacaggccagactggaagcaagccacacagatgcaaagaagaaacctgccctcgctaggcagctgatctactggtaccaatctagtctcataacaaaatgaggaaatctagccctcttgccccagagagatttaaatacagagagtcttagtttggactgaaagagaaaaattgctctgatctttctaaagcttgaacattaaggcttctttgcaattttcttagagctctttgatcgttaattatatctttccatcgaagagaagcagatttcttctgagatttctgaacagttcctgggtgtttccggttctgcttccgtgtactatcactttgccttgcctcagtctctccttcctccggggccacagaaggagaaagcccaaagcatacccatcctgccctttaaaaaaaaaaagaaagaaagattcgtctctcactttggaaagctcacctactctcctaggtccttctggaggggcatggaggacaatattccatgttgccatttgatgccactaaggatccccaaggcaagaagacacttgaattatgccagagtaggccagcaaaggggagggaagggacagggaagcagccccatggcagggactataggacccctgcccaaacctgaatctagagggaatgccccaccctggctcagagcaggagaggaaaaggcactgtgctgaccggggtgggtccttccccaacccctagggagggcagagaacctgctgattctttccctgggtttcccaaggtgagccaatttctagggaaagggattttagcactaggaaaaggaaaatactgctgctgttttctgaagttctcagctgagattttagaaaccatatccaggcctttccaggagaggctagaggcaggagaagaaggaagagaaattccttaaaacagaagcttctcccaagagataaggaagtcaaaaccacagttctaaagctggaccaaacagttcccaggcacagaaagggggaggtaaacctaactcaaactgtgccctctcatcaaagcctaaatgcccgctaacgtgatcccagtagctcttaggcagggagggcaagagaacacgaacacgctctcaaaccaacaggtggccctgtgggcagggctagtcttcctgggagtctaacgccattgacacctgaagaaaactatcttcccagtcatgagaactcggggtgtcgattgagcagcctctcctcaacaatggagatttttcagaaaagtgagtctggtttaagggacacaaatcccacagagtttcttggcacaatgtttcagtaagcatgagtgagacccaaaaacgtccaatgagagaccaacaggcccctgacctaagtcagagctagactgcagaactctcagcccagctctgcagcagacatctgcgtcatcctcccagaaattcaactcaggccacacttctggcaaaagaagtttcaccctgactgtccttgttttcagtcagctgggctcagtgggatctaaaaacctgggacagagtgtagatccagtagaggagcccaggcctctcctccacgcacccctcactggcacccctcaccatctcccatacattccctatggtgcagcctctcagtcctagcactaagctcaaaatacagataagagaacaaacagtgcaaaaagcaaaaggtgaacaacagagtaattcttgacacatacaatacaaaaataaaaataaagaatcccacccctttaacctaaacttcatgtacctatatcttggaggagccacaaaacaaaaacaaaaacaaaaaaactttcaagttcagcatcatgagccagctgtgaccagccccagggagctcttgttagctggataggcttggctccaggggagtctaccccagcccccaccatacttcttcctgtttcctcacttcccctttagtttttgttagccatagaaagatgttccttcctttcgttcacaaccagagaggaaagcgcccatccctaaccctgagctcaggggaaaagggtgggcttggaaacagaggcagaagcaaagctgcttggcttacagtaccattaggaaatggccccaggagtcagggtttccttctgagactctgagtcactgaagggatgtgttgaggtggaaggcgggaccccctccttcctcagacagacccaggcaaactaacaaacaaggcaaaatggaggcagccagtcctcctccttcatcttgactaacccaatggcagtggcccagggctttggggaatttcgatgggataggaaccaaagctactgccagaagcctgtttagttaggatgtccactgccccaggcaggtggtccccaggaccaaggctacagtaccttatcctttagaagcaggggagctgtgtgaagcactatgggaagtatacctctgactgcagcctcgggccacaaccctccagctgcctgactcaataccctagcactgagacccaagtcacagcgaaaacaacaggctacaattctcaaacgactaaatgctggcctggagtaatcattaaagagccaaaacccaggacatgagcccaagagctacctattttgtcacataaggagcagttcaaatatacagagctcttaaaaaacatatctaataaagcaaactcaaaattaaacacattctagaaaagcgggcctggcctgagatcctatattgactgctccagcccaagctgaagctaatcctgctgtctcccatccacaaaattccttctagcttggctgggtcctccttcattgttgccctaactgggaaatggatgacaatggccagaaaggaggggaccagggaagcttcatttcctatagaaattttttcagggaattcaagatcgacacttagatgctaaggttagcttcagagctgccaaggctctggctgactggaattctttcagtcccatcacaccaagaacctgactgctacttggatagagaaatgaaaggacaggggaaggaggggcatactattaagatcaataagaagcatcgctgggcctatatagctaattagtctagttccttgaagtagctctaggcataaaccaaaactggctgaactgtgacacacaagaacatgggaataaatgaacatcagataccagacactctaaacagtggtcagtcacttagtagggctcaaatctctgaggttgctcttaagctatgctaacataagccttttctaatccaaagaccagaagagacttttaaggtcaagtgttctgttgctgcaggctggaaagcatccctgccccctggcagcaaggccctacaaaggggccagtaaagaactgctgggtcaggtcctcctggctgctggctcagagatccagggagggaggtaccaacaaggtgaggtggtaaaggagaagacattcaagcagagaaccccaaatccccgtgtctccttcccttcttggctataacttagtgggatggttgagagggagaagaaatttcaaatgagccagattaaggaaacaaacaaacaaacaaaactgagaagaaatcaagtccccaacaggcactgaaatcaaaatgatttgttgtggtaacaagtcagaggcgatctgaggacccgacataaccgaaacgtcttggatgctggacagtctataactggcacatgccagggagacaagcaatgacaaagctcaaacactaaaggtgggaccatcactggattaatccagaaaggcttccagataaggaagcattttctttctttttttttaatctccctacttttttttttaagtctttaccgcacaaattctaccccttcacacacattctttcaatcccaggacgtctgaagtcttatctagacataacttcagaccgtacctaactcccagtgctggtcgtctcaggtaataagatggcatttccctgctgttaatttctaacctaaaaaaaggaacagtgactcctctgagttcagagtcctttccactaggtatacaaatgaggatccttgagcaggaaggatccagtttaccctaagtatcctcaagaggaaagagaaggctgggagccagccacaaagagaggacgaggactgaagcacgtctgggaccaggtggtgaatgagggctgctctctactcgctctgcctctttttgtctcctttaattgatgtgtgtttttttctctttgtttttgttcattaatcattgtgaaaaatacagaaaccaaaaccaatatggctggtttctttcccacacccctccaccctgttcaggatagtcatttgttctcacaaccggcagaggcagaagagggttggaatgaagactccgaaggccaccaggatgggaaacatgaggctgctgttgtccgaggcataggggttgggtgtgcgggggcctgactgcacccggttcttattggtctgttttttgagattagacccttcatcatattcttcttcttcttcttcctcttctttcttctccaatcccggatgaggctgaagctttggtacatct

SEQ ID NO: 5727 - DNA, 1139 bp, Homo sapiens
acagcaccgcttcttcctcatccagggctacagatgccccctgactctagccaagagatcttattattcttagtcttattattcttatcttctctttttaaacagagagacagacagagacagacaaacaggcagagccgcagtgcacacggtccgtgtgtcggagaggccgccaggagactcaccgcagcaatgctacgtgaatgcagagggctggaggtgatgtgactactcacttgctcggctaacagctgccggttttggatggaattattccgcaacaacaagaaagcgtcggttaaacgcctggtggccatgtctcaccctttgcgacccccctctcaggggccccccgcccacttatattcctgatttattcactttctttctcgtggcccggctggcccaccctttcacggaagcttctcgacaaggcctcaggcctcaagccaaaaagatgcagctgtgcgcttcgccaaggcgtagagacccctccccaaataactacctaggctttccaattgtctgactccccctacccagggcagacttcgatctctaagcacttgaatccccccaatccttgcgtagcgatccaacgtcccagagaccccaccccaatccaaccttggatctacaagcgtctaactcgccaatccggctctagactgggaggccctgaagccccctactccctgagaccccccggaggtctctgctctctacccctaactttggctcgtaagcgtctaggccgtgccctgaggtctggctgtgactcagtttccgcaccagaggcctggcctaggccctctttggacaaccggagccaggcttggggcctggactcgagggcgcctgcagctcccttctggggacttgtctgaacctgctgaggccctgcccgacctcctgaccccttcctttcctggacggcctggtcctccactgccagcaggctgccggcctgcaggaagacagcagggcctgcctccccggccttctcactcctcttctccggctccctccatccccggatctgactgcagctcagccccggaccgtttccgtgctgtggtcccgggttctggcgttcccccctggccctcttcctgtccgtccctcgcgagtgcccccct

SEQ ID NO: 5728 - DNA, 2096 bp, Homo sapiens
ctcttcccttctgtgggacgtgttttgaggacttgtgtgttgactgcaccatgcagagcatatagcatggaggcacccctactgccatcggggggcaggtggaggggggaccgtcctgcagctcctccctggggctacccctctcttccctctgcacagacctggcagccacccagacgtcccgcctgctgcctagactctaagaagatgccctatcactccaattaccatacacagtactggcgggggagaggtcctgccttgccgctgaaaactgcactgcttcctccctccagggatgaaaggccaaaagaacgagggcagtgtggagtctacgctctcgccagggacctgcagcctctcacttccaagcacaccaactccagctaacaggactgggcttccttacctgccgccttccgctgcctccccgcagacacagcttcagcgacgcccaggctgagacggcagaagaggttcccgccggccgcggcctgccctcaggcagtggctcccagagctcagcggttccccgcactcttctgcgcccgactccccatgcccctacatcctgcgtccccttcagccccggaggtaccgtggggcccgggcctgccagtcaccacctcctcctccgccggcgcctccgggtcctgagcccctcgccgggtccctctccctcctggggctccttcccgttcagcctccggggccctaccccgctctccccgactcccccgggcccggcctgcgccttcctgcggtgccgaggagcggtggcgccctgggtgaagaagtcccgccgagtcgaggggcgcaatggaggagcgccggaacaggtctctcattccgagtagctaccgttgcactgtgcgagtgtaaaagtcacttccacccggtctcagttgttccaacctcagttgaagtgaggaggttggactggaaggtttctggggtcactccagtgaggctggggttctagtcccaatctcaccgtggcaccccaaaggcccagaaacccggaccatcacctctctttccccggggccaacggagcactcctgaaggagggagggtttgtctcaggcctgacgattcctgatgaggacttgggcagaaacagccccaggcaagcggaccttcattcctgcacttgagccgtctcctccctgcccccaccccagaaggagaaaacccagcgctcggattcccagcggcggggcagcctgcaggccctgttcccagcccacagacccatgtcccagcccaaacggaggcagccctgggcagcgggcgcgtggagcccaagggctcagggccactcagcccttgttactgtccctcatctagaaaatggatgtaataacaaaacagttcacggtaggtggcaagatcagacacatcggaaactgtgtagggctggctctttctgcgctcacactgtccagcaatgggccccagggacttggccagagcgcagtagggcaatgagaaaggggtggcttctggaaacctacacgaggcccagtctgggtggatttgggtggcggtcccttgcctgcgaggtgggcagggcaactttctactaaattatctaacactgccagtaatggcagcccttccccagggagccaggaggctgggccaggaccacccccctgtcgcctggcttcaggaaagaaagtggggaagacaacagatttgggagaaggaaactgaggaggttttctcccagtctccctcacgctgcctcagtcatggccattgctaagactcacagagcccaactgtgcaaggccctgcacttcgcattcttctcatccaaccccatgacaacccaaggagacacataatatccccattttacacgtggcagaactgaggttctacatggccaagtgacttgttcagtgccatacagctggtagtagtgaagccaggattcaaatccagctttccgactctaaagtctaaggcacagaccgagtgtggtgactcatgcctgtaatcacagcactttggaggctgaggagggcaaatcatttgagctcccaagttcaggaccagcctgggcaacacggcaaaaccctgtctct

SEQ ID NO: 5729 - DNA, 813 bp, Homo sapiens
agccttcagaagtccccatggtaccagtggattcccaggagcaggaaggtgggaagagctcggggggaagcacgcctgcctgtctcgggctgccctccccacgcgcctcacctgcagaatggaggtgcgctgctcattcttgtgcaccttggatgccagtcggttgaactccagggccatgcggcccaggtgggtgaagagctggccgtggtccggctcctcggcacacacactcagcgtggtctccaggcgctgcaggtgcagcatcaggttgccgtcctcacggggcagggggcccagcgcctggagagggaaagggcacacggcccactcttcaccaaggcctgagtaggcgccgccagtccattctccctctgcttcctcatttctcatgactcagtttccccctgtgaccccagctcagccccgggaaattctccagttatgcaggttccctgtctggggctgactcacagggcagaacccaggactcacaggccactggtggctccacagcagcggggccaccatcctcccacacactgggccttgcagagtgcctgacagtaagtcacttgtctgctggacctcagcatcctcatctaccaaatgtccgcacaacccttccctcccttcaacctcacagggttcttaggaggatgaattgacccctgacagtaacaagcccagaaaagggacatcactgcacagtcagccctccatatccatgggttccgcatccatggattcaaccaactgcagatcaaaaatcttctaaaaaaacaaactggccgggcgcgatggctcacgcct

SEQ ID NO: 5730 - DNA, 5958 bp, Homo sapiens
gttttgttcagcgctaccaagagcgcggcaaccgagaaaacacggagtcgcccctagtggcgaaagtgcggatgcgaaaccgctggctcggcgtaagagcagagccgcggaagagaaccctagcggcggggaactagctcgccttcagtgctcacgggagaaggcaagttagaaagaacctgagacgtgacactgaaaatcagtagaagaaatacgccacatttattctaccggggaagacagtgggaaacctgaaactgccattgagcagaaggaaaacatccctttccagaacctttctcgtttttctaaaaatctgcacttttggaagtgatcccccaaagagacctccagactctaccatgagtgtctccagctgaactcatcgtgtctaatcctcaccctagcttatcctgttcaaatcatttccatctttttctggatgaacctgggcggatgtcagaccagagaagagcacagaatgtaccagagaggacaacaactcgggatccacctaacacgggtacaaagaaggctgtaacacgggaagcagctgttgggccaaaccagccctggagctgtaggccagagcaagaccacaggactgacagagctgttaacacgctgacatctttcgggctgcagagggcgggactgaaagagctattagcatgttgtaacacccactctggggctttggggtcacgggcatccctgtttgggtgccatcacattcccctcatctggatgccagagtccaccataggagtcacttgcaacatgcctggtccagccacaagtcccacacagagcctgctcctgtgctggtgcttggagctaccagtggaaccccacactcactagctcacacacccctcctgccaggggctgagtgcacagtcatggtggccacaggatctgcaccagaggacatgccaggcacagcccagcaaaccgagtagatggggcatctcctgtggttagcctgggctccagcaaggcctaggtagggcatcgccagccagaggtctctggctggcaaagttgctgagaaacatcctatgtcattaaggagatggggaggggcagaggggcacttatggaaatatgaatgatttttttttttgagacagagtctctctctgtcgcccaggctggaatgcagtggcgtgatcttggctcactgcaagctctgcctccggggttcatgccattctcctgcctcagcctcccgagtagctgggactacaggtgcccgcaaccacacccagctaattttttgtattttcaatagagacagggtttcactgtgttagccaggatggtctcgatctcctgaactcgtgatccatcctcctcagcctcccaaggtgctggcattactggcatgagccactgcaccagccacaaatgatattttagaagataaatggtcctttagaagaatagataaaagatatgacagtttttagagaatgtctttttttgggtagggtgggtgtaatcacccaatggtttcatcttgcccattgtccacaaaggccaatgcactgagaacagcagcttttttgcagcaaagaaagacttcaataattgcagggctggccaagtggaaggacaggaattcattcccaaatccacctccctgagaattctttttttttttttttttttttttttttgagacggagtttcactcgtactgctgcccaggctatatagtgcaatggcaccatcttggctcaccacaacctccgcctcccaggttcaagcgattctcctgcctcagcctcccgagtagcttggattacaggcatgcaccgccacgcccagctaattttgtatttttagtaaagatggagtttctccatgttggtcgggctggtctcaaactcccgacctcaggtgatcctcccgcctcggcctcccaaagtgctgggattacaggcatgagccatggcacccggccaggctgagaattcttaagacaggattttttaaggatagtttggtaagcatggggctaggggatgggttgatgtgttgggtactatggggaacgtggaagtggagaatagtgtggacttttgaaaggatgtctgcctaggagtggagttgggcatgagggcaggactaaaaaagagtgagtgaaggaaaaggtatgcagggagcagaagagtggaggggtggctcggggtttggagacttgcccgtcaattcccacaacagagacttgggaggactgggtgggtcctgaaaaattaggtaaagcagagtaggttgcccggtattaaataagaaaaaatactggcctacctgccaccatcagggttacccttgtcttagatgaagcaatggtagttgccggggcgtccattccagggccccatcagtcttcagtggcaaggccagtgagatccgagtaggaggttttggccagctcaggaagggatgggagtggtccttgtgggggccgctcacagtccaacttccagtggggtcctctgcagagggggcatggcctgatgggcttacctgggtttgggcattgtctagaccagtggccttcattgccatacttgaaacatgcgccaggtggaggtggattgctaggaggcttctgtgtggagctgcggccctgtgggcctgcagggccccggatggcggagtcaagcatttgaaactctgcatgtttttgccttttattttcctcatcacgattgttaaagactttgaaggctaaattaagaaggtctcgttgtgggttttgagagccatcatcaagcttctgtagcttacgccgaatatcggggtggattgggacatgaactaaaggtttaaaatagtggttccttctgggctggttgggtctaggttggtatattttctcatgacttcagttaaacaagagagaaaaagggctgttttttcgtcaggatcttgggggatttctgaaagtttttcatagtttatcgctttatgggcaccctttttgagtcctgcaaggagacacaattgtggtctcaatggtagcgtccagaggccctgtcttgataatcccagtgggggtcctggttggggactgcctgtgcgccagtaggctgggcaggagcttggtgataaattgatcagcatgcccctgagctagggtccagatatggtcccggtcttctggggtgagggtggaagagaggataacgtagaggatatgccagattagttcataagactgggtaaggtactgaaactccctaatataagaggtcaggtcttctggaaatgaacccagtcttttgttaatttgagagaaatcagtgagggagaagggaacatgaactctaacaataccttcagttcctgctacttcctgaagagggcactctagcacaggcactaaagtaagggtggggcatggccaaacatggcacctgaacaagtgtggatgggagagaaggaagaacctggaagtggttcctgctgagtgtttgaaggggaaagggggattgagttaacaggtagtggaggatagataggggcgtaaggtggtgggatgggtttacaagcctcaggagaaggcagtaggggaggagaatgggtacaggcaatactagaattgtcctgaggagggggcggtgtaggaaaagaagcagatactgctgactgggaagatggtggctgggaagatggcggttgagaagacaacgaggaggcttgggctaaagaagacgattgagaggaagaggtaggggttgggaggggtggacagcagtctgctggatctaacgaggaaaaagaggtagggttgggaggagaaagacaatcagggtggcaagaatggaggagaaggatttgaacaggtgagcaagaattgcagaggtcgggttgtgatctgagtgcaaaaaggcctggacataaggaatttctccccatttctctagtcgttgtcaataattgcttaactcagttaaaactgtaaagtcgaatgttccatttgcgggccatttggacccattatccaattcgtattgtggccagactgaattgcaaaaaaagacaaggcgcttagggtggatattttgcctgaggcctaaggtttgcaggttttttatggggcagcctagagggctgttttttggaagggaggaccgggagtttcccataacagagggtaggctcaggagaacagggaaaaaggagaccgtcctggacggccagagggagacaaaaggagcaatcatcatcaccgctgcctttttcattcctggaacgggatcaaatggattagaggcgtctccctaagaccaggtgatgggatgatcagcgagtacctggcacacgccggagccttgctggaccgacattggatttttggaccgtagacaccaagagaggccatgtggcttttcccttgttaactgggctcctagggaaacttaccaataggcaaggccagtgaccaatgtgcatgcacagagaggcaactggaggctgaggagcttcctttgtcctgctgctgtggcctgttctccagggtggaggggtaggtccatgggggatgtggaccagagcccctccccggtttcggcactagatgtaaggttcttgtgttggttcaaaccctgagagcacgccaaaagacaacacgaagtggtgtggagcagcaacatgctgttttaatgagcacgtgagtgcaggtgggctgaggcctaaaatggcatcagccccaagtgaggacggtacagggggtttatagtcctctgtaaacaggaagtgtcccagtctaacatgactgctatgtagtacgcgacggcctctttctcgatcttcaggggtacgtgtcttctggccagggaatgtgtcttccggctggctctcttcctgcttctgctatcttgctgacacacgctgctggtgcaagtggcgttgtgccttgggactgggcctgagaaggggggagttactcatcccttcaagctttgggtccccggggagaatctttcaagtatgaacctggccttgtgaaagcagagctccagttacacagtgtatcccgaatccatgaatgttatgatggtgctaatttgaaccactaagaggccttgtgagagtctcttctttcccagaaaatgtggggaacacagagagtgtctttctggatagacatacccaagaaacttctgctgaggaaagtgaaagcaaagatacaacttatcccagaaaggggagtgcatatgtagatggtgataagtaatatagcctgaaatattcacatggatataattagagttagggttatagttaaggaggaagggaagggagacagaaagaaagcaagtaagaaaggaagcaagaaaagataaaactgtgtccaagtttcttacttgtattaaacagagtgtttttctagatattgttaaccaagataaggaatccctaaagagaggcaggcttgatttagagctgtctgagggcttccaaaagagctgttcagtgaataagaaggaatccaaccatggagcatcagagtctaagttggatgtataggtttgtgtgtcttcagtattgtcttgtattttaagacagaattagatgtgcccatcagaaatgagtgtatggcatgaaaaagttgcagatggtaggccgcagtgaactccaattgtttggaaggcttaacttgaaccttcctaggctagagaattttaaatgactgagatgtttctaatgtgcctagagcttcttttctaatgagcccagggagggctagaatctctatcagagttagtctgggatgtaaaggggatcaggatgtgccaccccaatatatgccactttagcctatggattattttgagcagttaaaaaattagaaatagcaggcctggtgcagtggctcatgcctgtaatcttagcactttgggagaccgaggcaggtggatcacctgaagtcaagagttcgag

SEQ ID NO: 5731 - DNA, 3246 bp, Homo sapiens
aggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacagggtctcactctgtcgcccaaagctcactgcagccttgacctcccaggctctgatgatcctcctgcctcagcctcctgagtggctgggactacaggcacatgccaacaagcccaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgttaaa

SEQ ID NO: 5732 - DNA, 3243 bp, Homo sapiens
aggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacagggtctcactctgtcgcccaaagctcactgcagccttgacctcccaggctctgatgatcctcctgcctcagcctcctgagtggctgggactacaggcacatgccaacaagcccaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgtt

SEQ ID NO: 5733 - DNA, 3245 bp, Homo sapiens
aggccagggaaagaagtctggaacaaagggaagacagatgaccatgattgacttcattcttttacctcctgagatggcgatgggatgggggacacacaggaagaagcagggtccatgagcctcagcccttggcttaggaggaggagcagtacatttccacctaccttctctaagacatcttccctttgcttaggcttacctgggggtggaggtacacagggaaggtcaagcaggtgtaccagggcacctcctggggaggggtccagatggggaggatgctggacatccccagaagccccatccaggagatctagcagatccaggagctgtgaggcctggcagaagggacagaaggggcagggctgggtatgaagctcagcccgtcttcctaccccagagtttctagccttctcacctggggctctgtgggcactggggctgcttctgaaagctgggctgcttctttgctttcctttgcttcctcatcagcctgagggccatctcgctccacaagaggcattttttccaggatggcagccctgagaggatggaatgcaagtgtgcctctgtgtggtctctgggcctttcacaagaggcatctaggatgaggactaggaatatggagccctgggcacatggtggctcagaagtacccttctgatttcctaaaatgacatgttgttgctgattttcagatgaacaaggagggttggaagccagcttagcttcaattaacagtgggtgggaagctctcaccgtggatatggaagaacacagggtctcactctgtcgcccaaagctcactgcagccttgacctcccaggctctgatgatcctcctgcctcagcctcctgagtggctgggactacaggcacatgccaacaagcccaggtcctgggatgacccgagcaatcctgtgcctgctactctgctgcccaggacactgagagaaccagtgttctctgggaggaaaccactggtcatggtcttactgctatgccctctctgatccagggatacagcagtgaaaggtcaccccacctgcaggaaggggtcgctgactccagatatgctgtgttctgtggagtatcccattgtcaccagagtccggaggatgtgtaccagctggggtaccacctggagggagggcacaactttgggcattcgttctaatcctctccagctaaagccccattccttccccactgaccctgtcttccaggcccagggcctgccccttcaccagcccacctttcggaagtgcctgagggctgcagggcttcgttcgcagagctccgtgatcagcgtgatggtgcccagcaggatgcctggggtcagcgtcggggaagtgaatggtgggggccaggggcaagagagtctattgcgtgtgtgcctgtgtgtgtgcactacccttctcctgtgagctggggttcccatccgattttcaattcttctgtccatagacctgaagcaaaggatggggggccccacagccttaccatggtgacgctcatgaagcagttgggcacagggtgggaggaagacactggagagttcagggaccttccggatcatgtgcactgcagtcagaatagcctgcagaggtcaggggcctcagacaggggtcagaggagatggacccctgcatctactactatatagcacgcagcaggcagtgtgcaggagcacgtgccaggagtcccgccatctcaccttcttgcgcacgtagggactgggctgcaggagcagtttctccacctctggggccaggtctcggcacatctcagcagagcccatggtgctcaaagtgcacaaggccaggccttgtactggctgaatcccctggctcaggtcactgcagggtttgggaggacggtcagtcaaacctctgagaaaatcagtccttttcaatacccacaacaggcagtcccctgggatttccaaggtccctactctcccatctccctgattccaagtgattgccagaaccctctcacttcttgatgctgttggtaatgagcaggtgggcatcgtgcctctcatccaatagaagcatggcccccaggtagcccaccctcttgtctgtgaatctggaggaggcgatcagtttcaggcactccatctatagtgaagggggcagaccaggaagaggcaggggtgaaaccatagacactcacatccctgttccatcttcctctttaaaaccagattaacctgtggggcatcatatctcatcactctcccttcaacaagaggagaagcttaggaaattcaggcgttagtgggtaggaggaactaggagttgaggaggatgggagcggagaggaggagatgcctgccctaaaggaggctggccagagaatgaagggttcaggccagctgatgaccagtaggggtagcaatggggaaagaggtttgcagtgcaggctgtgaagactctgaaattgtagaatttaaaaaaccagggcataaacaggtgagagagtctgggactctgccccactagccttcatcaagctcaggagggaggtattcctggccagtacctgtccaaagtgggcggggtagcccaacatgtggacgtagagcagtttggccagctgccggtgcctgtgcactgggtccccgtcgcggaaggaggcccggatgtgggcacactccttttggatcacctcccgctcctgggcctgagtcttggccccgcgaatctcttcgatgaggtcctgaagcttcagcgaaggcaccaccatcctgactggcagagtccgggagtggagaaacactctctggtcgggcgtgcctgggctttcggcccaggcccgtcctgtgtcaagaccctaagagcccgggtcccacaggcagcggcagcggcagcgacagcctgcctaccccaggactccagcctcacctggcttctgcctcaactccgctcctctgccccccagcgcttcctggtacggggccgagcaggggttggtgctccgtgcggtccttccctctccccgcctccaccacgggaccccgccctcctgggccgactgcagagccttcctgaatcctctgacctcgggcctcaggctttagcggagagacagcatgataggcctggagttcttcaagaggcctcctcgcacatccttaccacccggagagcctcagtttggatttgaagccatcgcaccccaaaggagatgacaatccccccccttttttgaacttttttattaatatattttttttgttaa

SEQ ID NO: 5734 - DNA, 1429 bp, Homo sapiens
ttttgttttgttttgtttttgagacagagtcttactctgtcacccaggctgaagtgcagtggcatgataagagctcactgcagccttgaactcctgggcttaggtgattcttcaacctcccaagtagctgggactgcaggcatgcaccaccaagcccagctaattttctttttttgtagagatgtggtctcactatgtcatccaggctgcttttgaactcctggcctcaaacaatcctcctgccttggcctcccaaagcactgacattacaggtgtgaaccaccgcccccagccaagtcttctctctctttttttgcccaccgtggtcaacctagctaaaggtttgtcaattttgttgatgttttcgaagagccagtttttggtttcattaattttctctattatttttctattctctatttcattaacctttactgtaatatttattatttctttctgttctttctggtttagtttgctctttttccattgtcttaacatggaaggttaggttaaggttattgatttgagatcttctttcttaatataggcattcacacatattacatttatacttctaggcatgtcttttctttttttgacatggggtctcactccatcgcccaggctggagtgcagtggtgtgatagctcactgcaacctccgcctcccaggctcaagtgatcctcccacctcagcctcctgagtagctgggaacacaggcgccagctaattttttctgtttttagtagagatggggtttcaccatgttgcacaggctggtctcgaactcctgtgctcaagcaatctgcctgtctcagcctcccaaagtgctgggattacaggcgtgagccaccgggcctggcctggcctttacctgtgtctcataagttttttggtttttttttttttttctgagagggagtcttgctctgtcgcccaggctggagtgcagtggcacgatctcggcttactgcaagctccgcctcccgggttcacgccattctcctggctcagcctcccgagtagctgggactataggcgcctgccaccacgcccggctaattttttgtatttttagtggagatggggtttcactgtgttagccaggatggtctccatctcctgaccttgtgatctgcctgcctcggcctcccaaagtgctgggattacaggcgtgagccaccgtgcccggccataagttttgatatgttgtgtctttattcctgtttatctcagagtattttctgatttctcttttgatttattatttgagacgttggctatttaggagtgtgttgtttactttctacatatttgtgaatttccaaagttttttttttctgctattgacttctaatttcattccattgtggttggaaaacatacattgtatgacttctatcctttcaattttattgaggttttc

SEQ ID NO: 5735 - DNA, 15053 bp, Homo sapiens
gaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctaggctgtgtggttggtggtgaataggcttctttttacatggtgctgccagcccagctaattaatggtgcacgtggacttttagcaagcgggctcactggaagagactgaacctggcatggaattcctgaagatgtttggggtttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacatatcaagatgcatttattaggaaggaggagtttagagagcaggctatcagaataaccactcatcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaaggtagaacctctatggtaaatccctctgtttataatgcactttacagtttcaaagcacttgtacgtacatttatctcaattatcaaaataacagtgaattataatccctttttggaaatgagggaatgtaaattttaaaagttaagcaattatccaaggtgacacagctgtgaaagtggtagaggccaggctttctgacacccagtccagtactctccttggaattagcctccattttacccacagtgttaaaatggctgggtattgggaacctcaggaaattttccagcttcctgatctggtgcccctagtcacataggatgtgtgatcacgtgatagctacatctggaccagaatcccatggcaatatcccacggtttaagggcataatatctccgtggtggtagattgtcaagtcaaaaacgggacatgttctaacagcaaagctacccaatatgaaacacaaagctacttttagattttttaagacttactgatattcctgggccctaagagcttgtctatggtcctatctttgcaaactagtatttacacaaaatgagccacctggtttttttaaagtcagtattgtgtgtgtgtgtgtaaatatgacatggagaaagcttctgttacctagtaagatagtaaagtatgtaagacatggcccttcccccagtctacattgaggtatagtgtattaaaggatctcaggagacttgcagcaaattactactgcttctgtgcttaaattcagaagtctgaaaaaaaaaaaaaaagacttctagtaaagagttccattttgctgtttaaccctttgtgtcctaagtttaatcaaacacagaaggatatttttttgcatcattccatctaatggaatgcagaaactgctctagagcagtataaccagtgcttcctgattgccagcagattgccctggacaccccagaataaacagcatcttcaaaatccccctttctcataccttcttattaatggttgaattagtatgtctctgtcatctgagagtcttgcatcttgaccattacctttattttctgtcaagggaatccctagaagatgtatggggagacataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgatttaaaatgcctacttttatgttagtaaatattaaatataaatcattcattactcaagttgacagattgctataccattgcttgtttgagaaactcagagcttagtaattgttccttagttttttaagcatgtctccttcaagtgagtttatttggattatcagaattttgtggttttaaggtttatcaaagattattctagttcttgactgatgttgatctgctaagactattgcagtatccacattaggcagaaagcagggggaaagtcactttttttaaaaaatccttgaaatattctgatgtcactgcaattaaggtcaatagtgaccttttcattgctaaatccgttacacctgcatctaatatgaactttcagcagcacaggtaactcccaccagcttcttgaaacacttcccttaagtgctataatacttttaattttcttttcaacttgcagactactcctttattgtaggttcttctccccatcatgtaaatataggtatagtggacatccattgctttggcttgccaaaaatcacttcccctttactttaatcatacatccccacttatcctttagaaagctgctccttcccattctgtgtggtggtagtggaaatgtagatgacagtactccggcctcatgccccctggctgaggtttgagcaatgcaagctcgttctgtcccacaaggactttgattcttaagaaaggtgaccacaaagtgatcagagttgagtcattctgatcgtagtgttctaaagaaaccatttaaaagtttatgaaaggagatctccaaagtatgctggctcctattctccaagcctggttgtccaagttttcctttgattgtataaactaccacatagcctccttaaaataagtttcctttttgtcagccaaaatgggtttctattgctggtgaccaaatgactgactaattacagaaatggaggccggagagttaaatggtaggcctttaacccacaggaacatatggaggatctggaattgattattgtactgagacagataatggcaccagctcttgttctgtgtccctgggaggataaatctacgagttaagggtgacaaaacagtaatgatatcatttcttgtcatttggaatcgtgcctgttgagagtagaatttggagggccaggtaattgttgacaataggacaatttaaagtggatagactgggcacagtggctcacacctgtaatcccagcactttgggagaccaaggtgggtggagcaccttaggtcaaggaattcaagaccagcctggccacatgatgaaaccccgtctctacaaaaatacaaaaattagccaggcatgatggttaatcatgtaatcccagctactcgggaggctgaggctggagaatgacttgaacccaggaggcagaggttgtggtgagccaagatcgcactgttgcactctagcctgggcaacagagcaagactccatctcaaaaaaaaagaaagaaaaaattagctgagcatggtgttgggtacctgtaatcccagctacttgggaggctgaggcaggagaatctcttgaacctgggaagcagtgtttgcagtgagctgagattgtgccactgcactccagcctaggtgacagagtgagattctgtctcaaaaaaataaagtggataaagcaggccaggaccactgagttagaatggttactttgattgcattagctattttattttttttaattttatttatatatatatatatactttgagacagagtctcgctgcaacgcccaggctggagtgcaatggtgcgatctcagctcactgcaacctctgcctcctgggttcaagtggttctcctgcctcagcctcccaagtagctgggattacaggcacacgcgatcatgctgaactcatttttgtatttttagtagagatgttggccagggtggttttgaactcctgacctcaagtgatccgcccacctcagcctcccaaagtgccgggattacaggcatgagctaccgcccctggccccggtagctgtcttaaagtgaagggcatcagctcaaacccagaaactgacctgtgggcatagaataaaatacaggccctttttgtggccaggataaatgaatctcggtgcttaaatccacactagtacttggagattaattattcaaattgcaaaattacaatgctggttgaatttgtagcattactaacgtctcttttgtgagagttaaggtattaatcagaaaagagactgtatagagtgctgatacctgggaagattcagaagatttagagaatcccaatcctcgaaatatctcaggaatgaaggtttgggttaccctattagtcaaaaatccctgactgaattaaacaaaaaagtatagtcaaagaggaagagataaatagcagttatagccccataacctgttggagaagtaagatctgtagcctctaccccatatcttttaggttgccttattttatttccccctctcctctttattcattacagtattctgccctaacatttcctggctgaagtttgagcatgatgcaagttaatccaatcagatttctcctccattggagctgagccattctagtggtagtgtcccctcactgatgtgtatgagtgtgttggtgatggttaaatatatcaggaaatccgtaagttgcagattatcaagatggggttaagaactagagaagaatgagcatcacccagaaatcttaggcttataactagaaattattttaggttatctccctttaagaggaagatctccctttaggggggattatgttgagtgaaggtattaagattgttcatgttgaagaatgcatgtccacatagtgtacgtttgcctacccagtgttatctttttcccctctgagaatagcacttcacctttcctttgggaaactacccatttcccatgccatgtgagcccagaggataatgtgtaagaggtatatgagtttctgagaggaatgtgagaggtcttcacctgcccagattcctgacttaatctttaagtcttcttgccctgtagactctgaaaaatctcatccatttccatggccttggtttctaactgtatattgataatttccagattcctacctttggccttgatatgtgtcttgagctccagatctgaatgcccacctgtaccttgatatccactgcttgattaacacaaagatactctcacccaacataataaacgctgacctcttcattttttccttaaaatctgctctccagtgttccctttgttggtaaatggcaccaccctctactctgtttctcaaaccagaacatgagagttattctcgaagcttccctctctcccagagtccctgttagtcattaaatgatcttggtgttagcatgtaaatatataccttaaaactatctccacttctatcactttgtccaagggaacatatatctgttgctgtaagtactataatgcctttctagtggtttcactgcctctattattgtcccactgcagtcttctctacaggacagctagagtagccccccaagagatagggtatccctgttgcccaggctggaatgcagtgtcaatcatagtttactgcagcctcaaactcttggcctcaagcatccctcctgcctcagcctcatgagtagctgggactgcaggcacgtaccaccatgcctggctggccatttatttatttatttattttgtagatacactatctcgctatgttgcccaggctggtcttgaactcctggcttcaagcaatcctcccactttggcctcccaaaccactaggattacaggtgtgagccactatgcccagcctacttaaccttttaatagttcccccggcatttcagaataaaatctaaactctcctggtttacaaggctcttcagcttctcattatcttattcctcaagcttcatcttttgccacttcaaacaggaacaactcaattttgtatattggaatttcctgtattattattatttcatttgaaaaaaaagtttccacttttttttttttttttttttgaactgaagtcttgctctgttgccagacaggagtgcaatggcactacctcggctcactgcaatctttgcctcccaggttcaagcaattctcctgcctcagcctcccgagtagctgggactacaactgcgtaccaccatgcccagctaattttttgtatcttagtagaaacggggtttcaccatgttgaccagaatggtctcaatctcctgacctcgtgatccatccccctcggcctcccaaagtgctgggattacaggtgtgagccacagtgcctggctgggttccacattttttaaagcagtggagatgcaagaattcattaaaagaaagacaaaattgaaatgattattcagaacaacccaaaagcctattgctatgaatactgtaatttattttcttccatatttctttccatgaaatttttaaaaatctagtatttgtaactgatacagagagctacagtaaggtgcctagagagcaaccaaatccctacctcacaacatttacaaagataaataccaaaaggactacagatttaaatcttaaaatgaaacactagaagaatatttaggagactatttttgtgatcttatgacatgggagattttcataaacaaagcagaaaacctacaagccataaaggaaattacagacatataagactacatgaaacaaatcttggttctgtaaaagatgtgatagattggagagatatttccaacataaatgacagatccaggactaatgttgctaatacagagagttcctacaaatttataagtaaagtaataatcactagccatttatttggtgtttgtttcatacttggcattgtttcaggcactttacaagtgttatttaattgtcacagtttatgagataggcaatattattcctgttttacagctacggaaacaggctcagaaggataaaataacttgcccatgtcacacaataggtgatagagctatgactcaaacacaggttgtctgttagtctgtactttgaaccatgatgctcttcaacatttccgtaagcatatgaaagataatgaggtcagtgagatgtgatgtacaacagagcaatgaagtaccatttgccacctatcagatggcagaatttaaaagagcagtaacatatagtgctggcaagaattagggtaacaaaacttttatacattgttggtgggcatgtagattgttccaatttttttagatgatgatctggcaatactgatgcaaatttttaaatatacacttttggacccagcattcctactttaaagactctcaaagaactaaaagcaccaagataaaaggacatcagtatgagaaatttactgcaacgtaacctgtgctagcaaaaaaatttaaaaagcaatcgatcaaagtggagtggttgaatcagttataggacagctatactgtggagtgttatgcaactgttagaaagaagacctctatttcttagcctgtggcatgtccatgatgcattaagcaaaacaaacaaaaattacagagtaatgtatatcataatagcccattgtatggggtgcagggctggaagccctacaaatgtatctaaatgaacatgaaagaaaagtggaaggatacaccaaattgaggggtttggagaaacttggtgctttatacatactggcattgtttcactggttgtgggagcacatcctttttttttttttt

SEQ ID NO: 5736 - DNA, 684 bp, Homo sapiens
ggactccagccctgccccaggctcctgtgtgagagctcccttgcaaggcagctctgagggctgtggacggccactcggtggaagtgtcgccacccacgcctttctggtttgactggaaaacaaggcccatcccacctatcaggatgcctgagagaaggatctggccggattctgcaggccgccaggctcccaggctgagccttccacctgctcaggcgagagtgggggtggggcaggtatctccaggtgacaagcaggcctccctcaggggagggagagagaggtcacctcggcctctcacaggcatctcagctaagcaggtgcagcctgggctgatggcagggtggacaaggatgggcttccgagagtctggccttgcttgcccccagtgacgggaagctcagcccctccactgtcgtcatgaagcttcctcttggaacctgggctcgggctgtagtctgggcttcctggcccatgacatctcagagtgtgggaacagggtgggcctcagtcccgcccatgagttgggcgtcagatgggatccccctggcctcctcatcgctgcccccatccccgctgtcacacttcccactgggtccccacggccttcctgcctctggccctttaaggcccaggcaggaagcccctccccatttagggcaataaatggacacgtaaaatggc

SEQ ID NO: 5737 - DNA, 1168 bp, Homo sapiens
ctcaatctcgcaggctggaatgctgtgatgggatcatagctcactggagccttgaaccgttgggttcatacttgagggctggggggctgagcccccctcagctggggggagctgaggtaggactacagagatggggttgcgccatgttgctaggctgctcttggcctgaagggtcctcccgcctcggcggcgccagacatagttttctatttttgaccaacataaacactgtgctgggtctgaatttttcagctacccttcttcggctggcaacacacaggacctggcggggaggtcgctcttaccagtccccactctgacgagaagactgcccagctccaggcaccgtagggccccagtgacgtagccgaacacccacgcctctgacgtcgccagaggcccacctctatggtgtcggcgaaggcgcgccattgtgacgtcacggaaggcgcgctcttgtgacgccacggaaggcgcgctcttgcggcgtcacggaaggcgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggtacgtgcgccccacaacacctcccccaggcagggcccggggacccccgggagcgtccccggctacctggcgccgctcatcctgggtagggttggccccctctgaggctgcccggcatgagggagctgcacccctgagcttgacctctgacggccctttgtaatagcattaagtctttgaaactttgtagcggggtagaaggggctaggaaacgaagaaaacatctttttaaaaatataagcggtcggctgggcgaggtggcccacgcctgtaatcccag

SEQ ID NO: 5738 - DNA, 847 bp, Homo sapiens
ttgaacatcaagtgtattcatgaacagtgagtatcttatcttcatgtaaacagttctagatggaagacccagatggcactcctcccggggaggggttccagcccccaccctctcagcccctcccctgccagctcaactctgcagtacacgatgggggaaggcttaaacgcagctgccaggtgtaatttttcaagtgtcaaagatcccaagtgatccctgacacccaccccttcctactcttacattcatgcgtctgtaagatagctgcctacaacaggtcataacaaaaataataaggtacatgctacacacacatccagctggaagccttgttggcccctaagcctttgtttcatgctacagtactgaggggtatgtgtccccaatgcacagccacccgcacacaactcaatgagcttcctgggaaacactattcccccacctccaccttaggtggctgcctcagttttccaaccacaggaatcagtccctcagctcctgcctctagtctccaccccaaaagttcagtcgtctctgtcttggagggcactgtcggccccctcaggttgaagttcaacactcctcaatgagcagctgttccgagctgtacagcttcttcttgatgactcggaagccagtgctcagcgtcagggactggctgaagccagggaggaagggagagttggcggagctaaacagcccctggatcttgggccagagtcgtgagtccaggcgcagcacgagggtcagctggaaggtgggcaccaggctggggtcgagtgccagctggcccacgctgtggcagctcttgccctgctccacgcagacgtccagcagcgccccccgc

SEQ ID NO: 5739 - DNA, 1543 bp, Homo sapiens
ggaaccaacacactcaaggacccagggcctcagggcagtcctcgaacaccactaaaacaaaggcatccttctcccctggtttactgtcacccccagggggactggagcccagcagttcactgcctccctgcccgagggattcggactctgggtggcttgcaggtgtccgggcaacctgcacagggagacaacagccacagaaatgaaaactgcaaaatcccttccgtgggaggcctcgaggcattccccgaacagcctcaatgctctccacacatgcctccaggcaggaggatacatacgtttgtcatctctacagctgagaaaaaccaaaaccacaaggccacaggtcagaggctgtcttggggatggccaggggagggggacagccctgtcccttccatacaggccacagagtgagccaagaagccttctgggcccgtcttgtgtctcttgcaccttgtcaatatcttgtggtacacagtgtgcaatgaacgccaccagacatctgcgagaggaaaacagggacattccgaatcactgaaacaagccaaccttggaagggcgggaggcccgggacgcggcaaggcctcccaagaacgcgggcgaaaggcgaagcacaggccatctgagtgcacagacggactcaacgcagcagaggagccgcagcaaacaccgtcggagccgcggagcgtggagggcagatgagtaaagtagggtcttgctatcaagcctgaaagcacctgccccgcctgcctgtgcctgaactccacgctcacagttttcagggagaagtctgacccatgtttatcagaccagagttcagggcccaccgggtcagagaaggctccctgggagtctgggctctcagagacatcacagagagcatctgttccgcggggcgagagccctgttagaagaaagcttcagttatgtgagcagtggcgccagtgctgagccctggggagccaatgcaaccttctgcccacctcagggatgccaggccccgctgaggccacatacccaagaccacgtgagaggacccaagtcccccgcgagctggatgaaaggactgagcaaacggtgtttcttctaacggcctcaggtcttgatttcagtcactcctcaaacctctcgcttcttcgcccaggtctatggaaaggcaaatgaccgaacactcgctcaggatccagggacccctccaacactgctccaggtcagcttctccacaaacaagcagagggacacaggccgctcctcttccagcccctcctagggcgcagcaaagggctgagctccgggtaattctacagctgttcagcgagcacaagtcaggcactgcagggatggtgcagacgacaccacgccgtcgtccactggacaagatgaccccaaagcgcaaagctagagagcctcacgggacacagcggaagggcgcggggaaagccaggcaatgtcggacccaggcggcaccgggtctgggaggtgggcaggcaggagtggtcaccacttcagggtcatccaggaaatacagaacattttccag

SEQ ID NO: 5740 - DNA, 1493 bp, Homo sapiens
gagacagagtctcgctttgttgcccaggctggagtgcagtggcgtgatctcggctcactgcaagctccgccccccgacgttcaagtgattctcctgtctcagcctcccgagtagctgaggtgggaggactgcttgagcctgggagttcaagaccagcctgggcaacatagtgagaccccatctctacaaaaaaaataaaaaaatagctgggtgtggtagcatgtgcctgtagtcccagctactcaggaggctgatgtgggaggacagcttgagctcaggaggtttaggctgcagtgagctaagatagtgccactgcactccagcttcagctacagagcaagaccctgtctctaaaaatataaagaaagaaaatttaaaagtaaagaaaaagtggatcattcggtcctttaagatgtggcactgcccaattagaactttcctccatgcaatgcaattacagtcactgaggcactggattttctagttttatttaactaagacggagactgaaacagccacacgtggctcctggctactgtgctgctgaacacaggccctcactactcaaaagtgtggtccgtggaccagcagtattagcattaccagggagctccttaggaacataggtccttgatcaggtgtggtggctcacacctataaccccagcactttgggaggccaaggcaggaggatcacttgagcccaggagttcaagaccagcctgggcaacatagtgaaacctcgtctctacaaaaaaatacattagccagctgtggtggtatgtgcctgtagtcccaggaggctgaggtgggaggatcgcttgagcctgggggaggttgaggctacattgagccatgatcgcctcacctgggtgacaaagtgagactgtgtctcaaaaaagaaaaagaaaagaaatgtaggcccttagcctgtacctccccagcctgttaggcagaatctgaattccacaaaaacacccccaagggatttaggaggatgttgaaatctgagaccctcccatggttgaggccaccagtcacttacacacaaatgccttcctctgcagcaccaggagacagagcccatcacagaacttctcagggtgcctcctacaccacactagctttgtgtgtttgttctttaatgcctcaaggcatactactagccaaggagagtaactaacagcagctgttgaacactatgggtcagactttgaccatctgttatggactgaattgtgtcacctacccatgactaaattcatatgctgaagctctgacctccaacagggactgtatttggagacagggcctttgggaggtaattaaggttaaataaggtcataagggtggggtgataagctgacaaaagggaggctggttgtggtggctcacgcctgtaatcccagcactttgggaggcagaggtgggtggatcacttgaggttagcagttcaaaaccaacctggccaacgtggtgaaaccccacctctac

SEQ ID NO: 5741 - DNA, 571 bp, Homo sapiens
gtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatggg

SEQ ID NO: 5742 - DNA, 2455 bp, Homo sapiens
gcactgcaccgagcttgcacagggcgaggcgggggcaggacctgggacccagccaccccggaggaaaccggagaggaaaccagcttggtcttgctctctgcctcgtcccaatccccggctcttaccaaatgcagatccgttggctgaatgccttttagtctgcatacatgcatctcataccgcacagcccaaatttctacaacttgtccaggtgcagtctcctcagaactacaaagcaagaaaagatcacctttgggctcaggaactcacagtcgttctccctctcccggaaggcacaatgaccaggacagtaccgagctttacagccatattgaactcaccatcaactcagcacattcaactcaatcagtcaaaatcgtcttttcctgctggtaaataacactgaaattgtgggaagatgggatggtaagaacaaagtctgtctctggaagcacgggcgctgtctctgaagacaaattgatcgtaacacaagcagacccggtggaacgacctccatgctgaaccctcagctccccctgcatttggaccatggcctgatggaagataaagagactgatctcagagtggtacagatctacaaccacgtgaagaattggatttatattcatctgactccagaaagttcctgagattcctctgcttcatcatctttcccatgccctttaaaacacgttatcaaatagcaacaggtggtgcaataactagacaaatgattctcagcctttttctttgccattagcactcccggaaggagacgtgttggacacttttccttgtcaccaccccatgaaccttccataccacaggtatactgtgtattcggttatgtatcatctgtacatctgtttctaaaacacagaaacagtaagagccccccatccaagaatccattttaatcctcttgggtgtgatgtcaccccccaaaaatgcatatgctctggagtcagtcacaaacacattacgaatgcatgatcacttaagaatgttaccaaagtttataaatttgagatgataattctatgttatttagttcattttagagataagtaagaaccagagattccagagaggtagaccaagctgacagagcaaggaaaggcagagccagacatgcagctgaagcatctgaattcccactctagtgctccagcttaacctggatgatcagtaaatggttgcttttcaatgtgctctcaacacttcccacactgcctccttcattaataaaggaatggtattttgggagaaaccagaatctgccctggggcaatagaaaggcagcaaagcaacctgcattcaagtctttgggggattttttggaaagcagagtgtattagtctgctattgctgctgtaacaaattaccataaatttagtggcttaaaacaacacacatttgttgtcttaaagttctggaggtcagagcccaaaatgggtctcatggagctcaaatcaagatgtcagaagggctgtgttcctttggaaggcccttggggagaatctgttccatgccttctccagttcctggaagtcacctgcttgctttggctgtggggcacttccagcaactgcatcactctaacctctgcaaccatagcacgtctcccttttctgactctcaccctcttctttctttcccttataaggacaattgtagtacaggataatctccccatttcaaaatcctttacttaatcacatctgcaaagtccgtcttggcctataaggtgacatacttgcagattccagaaattagaatttggacgtctttgggtggctgttattatgcctgccacacagaccaatgcatacacaatgtgaccaatccatcatgatttgtctgagactatattggctttaaagctgaaagttctgcatcccaggaatcgcctcagtcccaggcaattcaggacaattcgtcgtcaccctatgtgcacctcctatgtgctccttcaacttagagagttggtgttttctctcctcttcaaaggactaactccttttcacctaaagagtacacagaggctgggtgtagtggtttaggcctgtactctgtgcatttgggacactgaggcaggaggttcacttgagcccaggagtttgagaccattcacggcaacatagtgagatcctttctctacaaattttttaaaaaattagttgggcatggtggcacatgcctgtagtcccagatacttggcaggctaaggaggaaggatcccctgagcccgggattcaaggctgcagtgagctatgatagtgccactgtactgcagctgaggcaataaaacgaggccctgtctctaaaaataaaaaaaaaaaaaaaaaagaaaaaaaggctgcacagaatagactgatggactgaaggctctgcccttatcaaacatttactaagtaataattataagtttgcctcctacactgggtgacttctc

SEQ ID NO: 5743 - DNA, 1423 bp, Homo sapiens
cagatttacatggggcttattttttttttttttttggcctatttctcccttttggaatgggaaagtctaccaaatatctgtcccaccattatatcttggaagtaaataacttgctttttattttataggctcatagctgaaaggaacttgcctgagtcttcaatgagactggattttggactttagagttaatgctgggacaagttaagacttttgagactactgagatgaaatgacgtatgtgagaagaatatgagttgagggggaggggaagaatgctttggtttggatagcatttggatgattgctttggtcccaccacaacaccttgaaatttggtccccagtgtggcagtgttgggaggaggggcctagtgaaaggtgtttgggaaatggaggaggattcctcgtgaaaggcttggtgctattcttatagtagtgaatgttttttgtcatttattaatgtgctttacatttatttgatgtgttccttgtttttttatatttatgttacattgtttggaattggaaaggaatttaagagatcatttggcccagggatacaaaatgtcttacataaaagcttccacacttattcccttgtccgtgccagatactgtttaaatgattatagtgatctttcctatggagtctcagaattcttctgaacacattactttaggaagatgctaccaatcattagatctggcacaggagttaaaacctatttgctacttcaatctagtctagacaatctcattttaccaacaaggaaactgaaatacagaaaaatcaaatgataccccaggactcaaaacttgtaacatgcaaaggaagaataattctggtgcttcttactcaatccagtggtatttctactatatgtcttttaaggtcatcttgaaagagaaattttctgaagtaacaggaaaattactatgaagtgcacacttcaagattttcttgaaaaacgtgcatttctgttttcagtgctaatcaaccctggttatgactagtgtcttagaaaacaccaaaaagagttgtttatttgaacaacatatgatataagcccagtatgaaatatttgttaagtaaagcttttctgagtgaaataagtgtgtgtgtgtatttgttctctcccccactccatctcaagcaccaagtaactcttgggaccccctaagcctttttaaagaacagtttgaaagccattacactcgagaaacaaatgtttctgcctaaaggaactgtaaatattatacattcataatttaaagtatattttttcaactcagataccatatctatttgtcaaacacaaagagtcatagactgatatttccctgaattatgccaatggacttcatatatataacaaactagtgattcatttttaatgtacttgattaataagcagattttat

SEQ ID NO: 5744 - DNA, 12993 bp, Homo sapiens
acttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatgaaaaattttagaaaatcattttctactcactattttatgcctgccagttatcctttgttagtgataaaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaactctcatttgccatccaactcattctatatatttaaataaatgtacttacacttgtgtataggatttaaaagggggaaacttaagaaggaagaaattgtgtatagaatttaaaaaggaggcattatattgcatgagtagaatgaaaagtatctaaccagaaagcaaataagttaaggattatattatactgaaatattttaatacaatttaaatatttcattactctttcactttatttgctatttgtagatttcagtattgtaatgttggcaagtctatttaagacggcattaataaaaattttgtttttcaggcatgtgataccaagtccctttccattatagataagtaaggcctaggttggttaaaaccttagctaaacacaaaatttgctagagaatcaacatataagaagctctaactccaagcttattcaccccagatatttcaccaatgttaacacataccctattgaactaagaaaggaattatattactaaccagcagagggagccaagtcaatcatgaaaggtaggagtataaaggaacatcatatgacttcctgttttgaatttaactgtatggcccctgctcactttttgagtttaccaaaaagacagtcataaggagagaaaggcgaccaatgtatcaaataaggatacagtgacaattataacttagaattaccttgcaggaaataaattggaagaaaaattgaatgcagaactatacaagtgaaatgtctcagtattataacccaagatggaaaaaccatggaaaacagtaccttaatgccatgatgaattgctagccaaatgtaacagtgaatatttcttaataattccattttcacttaaagttgaaattaggccataaatagacacattttaaaactataaagttgtacatcaaatttatgtgcatttaatctaagaaataagggataaaatttaataaaaaattattacagtgaattaataaggacatgatttttcagcttaaaattagagaacagaattgtttccactactgtttataaacacaacaaataaagtaatatctgttttgtgagagatgtttggaggaatctagtagctaagtgattatgtcagtttatttaattttgtctaagaacttcaaaatgcctgatagaatgggtgcatattgaatgaatagatgtgatctatatattatttgaagtaaaagtataagagctgagcgttagctaactgcatcaaaataaatgtaaagacccaaacatttttagttgaataaccaaatgaattagctagtctagccccttactcgtttcaaggtttgtggaaacataccatatatacttttactcatgtgtttattcctttcaaaaatatacttcttaagcactatctccataggacgtggagcatatcttcattatgaagtagacaaacttcttaaattttattgaaagatttaatttcattgatatatgaacaatcatacaaattcagtatgccaccagtgatttcaagaaagtgatacttagaagcaaatcatttatgggactagactgcctttgtaggactaacaaattaggcacaagattagaaattatagtttaatagtcatgcagctggaggctacacgattctgaccctccctaacctgctcctaagatcagtgcttgagatattctgcagaccctgcacttgatggatcagctggcaccacccagatcaataaactggctcatctgatcttgtggccaccacccaggaactgattcagagcaagaggactgcttcaattccctatgatttcatctccaacccaaccaatcagcacactctattcacttgccttcccccacccaccaaattatccttaaaaactgatccccaaatgctccaggagactgatttgagttataataaaactccgatctccagccaaaaaataaaaaataaaaagcaaattatttgattttgagtactagaaagtagactttaaactttttgaagggtatattcttttataatgctatattatactggcattattttataaattggcatttggtgtcaagtcagttaatcacagcgataatatccaagatgtacagctcatcagtcctagagacatttttttttgtttgtttaagacagagtctctgtcacccaggctggagtgctgcagtggtgcgatctcgcctgcctcggcctcccaaagtgctgagattacaggcgtgagccactgcgcccagcctagagacattttaatgccaaaaaaccctcaatgccaccagtattactacttctaattatttgtttcctttacacacgagttgtgatgaatatgggctattagaattgcataaacagcctaagcttttaaatgtttccactcatgaaaaatagctattatgaacttttaaacattaaattaataaagtgcaatagctttaccatgaactattccttattgataaacatagtaatgggttaactcatgtcaaagtccaataaaaactagtaactttgtcaccaaagtcaacatttcagcatctatgatatgtagtataggtatttctgttttatctagttttcatttaataatctaaaagattctggccgggcacggtagctcacgcctgtaatcccagcactttgagaggccgagggaggcagatcacgaagtcaggagatagagaccatcctggctaacatggtgaaaccccgtctctactaaaaatacaaaaaattagccgggcgtggtggtgggcgcctgtagtcccagctactagggaggctgaggcaggagaatggcgtgaacccgaaaggtggagcttgcagtgagccgagattgcaccactgcactccagcctgggcgacagagtgaaactccgtctcaaaaaaataaataaataataaataaataaactcaaaaaccaaacaaaggctggtgagaaaatagctcatttcttgtcttattccagagtaaggagtggtgacagattaggaaaagcatcaaaaaagtggcttccagtgaacaaaatcaggaagtttgagtaaagaatttctcttttgctaaaaacttaaatataaaagtttagtcaggaatttgtacccacacatgtatactgcttttaacatttttctctagacatttgaaatattttattttctctttaaaaaagcagcaccaaaacctaaatttaatagtaatgtttctgatttatcagcttctttccatcttacactgttgaattctgtactgcttctaaagcacctacaattaactctacaagaactgcacaattaacactcggcattgccttcttcctaattctaacatcgacattcatcagctttctccaatacagtcagatgattccttataatcatatctagccaaatgatgtaacttttgcttgatgtatgggaaaatagcttacattatgaatttagaagagctatagtagtatttgacaatatagatggaaaagtatttttaatttaaagaacatattgcacatctttcagaatttctgtaaaaacttttgaatgtccattttggctaggagcttagaaatgatcatgcttaagtttaattttgtgtttacattaaatcttttggattttcattctgtatacaatattgctgtaaaacatcatagttgtgaaatctggctctttaggagatgcttaccataaaactggtttgaaaactattctgactacagtgtagctattacattcactaataagaatttagtatgcctctgaatataagtaagtctctaattccctatttttttggaatattactgtattctaagaatatcagaatatgagcttcttaaagattttgaattagcatatccaaattgacagataacattcttaggtggggcgtggtggctcatgcctataatttcagcacgttgggaggctgaggtgggcggatcacttgaggtcacgagtttgagaccgggctacaaggtgaaaccccatctctactaacaatacaataattagccaggtgtggtggtgcatgcctgtaatcccagctacttgggaggctgaggaacaagaattgcttgaacctgggaggcagatattaccccacactcaacaaataaatatgaaagaactttacttacaggataacatcatgataaaatttgcattttagaataactctacaattaacaataaaaagaagtacctataacattaccccacaaaagggataaggtgtggtgaacttggaaatttcatacaatttagaaatatgtattgagctgtaaaaatgttcatattcattgacataaaactttcacatctgaactcttgaggtggctatatattgcttttgtaatttcaatgaaaacagaagcttgggcaactgaatgaaggaaggatggaatgtaagagagggtggagaaaggtgaatcaatgagaaagttaatgtaaccagtcaaatgatttaataatttattttttagcagcaaatctccttaacaataatactttcaacttaataatactttcatcccacatctagaaagcttacagcaaactttccaagtagtttgtctgttctcaccccaaggtgcaactccaatgcaacccacgcttgctgaccattcttgctgcttcactttcatcactcctccataacacgtttatctgactaccaaccttctcataatatctatccactcaccattggttcccaccatccccacacattttggttcctttaaatcaagggtaaatatagtcttgattgttcatgtcacctagtggtaagacaaaaactagcatgacagggtggaagtgaagattatgccatatttcagaggtttacatgttttccagtagtgaatcacaactatcagaaatccatatgtatgtgggccacatacattttaaattataacaatagtagaattataacctattagctattcaaaagtatttagtttttggctgaggacagtggctcatgcctgtaatcccagcagtttgggaggctgaggtgggaggattgcttgagtctggcagttcaagaccagactgggcaacatagtgagacccccatctctaaaaacaattttttttttattggccaggtgtggtggtgtcgacctgtcatcccagctacttgagaggctgaagggggaggatcgcttgagcccaggaggtagaggctgcagtgagtcatgatggcaccactgcactccagcctgggtgacagagtgagagcctgtctcaacaaccagaaaaaaagtatttagttttacagtattacaaagtagtgtcacattagtttaatgaggtttatttatacaaaggtgtaaaattatgggccaagtactagccttcaagtaatttcgaagtcagcgagaatactggtatataacggatcaaactttgttcaagaaccaaaggctattgttcaacgaatggtgctgagacaactgcaaaagactaggacccttacctcacatgcaaaagactgggacccttacctcacaccattttgcaaaaattagctcaaaatggatcaatgacctaaatgtaagagaaaacctataaaattctcagaaaaaaacagaaggataaatttgtataaccttggatttgacaggattcttagctatgacaacaaaaacacaagcctccagaagcaagcaaacaaaaacaccataaactggacttcatcaaaattgaaaactttagtggttcaaaagacaccatcaagaaagtgaaaaaatccacagaataggaaagatatttgcaaatcatgtatctgataagggatctatgtctataatatgtaacgaactcttaataaaaaataaccccacttaaaatgggcaatgaatctaaatagacatttctccaaagaagaaatgcaaatggccaataagtacatgaaaagatgcttgacatcaccagagaaaagcaaataaagaaactgcaaggttttcattcttcttcacttacaaggcttcattctcactatgatagccagaataaaaaagtcagataacaacaattattggcaaagatatagaggaaaactgcaaaccttatacattctgataggagtgtaaaatggtgcagccactttggaaaacagtctggcagttcctcaagtgattaaacatctagttactatatgacccagcaattctactactaggtatatacccaagagaaatgaaaccatatgtccacacagaaacttgtacacatttgtttacagaagcattattcagaatcaccaaaaggtggaaacaacccaaatgtccatcaactgacacatgcaaaagtaaaatatggtatccatataatggtatattatggtatataaaagaatgaagtactgatacatgctgcaacatgaatggatcctgaaatcattatgttaagtgaaggaagctagtcacaaaagaccatatgttatatgattgcattcaaatgaatggaatatggaaatctatgcagacagaaagtagattactggctgtttaaagctgagggtgggagcatgggtgggcaggggaatagctaaagggtacagagtttctttccgaggtaatgaaaatgctctaaaattgactgtagtgatgattgcacatatctgtgaatatactaaaaaccactgaattgtacactttaaatgggtgaattgtatggtatgtgaattctatttcaatgaaactgttaaaaaaaaaaaaaagcggggggggggaactgaatatagacagggcccatctcaattcccagtccaggtttacattattgaaagtggcccttagattttatttccatagtttcaggaaagaaaatatacattaaaagagttggaagactctaatgttgcaagaatttgactacagagccagaaatttcagaatggtaatatatgatgtatatgttcattaaaaaaaatcctagagattatatgagtttgctttcagctcaatcaattcctcttgaagtagagccatgttgacaaggcagatgcttacaaaattcaaacacatctctctagtcagctgcagaaacttaaagcataattcatgctaatgaaaactagtgaatttcttctgaaattcagattttatttctaccaaatagctcagccgttcttcaaattctgtgattccatttagcacaggacagttctgatatgggacatgaatgcacgctccaagtaacatctacccaactccccaggtactggtattaatattaataactatagttccttcacagactcatctattttcttacttttttctctacagtctcaagttcagtgtattcagatatcttgcttgcaacatcaaacagaaaatataatcatgttaggtatttgagttcggacaaagagggatccctttaattaccaaaagttttacacctgagatagcatcattgtggctttcttcaacaagcttccataatcttatcaccttattgc

SEQ ID NO: 5745 - DNA, 3704 bp, Homo sapiens
aatgaattctcacaagtccaatcgctgtgtcaaagcatatggccttttaaaaggctttggtagcctgttgcctaattgtcttccgaaaagattccccacatcctggtcaattcttcagcatatacacggccatctctatattaagacactttatattaagatttgtaaacctgttgactactgtcacaggccaccaccactctgggcatcttcaggtcatgctacatgttcaccagtccttccagcagtgggcagtgcaaagcttccctccgcccacaaggtttctgtgatctttagcctttattgtgcagtttacttgttaaccggcttataatgtattcagcctatgctaatcattgactccttttgggaagggtagaaggtaaaagatgtatacaatctctcagctgacctttttttaatgttggggaagaataatgaacaacttttattatctaccatagacggccagtcttctgcttctaggatgctctcccaccaatgtgtccatctatgctgtcagccctaaatgccagtcctgtgtaggaagtcctgtgttcattcagaaaagtcacccagtgtccatccatttatgtccatcatattaaaaacagttgagttatatgataaaacatgctaccattaaatattttaacagatttaaataatatgaggaaattattaatggttgtgacatgttaaacaggataaacaatttttttataatataaacttttacatctatcatctgaattatgcgagaacaaaaaacatagaaaaaagataggaaagtaccttgggaagctgaggccggaggactgcttgagcccaggaactcaagatcagcctgggcaacatggcgaaaccctgtctctacaaaatgttttttaaatctagccagacatggtgacaggtaccttatagtcccagctgctcaggaggctaaggtgagagcatcacttgagcccaggagttcaaggctgcggcgagctgtgtttgcactccagcctaggtgtcagagtgagactatgtctttaaaaaaaaaaaaaagaagaaagaaatgtattataacattaggagttgtaggcggcaacattacaaccagtatttttctgattacgattttgtatgttacagatattctatattgagcgcattataccaataatcagaaaacattgctgaatcattttgtctttaaagaatcatctaatagggatgggaaggaatacaaaagttgtattaagtaaatgggatgaagctctcagttcagagatcaagatgattgggggataagaagaagaaaaacattcctgcaggactggtctgggcagaagaggagttgtggtaactagatatgaggagaaagagaggaaggaggcacagagcagttggagcttgctgcctggaagaatgacggtatgataaagagatgggatgatgtgaaataattcacattgttaattatgaagtgtgttttgaatcacctcagtgttacccagaaacgacactcggttatcatgttcagataggggacaatgtgtttttgcagtgatagcagtggaggggaagggttgtcagcttaaggggcagttggtcattctgtcatcaaatgaattagtagcaagacttgaccagcatttgtgaataatgaagcttttcttgctgacaaactgctgatgtttacattgggccattataataggcaatttaatgtcattaatgacctttatataaaaaataactcgtgaatgaatgaatgtagtgaacattaagtactgctaatagaaaaaaaaagggcaaggcttctttgccaacttggcagaatgatcatcagtatttctgcctgttctttgcctcaggtacacacatatttattttttagagacaaggtctgactgtgttgcccaggctggacttcaactcctcagtacaagtgatcctcctgcctgagcctcctgaatagctgggactacaggcctgcaccaccataccctgctctagttacacaaatcttaaaatgatgctgttatgttaattcaattaagaaagtaaactagttctatgatccaagcacatagttgtgactcaattcatgttgttgtttttaatcctgaaatgatattgtaaaataagagctttgccttaaagtttttgttactcagtttttacatttgaggtaagaaggcaagtggcagggaagaatgattagcaataaagctttttaaaagttcttcagaaacagtagacaattggttgagtcaaattgacctataatgactattcccaggaatttcctagttcttattcctttggaaggaattgtaactaccttatgccatgtaaagaatgctgctattttacgtttattacaaagatgtgcctacagataagaatcaaactggagaactttaaaaatgttttaactttacctgatctttttcttagaaagctaactgtaagtaggatatggtgccaagaaaaatcatcagcctgatactgtgaaaaaaagacaccctattaatatgcccacaacattatcagcaagctaagtaacatccctggaccttagtttcattatatttttaactaagtatgtatcagagcccttaacacaagcccaatatattttggaacctcaataaatagtggttttgctgattgtctttttaacaatttctaaaatattgaatactggttattataattaaatgtattctaaacatctattctttctgtctcatgccttgatctagcctgttccttccacctagaatgccttttccttccttttctcacatagcaatctttgacatatccttgaagactgagctctcccatcagcctgggaggcctggcctgatctggaagacggttcagcacgtctttctctgttgccatagtgcgggatttttgtctattttcagcaggtcgttccagactgcaagcctctggagggcagtgactcgatcccattcagctccatatccccactaccagcatggcatgcattgggggtgtccatacatatacagaacagaaactttcagggtttggccaattttacttttccttagcatgtattatcataaagtgatgtaagtactatatgcctggatttgtcttattactacatctatttgttagtaaaaggaggttacatgttgccttagtggtttctttgcacttaaatattttttaaattatttggttcttggctgggaacttagtccaatatgtctgctaaagtatttcccatttcttgccacctctacaatagtgccataatttccaagttgatttgacatgtatcatctttattctcacaatcctgagaggtatatagagcaagaattaagttctacatttaacaaaagagaaaacacacagagattgattggctctaggttatatagctaactggtaacaaaccaatttttattaaaattaattttaaaaatttaacttttaaagtttatcttaaatgatgaacatcgcttgtgtttttcttgcatgtagtttctattttaggagaatttgcctaggggtagttctgaaaccaagtaaaagtaattggattatgaaggtcttctaccttaaactagctgtcaactttaaactcaaccatttaataattaaatttaaactttacatttgtttaatttagtaatgtttcttcacattaatcaatttttcaaattagg

SEQ ID NO: 5746 - DNA, 2732 bp, Homo sapiens
atatcctgcctgagcctgggccgggtggaggtgtcctgcatggagtcttgtgaaatcgcgtggactgcaacacccagcagcgcgccgccctgggtcctgccactgagcagctgttggtaggctctgctgtgaggtctcctcttccggctttcccacttcccaagtgttggttaaggaatccagatgttactgcaataaccactccataaacaaaaggaacacccagctgtgagaactggcttctcagcattcgtcccagcagaggctcttctggggccagccctggaagaacccatcagggttctgatggttgccctgtttcagcacagcccttattggcaggcagacggctacgggcacagccacaggctgaagtgtcaacacttcaaacaacacagacagtacaatgacaaattggagatcagctctaatctcggcccccaatttaatgcattgctgaatattcttctgaacatagtccatcccacactgtcccatgacacaagacgctccaaggggctgaagatagagggacttctgcagtcaagagagctgggaaactcttggacagtcacaatgtgcatttgggtattaaaggctctgcaaagttctgcaccaaataaacccttggattggcttgatccaatgccatgtttccaaaacctacttgcccgtgggacaccttagtccataacacaggttggcatttcttctagagagtgtgctgtgaaaaacactggtctcacagcaccgtgcattcatccagcaggtatttaccaagcagggactttgggccaggtccgtgctaggctctgcaggtggaccagccagccctgacctccatggtgtctcttctcatgggagaggctgcacagcagtcattgagaaaacgaagaaacacacaggtactttcagatgctgataatgactaccatgtgctaaaagagctccaggtgttgtctgttttgagacaatcttctcgacaatgagatagaatgaaccatgcaaactttgggggctacgatggttttaggaaagagctagagtgaaaaatcctttgacatatatacatacaaataaagatacatgtgtataattttatgtaattgacatcacattatatgctggcacctgccttttttgcttaatgaaaatgtcaaaggtaatattaccaatcaatcaatatatttcaccatcgtgtttaatttctgcagagcacttattcaagcacatactgcatttttcttagtcactcactggtgggaatagaaagttttctcaggcatgcatttttcccacttctgaaatgatctccttagaataaattccccaaattgtattgctgggttcaaaggcatgaacattttacatttttatacaataatgtcaaactaccttccggaaatgatgctcactttactttccctccaagactgtgtgaaaatgcccattttcctaaatgcttactatgactggtttccaactacattttaattcttgttcaatctgataggcaaaaaatgatatttaatttttatttgattgataatgaccttgaacgtgcccattagccttttgcatgtattcttttatgaaacatctgttcctatccttcgtcaatgttcctcttcatatgttaacttttcttattgatttgttagagcactttgtatattgtgaatattagcttttgtgatcagaattatggaattgttgttgtctttagttttgcttatcaagtttaaagccattcagagatgttgtaaatgtgtatgttgttaaatttatgtcttattttgtgttttctgatgctcatatgtttagaatggtcaagcaatcccaacttatgattacttaaatattctcccatatttgctcttagcattttttttcttttcatgtaaccctttgttctttcaggaatttactttgcggtaagaaatgggctggcttccagttttatgtttcccaaatggtgattcagctgttccatttccatattctcccttattagaaatgaccactatattatgttctaaaatatctgcgtacttgtgtcccttcctataatctcagttcatctctttgagctatcttttgattcctttttcaaaccacactgctttactgaactgtcatcatcttatacatttttaatactcagcaagacaagtttctcaatgccactctttttcagagtttttctggtggttgtaagatgtttattcttctggataaactttagaatcactctttttgtccaaggtaaaatatatcccacattgagatcatactgaatatacagactaattcaggaaaaaatgtatgtctttattgcattgagtcttcttatccaataaaaaagatatgaatttccatgtattgaaatcttcactgagacttatttttggcttttcacatgtcctgcaaatgtattgttaaatttatttttaggtattttaggggaaatgattttctaaagtttgtattttctagcttgttataatttacatatgagatagtcattgttgtatattatttataactgatcatattactgtatttgtattgttttaatagtttttctattattttgggttttcctggaatacaaccttattatctacaaattatgattgttttgccttttccaatgttcataactgtttttatattcttgtctgattgctttgttcagcacttctagaataaagtcatgcaatactaatgat

SEQ ID NO: 5747 - DNA, 1829 bp, Homo sapiens
tacctgttcccctgagaagttgtagagggatcgaatgtctgagccattaaggatggtgacctgggagatgaagagataggcccattggtcctggactcccagaatatcccatggttaaagaacagatgtgtacaggacacccaggggcaggcattccttagagacgcagaccactgtccctagctccctcttcagctttgccctcatattcccacctctatgccaggtagttccaccctatgtctgcttcactatttttctccctatcaatcaccaaccactgacagattttgtatttatctgttcgttgtccctctctacccactagaatgtaagatcaataggggcaggaacttgattttgttctttgctttctcctcagaacctaaagtcatgcttggtgagtagtaggcactcaataataattatgactgaatgtgtgctggtgcctcaaacccatcacgttcaaaacctaagtcatcctcatcctccagtcccccgaaccacaaacaccatttctcccctatattcccttagtgactggccccaccaggcctcttgaatcctggtgtgagccctttcccaggactgctggacagatgtcttgacaatgtccctgcctccagctctcccagcagatctaggaggctacctctggcttggaaatccagtggccccctgcagtcactgcccaaagtctcaacttcttggctggtcctccaaagctctggagaatctggccctaacctatctgtttttgctcaacctttccatattctactcatcctcaatcagctcatgagtctgctaagttgggctgaaattgtttccttttcttccacctcattcatgctcctgcacaggatgccctcctgcctcatctctgctgaaccttcatagaaccttctctcatctgtcctcttcctttttaaaaatttaaaatttttatttcctgactccccaaacttgttaccatccttttcctagaaaggagattattctttcccctaaactgctatgccactgtatccactttgctgaagtttaccaaaatgcagaaagaatgctgattttggattaagagagacctgattttaaacctacttactaactgggtgatcttaagcaacttacttggtctcttagaacctcagtgttctcatatgcaaaatacagatgataatatctaccccataggcttgttgtgaagaatagaaatcatgaatagatagtgcctgatgcactgagtagagaatgaatagttgctccactttagatcataattgtatgtgtgtcttatctaacatacttgattagaagcatcttataagatggggtatgataccttattcatcttatctcttaccttgccttaataaatgttgttaattgaatgaaatccgatggcactcttatctgtatcttttaaaaagcacttgtcctggtctaataataacatctgccagttgtacattgcctaacaattcactgagtactttcacatgcattttctcatttcatccttgccagagcctcgtgaggtcagaacgattgttatcccagtatacagagaagaagaaggctcagagaggttcagcaggaagcagagtatgaataaagagcagaatgattctgccagagtaagtgccagaacttgaatgccagtctgcctccagagcccatgttctgatccacctttttgagcccttgcaaactgccatgcacggttctttgtgattaggcaggggaggagaggaagtgaggggtcaggctgggtcttacatagccgtaagtgaggttccctttgggcacaccagcaacaaagtctg

SEQ ID NO: 5748 - DNA, 3142 bp, Homo sapiens
tatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattatgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgca

SEQ ID NO: 5749 - DNA, 2258 bp, Homo sapiens
ctagctctgctcccagccagggacgctggccttctcgcggctttcccccgatgtctctctttattccagctgcctgaaactcggtcccacgaatggcaggcagcgtccaaaattcaaccccgtaaagccagcaccagccaataaagcgcacggatggaggccacgtgacagcagtgggccggccctccggctgagccctgatctctatggtttccgcggctcgctagaaggagtgcggtccactggaggtctccctacattcttcctccattatctcactgcctccggtggctgctgggataccggaggactcgggtcccggctcgactcagtcctccagccgcccggggaatacctctagttcttcccggccgccgccgcctccgccccgccgcttcctcctccgcctgccggcctccttcgccccgccccgtccgcgcagctcgtccggcccgcccgcaggccagcttctctcgggagcctccacccaggcgcatggctccatgaagcaagaggaggaggcagagcgcgagagatcccgtccgccccagccgcgtctgggccaggagaaaagcaaaaccatattcctgctgctgtcagttttgatgcactgagaaaacttcagagacctaagctttttccagagaagagaagctttactggtgttccagccctaaggctcatatgacattaacagacaagacacttttcagaaagacaggttgttcttttgggccacatctaagaaatctttgtctagccaaaagccacaaataatttctcattttttggcttctggaagatgtacagttaaatgttatatttgggactgttatctaatttgattaaattgcactctacaatatgatatttgaattgatgaaaaattagtaaatgttaatattttttaaagtagccaaatcttgcaatttatatataatagagaagactagaaaatcccccatatttatttcctcttacttcgtactactaaaatttgtatttaggcatttggtttctcagataaacattacattccccagtatatggttctatctggcttggtgacgacatgttgaacattaagatgtgagcagaagtaatacatacacactctttttaatgtctttaattgaatgggatattggcccattttttcttccagtttattacactgaatattgacatgttattttccaatattgagacaatcaatgacaagactttaagagtaacaatgtaaaaattatagaagttgtctgagtttatcaacaatcccctggattagaaccccctaccagttctaggtcatctaatatatagacattgtgttcagtagaaataaatatatatattttttaatatactttaagttctaggatacatgtgcacaacatgcaggtttgttacattggtatacacatgccatgttggtttgctgcacccattaactcatcatttacattagttatttctcctaatgctatccctccccctgccccccaccccccgacaggccctggggtgtgatgttccccaccctgtgtccaagtgttctcattgctcaattcccacctatgggaatacatttttaaatcatttttaaaggtgttattacattctgattgaacattttcagaaagaataaataatttaatacaagaagtgggccacttcatgtaacaaaacaaaccaccactacagcaacaacaacaaaaaacactaatgaatgtgactttagctttgcaacatcatgacagactagcaagttaatgacatttgttatgccatagaaaatatttgttgaattgccactctaatgactttatatcagccaactcattatcaacactagaaaagatgattaaaaaatacttcagtacgttcatgtgttggcttgttaacatttttaagagtctataagagaaaaatgcatccaatctcggcaaaaatatttttcaagtatcttgtaggtacgtacaactaactaccttgtgaacaaaagtcactatataattatataatttctgacacttaaaaaagtttattgtgcaaaagaagatatatgttctaataccaaatccacatataaaataattgacttatttaaataatttaagatgctcttttatatatttatattaaaaactttacagagaataaaaaaggcattatacaggctgcttatggtttttgatgtttggatatacaatacatgtatcaaagattgtggaaataaatcaagcaatatattcaat

SEQ ID NO: 5750 - DNA, 4730 bp, Homo sapiens
ctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgttgtatatttaatttgtcctttgtccaagaataatgcaatgaactaggcaactagttgaataaaaattgaaaccaagttcaaacaagcctattgaaaaatgggcaaaagactggaaaaacatggccaataagcgtaagaagagatgttcagcttgatcagtcatcaagaaactacaaatcaagaccacactgaggctgggtgtggtggctcatgcctgtaatcccagcactttgggaggctgaagtgggcaaatcacttggacaggagttcaagaccagcctgggcaacatggtgaaaccctgtctctactaaaaatacaaaaagttagctgggcatggtggtacacacctgtaatccctgttactcgggggctgaggcacaagaatcacttgaactctggagagagaggttgcagtgagccgacatcagccactgcactcaagactctcgatctctctctctcaaaaaaaaaaaaaaaagaccacaatgaaatacaactttggactcagtagactgacaaaaattaacaaatgttacacagaatctcttatattgctggtaggagtataaattgtttcaattatttttgaaactaagggtttgcattatcttgtgaagtttaagatagattcacatatatgctcaagcagcaattccacctctgggtatttacctaaaggaaatgatagcatgaatgccccaggagacatggtcattaaagttcttagtagaactgctcacaatagcaacaacaaaccaaatgcccattgacgagagtggatgaataaattacagtgaaatattttgcagtcaaaattaacagataaatccaatatgacttaacagtggtttacagcgaatgttttgtttctctgctgacacatcaatacttgtgtcttcatatgtttagcatttttattctgaacttatatgtggttgaaggtcatctgtgggagtcagaaactaaattgagcatgctgcctccagagagaattagcatttgcttgtttttttcgggtaacatactgctatggactggggccactttagccctgtttgagtatcctaggctattagtagagtcaacttttacttcttacagcttattcccaaggcttattctccagtgtaaccctagatttattttttattatttttatcttttttaagattcaagggatacacatgcaggtttgttacatgagtattgcataatgctgaggttcaggcttctgatgaccccatcacccaagtagcaaacatagtacccgataggtagttttttagtttttcaacccttgccccactccctcccttcccatgaatccccagtgttagaaatgcttgttccccagtgccgtaaagaaatagcacttgaacataaatttaatttcttcagcaaggccatttttactttctgcagaaagggtacactcactagcagttttgtcaccagagtacacagaacaaaggagacagggtcatttataacctgatgcgtccacactactgctgtgtctgatttccactggctggaacgggacctcacattctgtatttgtcctgattggctagcaacttagaaccttttaaaagaggcaaaggcagaggagaacaaaggaaggaggaagtaacttgtggaatgctgagaaaggtaaaaacaccttcaaataaggaagaggaacaggctatgacctaatgcttgcttggaccagtataagcatgccagggcaaatatttaggctaaattgtgggagataacataaagtacattgatttctttattacagatagcagatatttaagaatgttggcacaggtctttgaataaattttgcttctaaggaaagttactgtttattcctaattagatggggaagaaagtctttgaagaggaacgtctactttttttttttacaccagtgtctattgttcctatctttgtgtccatgtgtacacaatgttgagttccaacttacaagtgaggacatgcagtatttgtttttctatttctgcattaatttgattaggctaatggcctccagctacatccatgttgctgcaaaggacaggatttcattctttttaatggctgtatagtattccgtggtgtatatgtaccacattttctttatctagtccaccattgatgggtacctgggttgattccatgcctttgctattgtgaatggtgttgtggtaaacatgagtgcaggtgtctttttggtagaacgatttattttcctctgagtatatacccagtatgggattgctgggtaaataataattccatttttagctctttgagaaatctccaaacagctttccacataggctgaactaatttgcattcccaccaacagtgtgtaattgttcccatttctcaaccctggaagggttattcagatagtgtttgccagactgctggaagtgtatttcactaactatagtttgattcatatgtcttccgtgacttatctgtaaattccttgaaagaaggaacttctgacctaaaattttgaataaaacattaaagttttagggaaatttggctgggtgcagtagctcatgcctgtaatctcagcactttgggaggccaaggtgggaggattgcttgagcccagaagttcaagaacagcatgggcaacatagtgagaccgccatctcaaaaataacaaataaaataaagttttggggaaaattcttatatatttagatactatggtaacgttttaataaaataaactgagttgcttttcatgtatttctgttttctaaaaattatgtgctatattaattacctgttcctgccctggagatgatgtttggttatattttcaggttctttcactatttttatttttgtctgtttggacttacaacttttatctatgttaaatctggtatttatacttccctttaaagccatatattttatcaaaaaattattagagaaaatttatactcacatggtattttctaatattaaaaactccttaaaaaaactcatgtctgtcaccttgctcatttcctttttttattttttgagacagagtttccctattgtcacccaggatggagtgcagtgagccactgcactctagcctgggtgacaaggcaagaccctgtctcaaaaattaaattaattaaataacaccataatttatgggtgtgtatttatttatagctttagccacatataaactcttaaaatgttatagtgtattttattacttctaagtaacctatgattttatttttacttcatcttaactcacttattgaagaggttaatattttaggtagttgaaatgttttcctgttttaattgtcagtattaatttctagttataaatttggactaaagaatgtgacctgagcaatttcttcattttggatattactgaagttttatttgtgaccaatatttgaaaccatttcatggttcctgaacaagaaagcatggtatgtgcttcaaaatacaacattcaacttatagctgtattcagtgttgttaattgtattttgaaagtaaaaactaaccattggtttttgtctacctgatatatatgtgcctgatagtatcttgttgtcccctgctatgtttttgtttctgtcaatgtatcatattttaaatcatagttattttataaaatgtgattgtgagttattatttaaaccatgccttctttagaggttggaccttttatcagtgtgaataactctttttgtcccttggatatcaattaaattgaattctaatttttttttttaaccttacctcaggtgctgtttggctcctgcagccaaatacactgatgatttaattaaaatgtttatctcccccaaattttaagaactttatttgggttatttggaataatgtataaaatatctatatagattattatataattcagggggaagcaaattatcagaacaatttcatgttatacaaataacatcagaaaaatatcttaaattatatggcatattctattgattcatccacaaatttataagtccttaccacctttcattatattggtactaggcattatagtagtgctaggcactatagtaatgctggggtataaacaagaataaaacaaaataagttccttatttcaggtaacttacagtataggtcagtggttcttagcttgctttttaattatgaattcctttgaaagtctagtaaaataatccaacaccattattccccattgcacatacccccagatgttttagacatattttcaattgctccatggaccttaagaaaacttggttggtgtgcagtttggtgtattatgggtaagactggacctggtgttagaaaatctgcatttgaggctttgttctgacagtgtctagtgtaaacatgggcagaccacttaaacctctctttagtcttctctgtagaatgatgataataccatctaattagcaggattgttgttttattcagtgagacagcatatgtaaataacttagtaaaataaaaagcaacgtgttta

SEQ ID NO: 5751 - DNA, 1127 bp, Homo sapiens
gcccacggccgcggcagtggatggggttgagctcgtcctgggggaaggcgtgagccatgtagttgtcgtagccaaagacgaacatgccccgtgccaggtcgcgcatctgggcacgcagctgcggagggaaggcgccgctgtagcgcttctcgtactcgtccgggccgcggccccggccgcccagcacgtagccccagttggctgggccgcacatccccggcccaggacgccgcggagccttgcgcgggctctgcgctgccccggtccccggcggctgcagccacgacggcccggatacccccccaggccggcccacgggccccgaggtgggcgacgcggggccgtcggggctcctcagacgctggaagccgaagctgagcggaaagcgctggtagaagcccatgctgggccccagcccgaagacgagccacaatactccatggaggccaagccggaggagcaccagccccaggacgagcgctcgccattgcatggtcgcgcgggcgccgcgggcattattttaaagcgcgggggcctccccgccgaccaccgcaccccgcgctcgccccgtagcccggctcgcttcccctttaaggaactcccccgtgacgcaccaggaactagcccatcgtccccaacccccaggctctccggcgggccggccaggccccacggtcgcccgcccagtggcccgggattggcccggcctgggcccggcctcgcggggcgcggcccaggactccctcccacgcagtaggccgccaggacgtccgcgacgccccgaggccccgcccctcacccgggccccgccccaactcccaagccccgcccccctgggcggtccgtagcccgatgggctggcgtggcgagcaggagccgcgccggcccgcgagggaacttccagccaatgggagagcggcacggcagcgcccgccggacgctggacacagacgtgaccccagaccgcctggccttgggtggatcgggtctctgggcagagcgtgtgtccggcagagctaggaccggaaaaagccactctaggtctaggttaggagtgatgacagttaaaagatatataaggaaaagaaggaaaggatcgtttctgtataaaacgagctatttttgca

SEQ ID NO: 5752 - DNA, 7567 bp, Homo sapiens
ctcctgcttttttcctacactctctcctccctcctctcctccctctttctcctgtttgatttccacctcttttctctcctctctcctctgaatctgcctcttcctcttctcacctccctcttccttccctgtctctcccccttgggtctctcttccttccctctctctggtttctctgtctctgccctgtcctttcctttccctcctctctggacctgtctcctctcctggctctctctccttcaagctctcactcccactggcctccctcccgggagccccgtctcctccgtctccaggtggcccctgcatccctgcctggtgggcctttgcctccctctcctgttcctgccttgcctgctcccaggtttccaggtcctgaccaggaggcaggagtccataccgaggcccaaacaggctagccctgagcagggcccccaagcctgaggcccaggagtggacagacctttgtgacacccattctctcttccttttccatctgtccggaactctggacactgcctggaggaatcaggcctgccgtaggcccaggaaggcggaaacaaagacgacgctcagagacaggaagcaacttgcctaaagatacacagcacgtaaggagcagggacaggactgggtggggcccctggggttggccaggagtgggctcctgaatctgccgatccctggcctcctatctgagctcagtgagcagcggatgacgcctttctgctccattccgctcccttcccaactcttcctctgacaacatgaagcacctcagcactgaggggacctcacctgaattccatttcagaaatgagaaaattggtgcccaatgtttctgaagaccagcaactgctaagacagagacttcgagggaacccgaccttgcctgaaggaccaacagcgccccctgcaggacacttccctccattgagagaagccacaggcgccggcctgaggcattctgagtgcgtggaatcctctattaccacctcctggcaaagaacggagctgcaacccagctatatgagacaccgagaatgatctcaacaaaaaggaacagtgaccagaatgcctgggggaggaacaggggatactgggtggaaggaggggagagggagaagttgtaatattttgtaaaaatgaacatttttactcctaatcaatatacaaacatcatgctcagcaaacttcttggtatgaaacttctgaacttcacacattttcaagtcattctatgggtgggtggattggctcccatggaaatgcaactgggactgcacatgggaaacaaaggaaaatggaatttggttcacacaaacctgtttgggagattgcatttccaggaaatgggccaaattgagtttgtttcctttgtaacaacattgttgtgccttgctgactggaaggtgggtacaaataaaggaggatggactgacagctgaagaggcaccagtaattagcccctaatccttaccagggagtctctctgatgggttaaagaagcctacagaggccaggggcggtggctcacacatgtaatcccagcactttaggagactaaggtggatcgcttgaggtcaggagttcaagaccagcctggccaacatggtgaaacccggtctctactaaaaatacaaaaattggctgggtgtggtggcacacggttgtaatcccagctactcaggaggctgaggcaagagaattgcttgaacctgggaggtggaggttgcattgagccaaaattgagccactgcactccagcctgggtgacaagtgaaactccatcccacaaacacacctgccccccacccaccaaaaaaaaaggagcctatagtttccagtagacaatttggggttagtaaagaattttacaaaatactaaatgtagtcttgtatattttaggattgtttgccatgcaactatgtactgggagcacctaaatgcccacatgaaaccctaggctgggaagaggaaggctttcgcaatgccacgcagccgataacattttctggtggcaggaaatgggagggagcaacccctcctggagcatttaccttgccaggtgctctcacatcttagaccagaagtcacgaggctaggatgagggtccaggaggcagagaatgaggattgagttagggtcaggacagtggacacagagaggaggagacacagaaggatgggttgggactctatcctgggggaggtgagaggccacgcggagggctgtgagcaggggagtagtgaggtcagctctagtgtcaggaagctctccattagggggatggactgagggggggatgttgggggctgggaggccaaagaggaggctgggccgatggtccaggtggcagaggacgaggcttgagctgggaccaaggccatggagacagaggtgacgggatgaggccaggaagaactttaggggtaggtatggtggtgcataggagaacgtgattgggacagggcagtgctctggtccatgaggttgggcaggtgatggcaccactcactggaacaaagatccctggaggagcacccgatccgggcaggtgggaggcactggctcctttagtggcccctgaggcacatcctggggaaggagcccaggaggcagctggggccatgagtctggagatcaggggtgggatctgagctggagatgagttggggaatcgctggtgaagaggggctgtctggaacctccagggtgaagggatggggcagacacctggagtagcaagggggaagcatgcaccaccatcacacacacatccctctcccccagcaaggtggggccccaccgggccatgtcttccacagacacatatgtgtgcaaaatgatgcagcagaacagggggactcctgcagtgctgcttagaactactcaaatccagcaacacactcttacaccagagatggaataagatggcaccttataccagagatggaaactgccccagctatgtcaaaagaaggtgggggaaaagagcaacacttgcaaaactgttgacatgtgcatctgcttgtttctgtggagagtatctgcagcataccaggggacagaaaactcaggctgcctccagggaggggaagtgggtgctggagcccagagtgagcatacagtttctggacgtggattccactgcatcttttgtctattctggagacagggtctcactctgtcacccaggctggagtaaagtgattcaatcacagctcaggaagcatcgaactctggggctcaagcgatcctcctgtctcagcctcccaaacagctgggactacaagcatgaatcactatgcctggccaacctactctatcttttgagtttcatacttcatccctggataacccggtcaataaaataaaatagtgagtgggttccccaaggaccggccagacggggaagaaaagtttaataagaacagaacgctaggggagcctgaaggagctcaggcatttcctggaatacccaacagagtaaccctgccagcctgaaagcaaccgagacttagagggaaaggacataatcaggtttataaagatcccaatgtttaacccaggaaaaataagatgttcccccagtgccggggtagaagacatctgcagatcagacacagggaccaggactccaagttgggaacacttcccaaaaagcatcagtaggcctggcgcagtggctcatgcctgtaatcccagcactttgggaagctgaggcaggtagatcacctgaggtcaggagttcaagactagcctggccaacatggtgaaaccctgtctctactaacaatacaaaaattagccaggtgtgttggcgggcgcctgcaatccccgctatttgggaggctgatgcaggagaatcgcttaaactcaggaagcggaggttgcagtgagctgagatcgtgccattgtactccagcctggatgacagagcgagactctgcctcaaaaaaaaaaaaaaaaaaaaaaaaaaagcattagtaaatatttctggaatcctctaggaaaagaatgaagcaggattcacatggaatgaagacagaaaaagcataagctatctcctgcaggtggagaaagaaacagaagttagcaatgctaagactatcttctttattaaagttaccaaaaataggccaggcgcggtggctcacgcctgtaatcccagcactttgggaagccgaggcaggtggatcactcgagtccagcagttcacgaccagcctgggcaatatggtgaaaccccgtctctacaaaaaatacaaaaactagctgcgcgtggtggtgcacgcctacaattccagctactcaggaggctgaggtgggagaatcgctgagcctgagaggtggaggtcgcagtgagtcaaggtaccgccactgcactccagcttgggtaacagagcaagaccctgactcaaaaacaaaaagaagtgatgggagggaaggcaacctcccacggtgcaccacctcctggtcttgacagtcgactcacaaaccatcacttgtttataaacgcgtttccgatctgccatcgtaattccattttagtcatgcatcccgagatcattcaaaccacacccaagagagactggacgacagcactcactagggtgctatttataaccatacaatgcaggaggctagctgcgtgtcgatctgggggacagtttaataaactgccacacaacacagctgagctccacacagccacatgaggatggggacagccattccttgggtttctgaataacgtatcaagtgagcagtgaatttcaatcaagcttgtacatcaggaccgtcttgccaaaacaacagttgcttttggctgctggaagctgtagcttttcaaaacgttcacacatttcaatgtatcgtcgatgtttttaaatagacttacagggagggtggcacacagcaaaggcccgcaggccctcgtagcaccgcagtccaggtaggatgctgggcggcggggggtggtggagggggttctatttacagtgtctgggctttgactccactaactgttggttttgttttctttcttaaaccttttccttcaagtctggaagcctgtggagggcctgtcaccttaaaggcaaggattccttgtttgcaccaggcagacaaatgtcaaaccacgaccccaggggctgcactaggcgtcgggcccagaagcccccggccatccagccccgactctttcatgcctctgcccctgatgaggggacccagggtaccctcaaggggacacagaagggaggctgcatcctagtccagtgtcaaagtgaggggggcgctgcaggagcctggacaggaccacctagcccagccagggacaggagggtgagaccacctggaacaaaggcacagaggctggagagaaggcggcatgttcccagactgcatgggctcggggtagggggatgcgaggtcagaactggcatagtggccaggatctcgggctctactccatgggcaggggggaagcccctggggctgcatggggccatgggggaggcgggcgcaggagacaccggctgctgtgccaaaggccccagtccagctgctcctctgccagcagaaggcagaggacaaggggctggcccaggtggcctcgtgggacggggggaaaggagggaccagcaaacccttcttgggatggctgaggacacaggggactccagcagaaagggaggcccctgggtgtgcaagacgggacgctgaccagcctgggccctcaccggccactacccccaccaccacccccacccccacccccaccctggcccccggtgtctggcgctcctgacatcatgaggaacaggacgacgggaatgatgtacatccactgcagccggacggaaggatggacagacagacacagaaagagagagagaggggaaggaggtgagtgtgggcatcacccacccacggtggggaccggcatgaggggaggtcgcgtaaggggagggcgcccaggtcccctacgtcactacaggtcagggagggccagtggggcgcagggaggggcaggggtctcggtcctcactcaggcctcctgtggcggtggcgcgggccctggcgcagcaggacgcagggctgtgagcaacacggccccccccaggatgatgtgccactggggagggagggagcgcaggtcagggccagtgggctgccgtggggcctgagggccagcagggagtgggagggcgctcgagtgggcagcagggcagggcccagcaggcaagggctcagcctctgggcctcagttccctgcagcacaactgttggactatccaggcggagcgggtgaggccctcaggcagggcactcagcacagcagggctcagccatcccagcctcagcatcctcctagcctgcctcgggccacacagacctcttcgctggccttggcctgcctgggctcctgtgccacaacctaacaccagtctccacactcaatggaccagaggcctgggtggaagccacctcctccggctgtccccagcctccccaccccacgcctcagcctctaagcccccgggactcagacctgctgctggcagcacaggcccctccctcctcagctccaggaggcctcccaggcaccctgctgcccccaatgcccctccctgggccacatccctcccggacccactcctctctccttcctgtacaaccccctgaagaacctgctcgcccctcctttccaagcctccctggttcctttgaaacctccactgttcccttcctctccagcctcatggctccaacctagctcaggccgagacctcccccaggaccctgcgccctagagctggcccgacctcccctgaccacacttccataccctcttcctgcaaacaagcctcagcccaggtaccaggacacacaggaggcccggaggacaaggagcaggcccgagcaccataggggagtctgggtgggagcatggagggcctggccaggcaccgggactgtcaggaagggaataggggaggcgggggagccccactcacgtatttggcgaagaaggacttctgctcctgggggttcttggccttctgggcctgttccatctccaggcgctcaatgaaggccgccgtctcagggctggggcaaggggagaggaggagaagggtgaggcccggagtccagggacctggagaccctgaggccgccaggaagggccggggcaggtggcaagagcgccgcgaaggcagcagaggctcaccctggggctgtggtgggcggctgcagctgcaccgaggtgttgaacagctccaggtccacgtcctccacctcatggccccggcagcccccggggtgcgtcaccaccgacacgcccaccacgttgccggccacatccacgtgcagggtcagctggtccgacaggtgcgactccaccagggagcactgtggggggagtggggtcagtggaggtggggagcctgctgcctgggctccaccctaacctcccccggcccccaccacaggacccccggagcatttttcaaaaccttcccatggctccctgttaccctcaggcccaagttca

SEQ ID NO: 5753 - DNA, 3080 bp, Homo sapiens
gggggtggccttgcttacccagctgtgcggaacaggcttggttgggagtgcctggcctcaccctttgtggggaaaccagattctctgggcagcagtggtaaatggtgtctgagtctgtgtttcgttggatgtgtctgaggtccgctgctgccagctgggttatgctgtctccaaagctatctgcagtgggggaggccctgagcctgggcaggggagggtacagaggcctcaacccatgggacctgggggtgatctgaactctgcacttcactttttttcaggatttcccccgccccaccctaaaggaggaggaaatagagtctgtcccaccctaagccccagtccctctccccaggtctctttggcatctcccagctgggctggggctgaaggcccttctctggggttggccacagtgaggccaggatctggctgggcaggtggcagtgttccgcctgtgggctgggtgcggaggcgggcctgggggtcttagagagagagcggcggatgtgactgcgggccaggaggaagcctggtcccaggatgtcaccatttcccctgcagtgagcaagcatctctagggctcggagataagtgctgggtggggtagctccagctctccagcgcttttttctgtctggttcctgccatctggacttgagccatgaggaaggccagagtgggtctgacagtccccactcctttccccgctgagccccaaggaaggggctgggcctttgcacccccaccccaacttctgcacgagttggaggcagttgatctcaatggtggaaagtggctggtgcaaagtcatgcttccatactccatgtttaggcttcatgggtgtcaaagctgggccgtgaccttgtcccattccctcagagaagggaactgaggccagagggtggagctgctctcaggccgctgcccaggcctcttgtgctctgcggttcagatggcactcccgatgccaggctcctgcccaggaagacatgcccacccgccctggccctgtctctgctgtctggtgtcaggccacctctcttcgggacccccccccaactgattgccctggggctgaccaggctctcctctccctcagtgttgggttttgggagcctctctcatcaggaggttggcacagatgccagccatgcagcggatcctgggcaggggtctcagctgggatggcctggccttgggacagggaggctggctgggcagaaccctagaaccaaaagcggtgcctgtggtgggctagggagctaggtggggagtctagtggggagtctagtggggaggtccactagacactcgttctggcacagcatgcagcgtcctccatcctggccctgctgtgggtacggagccagcagggcaggagctctcagtggagccctccaaagagggctgcttcctggaccagctgcaggatgagggagaccccttctgtccagggctgacataggctgaccaccgccagccccaccctctcactagcttcccattcagttagccattgatgagggctcactgggtgcaggatcctgggctgcccggggttgggtaggggactcctacatgtaggtaaatccgcgagatgctggagagagcaggcaataaagtggttgattctctctggaggtgacattttactttcctagtagggcttggccaggcaggcaaggtggagcctggtgtgccaggcgcagcgcttcagatgagaggaggtgagagcttggggatggcacagggaagtgttttgtctggtgagggtgtggcagggagggcaggcctgaagggacctccagggaggtgtgatcagatctgggttccagaaagatcctacctgcttggcgaccttaactgagctggagtctggaggccccacccttgcacccagctgcttccactgcttgcctcccatcccccagtgccagttccccagggcagtgccctccccatgccctcttggtgtaccctggtcccaaaggaggccaagctatgaacttttcttgcagaggtcccaggtgaggctgttgtcctggagctgtccccagagcaggcttaggatgaggggacctagccacagcttcaaccgagtggggtcccggtgtggctgccagggctccttggcaccaacccagcccagtgggttgatctctgaggacctcgtcatactcagccgggcagtctgccctggggggtggggtcaggactccccagcacttcgggatggaaggaggcgaagccagcgctgctggactagccttaaagaagcgggagacatcctagctccgcctcaagatttctcctctgcacccagcattctgctccccaaatgtcccaaatatgcagggggtcaaggaacattgctcagtggaatcaatggggagcgtgggctactccccagcctctggtttgccccatagcagccccttgggcaccgctggggacccccaggcctctgaggagcttggtttggaaagcgctggaatgctggaccaagttccctctctggctccctgagagggggtcttctagccccagtcttagggcaagaggagcccgtcccctaggagcctccaggccctggagccagacatcgggcgtcctagctacaccctttcctggctatgtgagcttgggcaagttaccaaacccctctgagcctccattcaccatctacagaatggaagagacgctaatgtcaccctggaaggtgttttgaagggtaatgtgtgtaaagggccaaacaaggccccgcacagttaaggacttcttaaaaacaaacaggcggctgggcgcggtggctcacgcctgtaatcccagcactttgggaggccgaggcaggcggatcacgaggtcaggggatcgagaccatcctggctaacatggtgaaaccccgtctctactaaaagtataaaaaattagccgggtgtggtggcgggcgtctgtagtcccagctcctccggaggctgaggcaggagaatggcgtgaacccgggaggcggtgcttgaagggagctgagatcatgccactgcactccagcctgggctacagagcgagactccatctc

SEQ ID NO: 5754 - DNA, 1529 bp, Homo sapiens
gagaggctcccctcagcacctggccccacggggcccgccaagtggagggtgggagccctggggatcctccctgccccagtgaggtctgttatgcagcatttttgaggtcaataaattacagcaataaatagcaaggtgaggtagggggagggggtcctggtagaaagttaaagtggggtgactgaagccggggcatcctaggaagggggtcctgggcagcctcagttcccaccgctcatgcccacccccaccccggcgtggaatgtcagactgaggctccagttaggtccctccccagccctcactcctggcgtctgattcacaggttcagtaacatctgccccaacggggttctgggaaataggaggaccttggtccctttagggggcatgccagggctgagagcccttgtctgctctaaggcctggcacctttggcttttgtcccccacgcctgggggtggacggatgcagcctcctgctccctgagccctgccctccggctgcccaggcctcaccccaactcaggatggccgcaggagggcagggggtcagcctgcccagcggcccagcccggatcgcactcctgcacagggcctgaggtccagtgaatactgacggattttgggagtgggtgggcggcccggtgcccccgagtggtgatgaacggtaaacacacagggctgcctgaggtggggaaagttggtgagggtccggatcgttcatttcacaggctgaggtgtatggctatgctgcgagtctctgagattcttatttgcttaaaggttcatcttttctcttccttttttttttgcaatcctggaggagcccttgctggggctcggtccggcgggagcatgcagtggcggagcccggcctgccacccgctcactcgccccaagtctgagaaataaatacattcatcactgcacaaacatattgatacaaaaacaacactgttaagagtgtttgcaccgtctatgttggtaaggaccagacccagtcagccccttccgctgcctggggtggggttagggggccccaggagtggggacccaccagagtcgacagagctgcgcaaaggtcccggctttttggcttgagtgggaccctcgcatcaacccatccccaagggtcacgggcagagcagcagggggacccaagcccagactcgggtcctgtggccagaactgacggccatccccgcgtaggctagctggtcaggaccagcatggtccggccagagggccttgggggctggtcagcacgggcccaagctctttggtgccagctgggcttggaggggccctgggaatggggacgagggctcaggtgactccagggaggcttccaatccctcccccagccccagggctacccttctctgcccgtgagccactccagggccaactcagaagggtttccagcagcaggggagggttccctggactggccttacagctgctgaggtctgaaactgtaaaagcttatgtaaacaatgagataaatatattagcatcttttttctga

SEQ ID NO: 5755 - DNA, 822 bp, Homo sapiens
aaaagggggggaaagaaagaaagagaaaaaggagggcgagtggcgagcaggggcctcggccgccacccacacgccccgaagcgtgctcgtcccccgcgcggggctcccggccgccgccctcggccatcggctgctccccggtggcccaggcctcggactccgcggccggcccggcgcggcccagcgccctcaggtgtataccaaggactggaattgatgggccaagctttgtgttttaaggaaaaaaaaatcatgttttagtttcgtgctggtaatttgaagtaagcagatgtctagatataagcttggaaactggccagttggagattgctcacggctgcaattgaagactccagcagcctcttctcctctttgcttccatttggagaggaaggcgtcataggctgtgtgacttccgtggacgcggggcttggcaccggcttgcagttgggatcaatcttcagtggcggtttggagtgggtcacggttcttcctgcttgccttccagtttagtccctgacgtctgctccccagggccctggctcttcccccacgccttcagcctgcacagtcccttctctcattctcaggctgcagaacctggaagtacagttgtccccccttacccgctgtttcagttacctgaggtcaaccgtggtctgaaaatactacatggaaaattccggaaataaacaattcgtaagttttaaattgcacgctgtgatgaaatctcgcgctgtgcagcctgggcagtgaatcgtcccctttgttcagcgtccccacgctgtggacgctccacacccatagtcacttagtagctgg

SEQ ID NO: 5756 - DNA, 1017 bp, Homo sapiens
agtgttggcccatacagggatgctagggaggtcttgctgcctctccttccactggctagctggctgcttccagaatagccaccactgatacctgccccagccccagctcttctgggctgagggagctccatttagtctgatttatgtctttccaagagccatggtctcagggccataaggaaagagatccttaccatagacttgtggtctcaaaggcatgcatttaggaaacatgggcttgccagtgacactgtccaccttgaccccaggtactgctgtgggctgcagagatcagggagggtactggactctccctctgccacccaaactcccagccttcttgtctcagatccagggccaacccaccataatccctggcctgagctccaagccctggggagggaaggaagtggctgaccccacggccagcattcctctgtgatgactacagtccgccttctgcccagccatcccagctggaaggcagttctcagggaactacaagggaagcccctcccacaaaagccaaggcatcttctgcagagtggggcttccttcaactggggacatggcaggacctgagtgggctaggggtcctgtgggggagcaggtcagaaggcatatggacctcacagatgcctcgaactcaccctactccttttctcacttagtaaacagtcacaagccccccgtggaggttggtgggttctagatccaggagactagaccagacagtcagggctcactctcaagggctccaagtcatgttcggggaaatcctccaacaaataagcaaaagaggacactacggatatgatctcagtaaggagacctcatcgtataaggacaataagatgggatgtgacagtgaggggacagctggggacctcagtcatttgaggggatatcccaattcctcagatcccacctgcctgcgcacagtcccctctttccccgcgtgcacaccctcaaaccccttagcttgtagaactcctccctcattccctaaaggccacc

SEQ ID NO: 5757 - DNA, 434 bp, Homo sapiens
gattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatc

SEQ ID NO: 5758 - DNA, 3490 bp, Homo sapiens
agagagcctcggctaggtaggggagcggaactctggtgggaggggaggtgcggtacactggggggatgggtggctaggggggccgtctggtggcttgcgggggttgcctttcccgtgggaagtcgggaacataatgtttgttacgttgggagggaaaggggtggctggatgcaggcgggagggaggcccgccctgcggcaaccggagggggagggagaagggagcggaaaatgctcgaaaccggacggagccattgctctcgcagagggaggagcgcttccggctagcctcttgtcgccgattggccgtttctcctcccgccgtgtgtgaaaacacaaatggcgtattctggttggagtaaagctcctgtcagttacgccgtcgggagtacgcagccgcttagcgactctcgcgttgccccctgggtggggcgggtaggtaggtggggtgtagagatgctgggtgtgcgggcgcggccggcctcctgcggcgggaggggagggtcagtgaaatcggctctggcgcgggcgtcctcccaccctccccttccttcgggggagtcggtttacccgccgcctgcttgtcttcgacacctgattggctgtcgaagctgtgggaccgggcccttgctactggctcgagtctcacatgagcgaaaccactgcgcggggcgcgggggtggcggggaggcgggcgttggtacggtcctccccgaggccgagcgccgcagtgtctggccccgcgcccctgcgcaacgtggcaggaagcgcgcgctggaggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctgggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgcttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggttaggcaacatctccctttttcttcctctaaatacctctcatttctgttcttaccagttagtaactgatctcagatgcctgtgtgatagcttccaaattgctgtctctgtctttagtgttatcttttgatccatcttacatcttgttaggatgattgtcctaaaggaagatagagcatgaaaatgacaggtgaaactccattactggcttgtactgtttacagcaagttgtctaacccgcgggccgcatgggacccaggacagctttgaatgcgacccaacacaaattcgtaaactttcttaaagttttaggagttttttttgcggggtgttttttttgttgttgttgtctgttttttttttttgctcatcagctgtcctttatatgtggcccaagacagttcttgcagtgtggcccagggaagccgaaagattggacacccctggtttacaggatgaattctgttctcgtgaatgtgatgcataaggtccctggatagactttcctcaatttaacagctttttcatttttcactattttccacatactacacacacaaatatgacctctctcctgaagtcacatggaatgaattgcagttacccaaatcatagagacgtcatatatctttgtggggtggttctttttggaatgctacccttgctgcttttaatcctgcagattcaaatgtcatctcccctttggtcatgccttccatggtctgttgttctatgacccaaactgcccttttaaaaaagcagttttcttctgactcctgagcagtttgtactgcgtgggtcatagtaattctggggttgttgtcattgctgatttaaattaccttaactattctgagctttttgaaggaatagtgtcttgtactcctgagctcctagtatactctgatgtctagccaactttaagtaaatggagtgagcgacatgtaaatgtctttatggtttgacattttattaatcttgagcattggaaaagtggctggtatgactaaagaactgaatttttattttttatctaatttgaattgcaactgtggacagtatagctgtagccccggacttgttctgtggattacagaatacgtggacattgatggttttctctttttactgagcagtaaggaaataaaagctgaagctctctggcccattacatttcatttaactgcttgttttgttttatttattatatatttagctgaaagctaagtccaacaaaccatttttaaagatgtgcctgccttggacaacagtgaaagcaagcgttaatgagtttggatttcaaaaaaaaatgcataatgaattttagggaggtgagattccattaaactgttacaggagctacatagttaaatatatcagaacttgaatgaagaataggtctgtgtgatacaaatgaacccagcctaaatttctgtcctacaagttttcacttcctggaaacacttgattggaggagctctaagcatcatatcttgagttatagaaaacaatcacaaagtaagttttatcctgaggaattataataccaacatttt

SEQ ID NO: 5759 - DNA, 36713 bp, Homo sapiens
ggcattctttttggctttctcttcacaaccgatgttttctgtaagaacagagacaagtcaatgaacagattcaggaaaaccacacttgcatcaggcaattaaaatctatcctttcttttttttctggagacagagtcttgctctgtcacccaggatggagtgcagcggcgtgatctcagctcattgcaacctccacctcctgggtgcaagcgattctcctgcctcagcttcccaagtagctgggattacaggcgtgcaccactacatccagagactgggactacaggcatggattttcaggtttataacatggcagagtgaattctggcaacacactgagtgatgcttgtcaatggccactatcaggaatttaaaacaagagggagggcctagctctgtcgctcgggctggaatgcagtggtgtgatcatatagctcactacagcctcgaattcctggactcaagcaatcctcttgcctcagcctcccatgtacctgggactacaggtacatgccaccacacccacctaactaaaaaaaaattttttttgtcgagatgtggtgtcactctacaaaacgggttgcccagactggtcttaaacttctggcctcaagagatcttccttacttggcctccccaaaagctgagattacagtcatgagataccatgcccagacaggctttttcttttttttatttttgagacggagtctcgctctgttgcccaggctggagtgcagtggtgtgatctcggctcactgcaacctctgcctcccaggttcaagtgattctcctgcctcagcctcccgagtagctgggattacaggcacccaccaccacgctcggctaatttttatatttttagtagagacagggcttcaccatgttggccagactggtctcgaactcctgaccttgtgatccacccacctcggcctcccaaagtgttgggattacaggcgtgagccaccgcgtccggcccaggctttttcaatcttacattttttctttctgtctcagtcagtattatttatgagcaatgctttgccttgctggtggtactcaggaataaagactgatgaaaacaaaatgccgtgtaagacaaagcagctcatgcttccatatttaccagctagaatctggacctgtggtataatgaaggattttaaatctgcttctggggtaaaagtcaatctgcaagatgtactgaaatttctgggatactctgatggttcatgtagataatgatacggaattatctttggattatcttttgattagcattaaatattaactgttaaattgaatattaaacttaatttcaagaaatgtatggcacacctgcagtgtatgtttctgtagatagccccagaggccccagggtgttgcatggtatggtaatatgattggacaactctgtacttcacaagttgatagaactttcaggcttattccatgtactttcaataatatctttttaactttatcccactgtaatctgtaaagcaacattgccaaccctcttcaagaacaagcagtctgtttacaagccacctgaaaggtcagttagtctggaagaactgagacatggtgcttttccattctcacagggcatgcattccatatcactttcaatcaagtcaacaaataaattaagtgcttattaagtgtatataaacaaaccctacattctaactttcctgggtaacaaaaataaagagaccctcttctcaaaaagcaatacatttataacctatttcttagaccaagatattttagactgtcctttaaaacacccaattttgtctacttattcagaggaagtaaaaaaattccactctagcaaaatagggatttccaaatggaaaaataattgaaatttttttaagtggactattctggtgagtttctgtatttacataaaaaattttagaataatgacctaaaatgctaatatcaacaatataaatttaaataaatgccagggttgacaggaattcttacttgctcctttaaaatttttcaaagtgggtcgggtgctgtggctcacgcctgtaatcccagcactttgggaggccgaggcgggtggatcacaaggtcaggagttcgagaccagcctgaccaacatggtgaaacctcgtctctactaaaaatacaaaaaattagccgggcacagtggtgcgtgcctgtaatcccagctactcaggaggctgaggcaggagaatcgcttgaacctaagaggccgagactactgtgagcagagatcatgccactgcactccagcctgggtgacagagtgagactctgtctcaaaaaaaaaaaaattttttttgaagtaatcttgcatatttggcttttcaacacacacggttagaagtaaaatagtattcagaaaggagtaaaatagcaaattgccaaatagattttcctggcattcagaaaaattcaggtttaggccccagtcccctacaggagcctggcctcataacattttcagcccaaggtcccactaatgaagaaagtgttccctaaccatgaagtgttagtcaggaagcataaggctgggtgacacctgaactatgtaccatttctgccaacacacaacccagcagctactgaatatggaccaagggttctaccttcttcctcctcgtcgtcatcgctggactcactgacatgcacgctgacagcagtgtttggagagtctgtccattcaaaatacaccccaaacccaatgtcataattgtctgtggcaaattcccaaaagagatatgatccttcttcatgggtgggtactcgaacagtgaccacttctcctcggcccactgtaatcacggaatctgcatcctgctgaatcttctctttgaagtctttgatctgaggtcgtgtccacatggatggagctgctattactggaagagattctaaaggcaataggtattaaaaagctaaagaaaaagagccttcaccctgcaggtagccacattttcatagcactacctgatcagttgtactcaggcaccaagtacaatatggtctagcttagatcaaggacttggaggaataaaaaagcctccccatgggagtctctccagattactatgtttaacaatgttgcaggcactcagaggtcatcgtacttcttcaagtaacaatggcagcccacaattttagaaacgaatttttttcaacactccctctatggggattcaagaatgaccttgggaaggccccagctggagtgagggaaatattctagcaaggaagagagattctggctttaggaataaattactcttgtggatgtgaacaaagaaagctggactttgacttcagcctgtctgttgaaaaattcttcacctccaactatcccaaagttctaggggctattctaaaggagctcaaagaaacaaaaactcggacaggattagaaccactagggactgagaaaaaggggtaaagtcttgttactgagcagtacctatgtgcacttgactatgcaataagtttttcaaagttagtcacagagcctttgaaatattttctctcatttgaagatgctagtataatcccttgataagaaaaaaaaagggaagggggcagtaaaccaagggatttcaaagccttttctgaagcaattattacttgttctaaacagacaaggaagatctctgaaaccaaatttcttatgaaccataccaccatccctgaccactgtcactgaaatgctctcctcttcctccttacttagttaactcctcttgcttcagatatctcaggtcaattgtcccttcctctgggaagcctctggtggcctctctgactaggtcacacttccctgttttacattctctcaaagataatgtacctctctctccatcaccgtacttatcacagctacaatctacattttctgtgtgttattttgcctcaccactgtactcctagcactcaggaaaccttcaactaattgctgaatgaacaaatgagctgcccatggaaagctagtagagctttgaaaatgcagttattttctaggcaacatgatacattagtctcaaaaatatatctatttctatggtagccagcctccaagatggtccccagagattctcacctctgggtcttcatgcacttgtgaggtcaccacccacaatatataaggattggtatgtgtgaccaacagaatatggtgggagttccaaagtcaaggcataaaagacactgccacttctgctaggggaagccagtaactgttttgaggaccctcaagaagccctatggagaggcttcatggggccaggaattgagcttccagccaaaagccagccatgtgagggaaccattttggaagcagatcttctagtcctggcatcaacatcttgactgcaatctcatgagggagcctaagtcagagccattcagctaaactgctcctgaaaccctgacccactgaagctgtacaagatagtaataaatgtttattgttatttcaagctactaaatttaggtgtaattaatttttgtttgttttttttttgagagacagtcttgctttgtcacccaggcaggcggaatcatagttcactgcagcctcaaactcttgggctcaagtgatcttcctgcctcagcctcccagagtgctgggattacaggtatgagccactgcgcccagcctgtaatttgttatgcagcaatagataatttatatatatatatatgacaaaacataacttttgtcttaaaagtgtccaaagacatctgatttgctcttctacactggtctatgagtcaccagagcattagattcagactaaaaagagtaaaaaaatgttcaactctcacaaatatgtaattgttctcaaaagctaattataacctgacttcatgacttttgcctttcacagatttggaattatgacatctggacaaacacatatgcaaaacctaccttttggtccattctccagggcttcttctgcagcttctggttccagttctttttcggagctgtcagtgtgtgttttggcctgtccattaactgacatcatattacttggtacagttgcattcacttttgatgatgtaggcaaggaagacccagccactactacttcctgttgtttctgtaatgctgcctacaaaccaagagaaagtgaagacacactgaccaggaaggctagcaaataagacatctgccctggagtacatctgataccatgcttttgccctaccaaagtgctatgctcaagaaattactaataaatttttatcagtttttatcctgtctataatgaatattattagtacaatatcaaactgacagctaaaaataataaaaaatcaataaaaattaatgtggacaaaaacctgcaactaaggctcacatttctgtgatctgagaatcaccataaaaactaaccaggaaaaatgaaagtaaggccagccaaagtggctcacacctgtaatcccagcactttgagaggcggaggtgggtggatcatttgaggtcaggagctcaagaccagcctgaccaacatggtgaaaccccgtctctactaaaaatacaaaattagctgggcatggcagcacacgcctgtaatcccagctacttgggaggctgaggcaggagaatcgcttgaactcgggaggcggaggttgcagtgacctgagatcgtgccattgcattccagcctgagcaacaaaagcgaaactccatctcaaaaaaaaaaaaaaaaagtagaaataatcaacccaaaataaaactattaaaggcaaaaattgaacacagtaatgtgctcttgaaattgatggaagaaaaaaatcttgataaactttaaatacacaaaatttgaattagaaaaattaaacttggtgggaatagtcacagaagaaaattcacaaaggcagaagctataattggcaaaatctggtatgggcccccaaagcaataaaaaaatcaaatatggacaatttattctaacataattgaccccaaaaagtcaataaattaaaacttcagggaaaaattatgatcacaatgaaattgaaaattgttaatcgtgttgtaaaatgctgacctaagaatcaaacagacttacaggatgcaatttgaggttaaaaatattttctcaatgaaaatttgtcactgtttatatagttatgattgaaatgtgtattcataaatataaaatcaaaatgtcctctgagtcaaaatggcagtaaaaacatcttaaatccaaaggactattttgggacattcctcttctaaatcaatatggacagatactacttcaaatatctgagtattacttaggtaactttggtggggaactataaattgaattacaacatacatgtagaaagtgtacaaatgataaattacacagcttgatcaattttcataaatcaaacacatccatgtaactaatactcagatcaagacagtatctgcatccagaatattccctggtacccctttctgggcacctgccctgaagggtaacaactatttgacttataacactatagatttgctttgcctattttaaaactttaaagaaatgggttgtatagtatacattcttttttatgtctggctaccttcactcaacattacttttataagctacatctatagagtcacaagtaattgtattttgttgtttgcattacttttaagttattccatcataaaaagataaaatctatccattctactgttgatgagcatttgggcatgtaagcaatgttttaaactaaaacactgtcacaaataagcaagtacgtatatgttcactgcaggaaaaaaaatacacacacgcacacatacacacacacacggaaaaagcctttatgatcccatggggtagggataatgatatattttggcatatctctacacacatttcattgaatgtatcatttacaagccaattacttaaatgaatagcaatgcttctctttgctgctaatataggttaataacacaattaagattttaagatatcttcttccaaggtctggattttcagtaatttccacatcaattttctagaagggatactagcttccagagaaagtacctaaaatcaaaacaagtcagcacactcagaacattcactgcatgacaggaaagcaaaagagcatttttgatgatcaataggcccagctcaaatggtccctcatctccactaatcctttcttgaaaggctctagcagaaaaacaactttctctgggaacccccgaccatgaatctattgtactacatgtaatagattgtaatgatatatttccatactctcttcctgttattaggaagtttaaaaaagcacagaaaggtataaaagcaacgtatcaaacacccacaaatgtatctacaccccaaaattaacaaatgtgttcattttgctatttatataaaaattaatattttataggagtaaagttccctttgttccttccccagtctctttccttttctcttctcagaagcaaccaataaatttgataaactgagtttgatcactctaatctcaattatggattttttttttttttgagacggagtttctcttttgttgcccaggctggagtgcaatggcacaatcttggctcaccgaaacctccccctcctgggttcaagtgattctcctgcttcagcctcacgagtagctgagattacagatgtgtaccaacatgccaggctaattttgtatttttaatagagatggggtttctccatattggtcaggctgttctcgaactcccaacctcaagtgatccacccacctcagcctcccaaagtgctgggattacaggcatgtgccaccacacctggcctatggctttttttttcctcgagacagggtctcactctgtcacccaggctggaatgtagtggcgccatcacagctcactatagcctcaaactcctgagctcgagtgatcctctcgcctcagcctcccaagtaactgggactacaggcgtgcaccaccatgcccagctaattttttttttcttttttaagagatggggtctccctatgttgcccaggctggtctcaaattcctggcctcaagcaaccattatggccttggcttccccaggtgctgggattaaaggcatgagccactatgcccagcctccattatggctttctagttttgtttcaaagatttgcggttttgtcctatttgactttcttctcattaaatgatagcaacctataaacaggacagagtgtatgtgctattaaaaatcatctcactgcctatcaaagaagcaggaaaatggaagtgaaactaaagtagaaacaggcttcagaggagagagaataaatctctcaaaaataccacttattatcttgaataaactctggtttggcatcttttcctcctcttcaggattacaaaaaacttgcagtgctttttaacttctaactgatgccaaagactcaggagaaaaggttgtttagtaagaatacacattttcaaggaatttaaagagtttggcaaaaacaacaaagattatttcatgcagtaagaaatgctgagcaactataatgtaacacttttcttcactcagattttttgacaggtggtaactgctttataagtgaaaattaagtaagttaaactaagctacgttaagtttaaggaggtattttatgcctgcacaagatgtaaaaaatgaatgtaaaattagtgtcttctacaagtacaaaaatcgttcacagggtaactcttttctcatttgactcctctgatagtcctgtgaggttaacaggacaggtgctttgattttatatcctattgttacggactgaaagaaagagcagaacaatcagagcagtaataacttgtctgagatcaaacaaggtaatgtcaaagcccaaagagaatccaagtgttatgagactcccagtcccatgttctttcacctaaaccaacctctcctatgtggaagcaaaatacttgggggcaggcagttggaggaggaatagcaatgtgctgttatgagcactgcctaactatggtgcctaacacaaagtcaaatggacccaatctagctctgcagaaccagcccatggtcttagggcaggggagtcctcccactggaggctgtccaagcctctgacaatgcactgcctgaaggacatctctgaactatggctagttactcaggtcctcatgttccaggaccactattagggtctatgccagactcacagtaaagacactcaacccatacaactcccaaatacccttatgacaatataacatcatcggttgcttcgataacacatattttctctcacaattgcctgtgcaattctcaagtctgcctaaaagatcacccaaaagttactttacaccttagaggctaactaatgcaaaattcatttgcgactgttaaaaaagaacttgggttccaatgaaactaaaaactctctctaaggctgaattctagggttgtctatcgtacctgttgctgtgcaagctggacttgatacaactgctgcatgtactgctgatagtgttgctcctgcaactggcggatgagaatttgctgctgttcgtagttccctggatactgttgggctgcatactgctggaactgcacggcagtctgggagtttaaagctgccattatctgctgcctaaaaacattaaaaatatatatactagtctggctacaggagattgttcatgacaaaataaaatgtccttattacttacttttacagtctgtaactcttaaaaacaactaagctagtaatgtacaccaattagtatgtgttctgggtccagaagaaagatttaagaaaataagcctggcctctaattttttacttaggattttccaggaaaattcgggatggaagataagcatatgatcatcatcatcatgaccaccatcataattattaacatttattgtgcccttactatgtgccatgcagtgttgaaagtactcacacatactaacccatttagtcctcacaacaaccctctgacagagggttcagtaacttgcccaagactatactgctagcagatgctacagcctgatgcaaatccaggcagtttggctctagagctacactaatttaccacgatgctttaagatgatggattgtcatctctgacatagatgaggtatttaactgttggctatggcttctgtacctaaatacataaaaaacagtaagaggcagaagaatagctggaagatgttacaggtggccctggtaagtataaataaagccagtgaaaaattaagggtccacagcatttaatttaaagcctgtcttaatagaggaaatactgaaaatatcttggcatgcttagtttagagatactcatattcttttatagataaaccacatgcttcttcttttttttttttttgagacggagtttcactctgtcacccatgctggagtgcagtggcgtgatctcagctcactgcaacctccacttcctaggttcaagcgattctcctgcctcagcctcccaagtagctgggattacaggcacctgctaccacgcctggctaatctttatatttttagtaaagacggtttcaccatgttggccaggctcgtttcaaacccctgacctcaatcaagtgatccgcccgcctcggcctcccaaagtgctgggattacaggcatgagccaccacagccagcaaccacatgcttcttaacttacttatgtgaccaacttaacagagacctcaaagccatctattaatagataacaaagcaaagcctcacaaactcctacatacagcacaacattcgatccacctaggacaacctcccccaaaaaagagctgcattcatagtctttctccaaagttgaatgagggcctggattagtttgaggctagcactaaacctttttctgaggaactacccagaaataatgagaagaaatcaatggactctcatgttctctggtttaacctacaagccatgccacccctacaaactcagacttacttcccagtgttttatgggtgttaatcactgcctccttgtacccacagctccctcttgaagaacctgtcagtctctgagtctcaaagcccttactgagtaagcaatagttgaagcctccaaatcttgtactaaggactataaatggatatctgacatagactggaccaacaagattctctgtcctgggaaactgcaactgggtctcacagattccagccagtctctgtcagatgcatggaaacatagaccaaataaatcctcggacagccttgcatatgccaaagcagacagttgacaatttgcagagagcaaggatgaagcagagacataagctgagagaagcagagacaagaaacagagagcgcaaccaagcaacctcagctcctgcttccaatctctgggttctgcaagtgaacccccaaaccttctaatacattcctttttttttttgagacggagtttcactcattacccaggctggagtgcaatggcgcgatctcggctcactgcaacctccacctcctgggttcaagagattctcctgcctcagcctcctgagtaggtgggattacaggcatatgccactgcgcccagctaattttttgtatttttaatagaaacagggtttcactgtgttagccaggatagtctccatctcccaacctcaggtgatctcccaacctcaggtgatctgcccgcctccgcctcccaaagtgctgggattacaggcgtgaaccaccacacctggcccgctcatttcttatttttattctattttttttccatttctcattttaaaacataagccacataataaacttacttttgctgctccaaccgaagcctttcttcttctatccgtctcctttcctcttcctcccgtcgaagcctttcctcttcttctctcctacgtttctcttcctccttttgcagacgttctctttcttcctcttcacgccgccttcgctcctcttcctccttcctacaaggcaaagatagagaatgaaccctatacgttgaatcctgtttaaaaataaaactttagctcccagggaaaactgacatgacctttttagagaacaatgtggatatatacatcaaaatttaaaatacatacactttactagcagaaacttatagggaatcaatcgcacaatatacaaatcacatcaagaataattattgttgcacagcaacagaaatgtgtccatcataagaaactacttaagtcattatgatattcctataccctgaaggatcccctctaatatatgctcacagcactaaaagcttttccttcataatacctgctgtcattataattaaatttgtgtgatacattcagcaatagatctgcattacccattaaactagatgctccataggggaagagactgcctatctcacaccacgacatcctcagggcttagcacagtgctggaaagaacaagcactcgacaaacgtgtacagaagtaaaaaatccaccctgaaatatcgcagagccaaaggatagaaatacattgcctaatatgtaaagacatgtaatacacttgcttaatgaaaaaaaaaaaggtgaatacaaaggaaaagatctggaaggacataccctaaatttatcagttattatctatgcagaggagagtggaattaaaagaaatgtgggaaaaaagatttttttcagtttgtgtttcatatactgccataaatgaaaattttatattgcatatatttgtgtattatttctgaaattaaaattttttgtaaagcttttaatttaaaaaagaacggttaacctctcagggcagcccttgcccagctttcacccaccccacaagacccttccaaaaagaacagatcctattgtgctaggaatggacatcttccgggtctgagagtggtatggtgttcagggagcctgcagacaggatgaaagggaagatttctaaggagtatcagataagacactatttcataaacctaccacgagaattgtctgggctacctcacctttctcccctctaactcctataagtgattaacaactacctgagccacagccaagtctcaaaatattgtaataacatgacctattttttttttttttttgagacagggtctcactctgtcacccagactggagtgcagtggcacattcttggctcactgcaacctccgcctcccaggctcaaatgatcctcccaccttagcctcctgagtagctggaattacagggacctgtaaccacatccggctaatttttgtattttttttttgtagagatggggttttgccacgttgcccaggctggtcctgaactcttggactcaagtgatctgcccgcctcgttctccccaagtgctgagattacagatgtgagccaccacaggcgtgagccactgcacccggccatgacctacttttaatgtgtcacagctggtacagagcaagaaggttcacaagccagagcttaagcttcaggatagatgaagtctactcttaaacactttaaaataattctatgtggactttatcccatgacaaaagtatatttttaaaacgaaaacgcagctctatatgttgagtagtaacttttgacaatgcttaagagaaatatgcatatatatcattaaaataagaacttaaaaagcaatatatagatacttctacagacaccctagcgatacctgattgatccaacatcactacacaatggactgtaggacataaatcaattttccagttaaagaaatctcattcttttctcataagaatcaaaacctttcctttagattaaaaaaaaaaatttctttggataaatatcttctgaaaatgtaatcaagcaatttcctattatcttaaataggaataaatcatatctaatgttccatctcttgataactcaggggttacagctgtaaacataaaaattgtacatcatactattgtaatggagaagtttaccttcatattaaatgacccctgactgccatgcttttataattctcgtgtctatttttcatgctttctattatgtccctaattatcaagctattttctcttctaatctgttatttctaatccaggttaaggtaggaaaccagagaatcaattgtttttaaagaataacatcggctgggcaaggtggctcatgcctgtaatcccagcactttgggaggaccaggcgggtggatcacctgaggtcaggagtttgagaccagcctggccaacatagtaaaacctcatctctactaaaaacacaaaaattagctgggttggtggcaggcacctgtaatccctctcccagctactcgggaggctgaggcaggagaactgcttgaacccaggaggcagaggattgtgtcactgcactccggcctgagcaatagcaacagagcaagactccatcttaaaaaaaaaaaaaaaaaaaaaaaaaaagtataacataacctgaagaaaaattggttttgtagcatcattttcatcacctaaaattttagatagtcaaaattgatgaaaatatagccactagaaaaataaggtgtaactataattctaattcacaactacaacagagaatcccataagcataaacagcacattcagtagctcctcctccaaaacttgaaaataatcaataagccagctggaagccaaagccaacatgaatgtctatataaggtagcatagttgcaaaccatgaaatggagcatgaggattctagaagctcgagggagactgcaacaaagggtatgtcagaccagaggatagggaggagggagtggttgagtttatggtggggcttattcagaaacttagtgtaataaaacaaaaggaaggctgccatgatggatgggaggttccttttaaaggcacggccagtaggaagcagtcctccctccccccaaaacttataatacaagtacctgttcacatcaggaagtttgaacaattgccacaagaaatggggatccaaggaaagcaagacacctgatctagaactagaacagacactctacaaaacaaaagcatcagtacactgggctgcgcagcaataaagtattccatgccctcaaacttcacctttttttttcttgctcttccttctctattttgtgggacgcaacatatgttgaaaagagatggcaacacctatttaagagcttgacaaactccaccatggcatcctctttagacatgtttcccagggctgcccattctctcctgtaaggaataacaagaaaagttacctccccttcttagtagaatgagaacttttaaatttaaacctaaatatgaataattctcaattgtaagtaaaatgaatgattctattgggagcaaaaggctcaaaacttcaagttttaacaagtatgtattgatttactaaattagatacgccacatacaatccaaacaactgcattgctgatgattcccatatagcaaaagagtatcaatttttcttttttctttttttttttgagataggatctcactctgttgcccagactggagtgcactggtgcgatcttggctcagcagaacctctgcctcccaggctcaagcgattctcctgcttcagcctcccgagtaggtaggattacaggcatgtgccactaccgccggctaattttttaatttttagtagagatggggttttactatgttggccaggctggtcttgaactcctgacctcaaatgatctacccacctcggcctcccaaagtgccgggattacaggcatgaactgccgcacctggcctatttttcttatataatatttgagccttaattaaacaaaaatactcaatgtattctttttttgtcacaattttttttatgcctcaataagggaatcaattactatatattttaaatggctacttttaatattatttgggaagaatcaaatgaagctctacttgtcttatgttcataagcagatgaatacagttcttccacaatatttaaccataaacatctctaagctaaaaacagataaatatctgaagactccagaagctgcaagcaaaaatgttcagttcttatcctaagctaatgaaccagctacttacaccttaaccaatacacattgtaccctttgccaacattatcctcattaaattcactatacagaaaaacactgttacctcctgtcattccccaacacatcaaagaatccaacctcaggacaagtgtctggattatatgggcccataagaacttgcttatgcagtgccacaagcttcaatttttcttcataagttggatgaaatgctttgccatctttttctataagaaaaagaaacacaaagaaaacaattagcacaggcaaaatacataattttcagcattatatactaaagctttgctacaaagcatgtcacaaactgcctgtaatagacacaaacactaatagtgaaatttttatttcaattactacttttaaaaaatttttttatttttagacagagtctcactctgttgcccaggctggagtgcaatggtgtgatgaaggctcactgaagccttgacctccgggactcaaatgaccctcccacctcagccccccaagtagctggactacacgtgcgtgccaccaaacctgtcttttggcagagacagggctgcccaggctggtctcgaacttttgggctcaagcaagcctctcgtcttggcctccttttcaaaactgctgggatttgagccagcatgcccagcccaattactacattttattaataacagaacctaagacggaaatccggtatgctgatttttttttttttttttttgagacaaggtctcgctctattgcccaggctggaatgcagtggcacaatcacagctcactgcagcctcaacctgctgagcttaagtgatcctcccacctcagtcacccaactacctgggactacaggagtatgcgccatcatacgtggaaaatgtttttatttttgtagagacaaggtctcactatgttgcccaggctggtctcggactcctgagctcaagtgattctcccgtctcagtatcccaaagtgctggcattacaagtgtggaccaccatgcctaccctgaattaggttgtaaaaataagccaactatcaatacttatgctaaagctactacagaaaaacccatctgtcaagctgcagtcaggctacagccttgacctcccaggcttaagcaatccttctgcctcagcctcccgagaagctgggactacaggcatgtgccaccacatctggttaattttttactttttgcagagacgatgtcttacaatgttgcccagactggtcttgaaccctgggttcaagcaatcctcctgcctcagcctcccaaagtgctgggattacaggtgtgagccaccatgcccagcccaacaatcggtttttaaaatagcttttaaaaataatttttagccaaaagagaaaagaaaaacttaaaataattttacattagtcccttttaacatgatcatgcatagaagattatgtacactttgaaaggctgtattcaaaaatgtatccatcccactaaggtagtataatgtggtggaaaaggctttggaattggatggcctgggtttaaatctcagctgagacacttcctagctatgtgactatttaacctctcagtttattcatcaataaagaaagggttacccttcagaggttgctacttcagaggtaataggattattattattactaacttattaatgcttttctttccttcacctgattggctctggtaggtttccatataggcaattaagagtgcgaccagtttgaccaataaagactaactgctaccaacatttaaaagccgtatgaaattgggttctggtaaaatgggaaatattcagagaacagttccacttctttgataaatggtagcactaactactggttgattccaatgacaacagactaccaaatttaaagaaaacggggagggcacttgaaagtagcatatgctacttatatgtctcattcatgtatatagtggtgaaataaaatcactaataagtgagaagaatatgggttaaagaacagcaggaaactcagagaagaaaaaatatagaagctgccaataaacatccaaaaagatattcaaccccactagtcaagaaatataaattaaaagcattagataccaagacccccacctcccatcagataaacaaaaaagttagataacatctaaagttattaagatcctacaaacaggtacccattctcatatatgaatgctgaaagtataaactgttatagttaccttgaaggtcaatttggcaatacacaatagtccttatcttatcccccagtggatgtttaagactgcagataatattgaaccctacatatattatgtttttcctaaatgtacatacctgtaatttataaattagatacaataagagattaacaataaaatactgtattatatttgtatattgtaattatataacaatatacaacaacaagttatgtgaatgtgggatctctgtctctctcaaaatatctgaatgtattctactcacctattttcagaccttgattaaccccgggtatctgaaagaagggaaagcaaaaccatggacaaggagagactcctgtatttcaaaactataaatgtgtatgccctatgatccagtcattccagttctcattacatatgcttgacaagcactctcaaatatataaaaggaggcagatacaaggacattcattgcagcactattttcttgttactggaaataacttaaaaggttatcaataagggaaagtcgaaacaacatggtacagtcatgctctgcataatggcatttcagtaaaggacagattgtttatatgagtgtagtcccataagattattataatggagctgaaattttcctatggcctagtggtgtggtagccaccataacatgatgcaacatataactcaagtatttacgatgatgctggcgttaaactaacctactgtgctgccagctgtataaaagtatatatagcacatacaacacataatacttgatgacattaatcatcaaatacttgataaggatattaatcaccaaaagttttcttacactacgtcacaggtaattattagagaaacacagcccagaacaacttccttctcactttttatttgagacggagtctcgctctgttgcccaggctggagtgcagtgagtggcacaatctcgactcactgcagcttccgtctcttgggttcaagtgattctcctgcctcagcctcccaagtagctaggactacaggtgtgcgccaccatacccggctagtttttatatttttagcagagatggggtttcaccatgttagccaggctggtctccaacttctgacctcaggtgatccacccatctcagcctcccaaagtattgagattacaggcgtgagccactgtgcccacccccttctcgcttttaacaaatggcgataatttgaaaaatagctccagctcctgatcttagccttgtgatttagagagtttttttttatttttattttttttctcgagacagagtctcgctctgtcacccaggctggagtgccgtggtgcgatctcggctcactgcaagctctgcctcccgggttcacgccattctcctgcctcagcctcccgagtagctgggactacaagcgcccgccaccatgctcggctaattttttttgtatttttagtagagacggggtttcactgtgttagccaggatggtctcgatctcctgacctcgtgatctgcccgcctcggcctcccaaagtgctgggattacaggcatgagccaccgcgcctggactgcctggctattttttttttttttttttttttttgggatttttagtagagatggggtttcactgctttagccaggatggtctcgatctcctgacctcgtgatcggcctgcctcggcctcccaaagtgctagcattacaggcgtgagccgagtttttgttttttaaaacaaaaaaaaaaaagggcattaagcagccgggcacagtggctcacacctgtaatcccagcactttgggaggccaaggcagatggatcacctgaggtcaagagttcgagatcagtctggccaacatggcaaaaccctctctctactaaaaatacaaaaactagctgggtgtggtggtacagcacatctgtaatcccagctactcagggagctgaggcaggagaatcgcttgaacgagatggaggttgcagcgagcctaaatcataccactgcactccagcctaagaaacagagcgagattccatctcaaaaaaaaaaaaaaaaaaaagacattaacctgtgtcattttatcttgagcctataaaagaacatatgctgccaatgattcaagaaaaaaagatgtggtgggcctgagactgagagtgcatttttcctttcctttttttttttggtttttttttttgagacggagtctcactctgtcacccaggctggagtgcagtggcatgatctcggttcactgcaagctctgcctcctgggttcacgccattctcctgcctcagcctcccgagtagctgggactgcaggcgcccgccaccacgcccagctaattttttgaattttttttttttttttttttttagtagagacggggtttcaccatgttacccaggatgatctcgatctcctgacctcgtgatctgcccacctgggcctcccaaagtgctgagattacagacgtgagccaccgtgctcggcctttctttttttaagaataaactcaattaagtagttttatctaaataaatgtcagtaaagataaaatcacatggaaactattcacctgaagacaacttttctgattagtcatgcaaaacagcaatttcgaacatacacacacacaaaatttttttttgctgcaggaagatgatttgaactaatagatggggcaagtggatatgaaaaaaattttttgaaatccctgactattgctataaagttatctgtaaaatactgctatttgggttttctactaatggagggagggttcatttcctaccagatgatacgtttgcttctttttgagacaggttctcactctgtcacccaggctggagggcagtggcacgatcacagctcactgcagccttgaactcctgggctcaagggattctcccacctcagcctcctgagtagctggaactactggtgagtgccactatgcccagttaatttttgtgtttttgtagacagagggttttgccatgttacccaggttggtctcgagctcctggcttcaagtaatcaatcgccctaggcttccaaagtgctgggattatagacacgagccaccatgcctggccaacttgtctctttatttcaagcatttgataatgtgaactaggcgcagggtctttgagggatggtaagtaaacaattttttttttttctgagacagactctcgctctgtcacccaggctggagtgtggtggcacaatctcggctcactgcaacctccatctccctggttcaagggattctcctgcctcagcctcccaagtagctggaattacaggcatgcaccaccacgcctggctactttttgtactttttagtagggacgaggttttaccatgttggccaggctggtctcgaactcctgatctcaggtgatccacccaccttggcctcccaaaatgctgggattacaggtgtgagccactgtgcctggtcgagtttcagtacttttggatgttattttaacgtctgccctttttacacctgacagaattaaaaatacagtgcaaacttaaaaagtatatttatttatttattattttgagatgaagtcttgctctgttacccacgatggagcacagtggcgtgatctcggctcactgcaacttctgcctcccgggctcaagcgattcttgtgcctcagcctcctgagtagctgggactacaggtgtgcgccaccgtgcctggctaatttttgtatttttcacagagatggggtttcaccatgttgggttggccaggctggtcctgaactcctgacctcaggtgatctgcccgcctcagcttcccaaaatgctgggattacagacgtgagccaccgtgcctggccaataaatgtgtttttaaaaagaagaatatgtggccacacacggtggctcatgcctgtaatcccggcactttgggaggctggggcgggtggatcacctgaggtcaggagtttgagatcagcctgactaacatgagaaaccccgtctctaatgaaaatacaaaaattagccaggcatgctggcgcacacctataatcccagctacttgggacgctaaagcaggagagttgcttgaacctgggaggcggaggttgcagtgagccgagatcgtgccactgtactccagcctgggaaacaagagcaaaactccatctcaaaaaaaaaaaaaaagaggaatacattttcagtgctagtcctggtcaggcaaacagattcgctgacctctgtgaacttcagtgcttaagcctacgtttttgttcacaggccctcatcaaaaaacacgcccagcaaatctcacaaaagaaattgactttatgggtcaactactgtgagaatgaacaaaacagtatatccattcttgtgaactgtccttgcattcccatttactcttttatgcacgtactagttttaagaattgctctatcgccagctgcagtggcatgcacctgtagtcccacctacttgggaggctgagacaggaagatcatttgaatccacaagttagaatctagcctgggcaatccattaagattctgactctgaagaaaataaaaataattgctctataatcctttctttaaatcttactactgaatctccaaattaataatttttctagatgagagccaaatttgtctcaaaaaaaaaatcaagaaaacaaacagccaggtgcagtggctcacacctctaatcccaacactttgggaggctgaagggggaggatcacttgagtccaggagtttgagaccaacctgggcaacactgcaagaccccatctctacaaaaaactaaaaaacagctgggtgtggtggcatacagctgggtgcggcggcatgcgcctgaagtccaggcttctctggaggctcaggattgcttgagcctgaaggtcgaggctccaatagactgtgaaagcaccaccgaactccagcctgggtgacagatgaagaccctgtctaaacaacaaacaaacaaacaaacaaacccagctgggcctggtggctcatgcctataatcctggcactttggaaagctagggcaggtggattgcttgagcccaggagtttgagaccagcctgcgaaacaaagtgaaatcctgtctccacacacatacaaaaaaccaaaatttagctgggcatggtggcgtgtaccacagtcccagctactagggtggccaagatgagaggatcccttgatcttgggcattgagactgtggtgagccatgatggtgccactgcactccagcctgagtgacagagtgagaccctgtctcaaaacgaaacaaaattcaaaatgttaatactaataattatttttgaaagactgtattacaaattaattttattttatttattcattttttatttccccaaattttcagtaagcatatgtactttgtaatcaaacacacatacacattatcttttttaacacacatttttaaagtcgaagcaatgtattttcagcctttgggatgaggttaagagattattctcccaaggaatatacaaaacccaggaggctgtgctaaccccaaccactttcggtatagcacagttcacacagtactgaagttctaagcttcagaaaaaaaacacagaaaaataaaaatccttcacaatctatattgctatgcagactattagtattacacaaaaggttacagctctcttactcttcaggtggctctggttgacacatcacaagagtttagtattttaaatcaggtgagaataattttcttctttttttttcttttctttttttttttttttttttttgagacagagtctcactctgttgcccaggctggagtgcagtgggatgatctcgactcactgcaacttccacctcccaggttcaagtgattctcctgcctcagcctccccagtagctgggattacagaagtgtgcactaccacacctagctaatttttttatttttagtacagaaggggtttcaccatgttgaccgggctagtctcaaaactcctgacatcaggtaatccgcctgcctcagagccccgaagacctgggattacagtgtgagccaccgcacccaaccaagaataattttcttctaaattatttctggtaccataaacgttaaatgtagttagcaggaaaataataagtaccactaactgcacagacacaaaaagccttgtagaaactcaaaaatctttaaccagggccctattcctaaaggaaagttctatttcagtcctcccagaagggaacacaagcatcatcctcggctcttgcactcattaattattaatattacaaagttatttaattcaatcaattttggaattctgctttctatggcaaacaaaaccaaacacaaattctgcttggaaaagaaaacatgcagataaacctctaattaaacatgatagattgaacacagacaattacctctgatccttaatgaaaccacactaaaaggaataaggaagccaatttagagaaccctggaaaaagccaggtgtggtggctcacgcctgtaatcccagcactttgggaggccagggcaagtggatcacctgaggtcaggagttcgagaccagcctgaccaacatggtgaaacccagtctccactaaaaatgcaaaaattagctgggagtggtggtgcacgccctgtaatcctagctacttgggaggctgaggcaggagaatcgcctgaacccgggaggcagacgttgcagtgagccaagatcgtgccactgtactccagcctgggtgacagagccagactccgtctcaaaaacaaacaaacaaaaaaagaatactgaatgctagaaaacaatgaatgggaaggtgggcacagtggctcaggcctgtaatcccagcactttgggaggccaaggcaggcagatcacctgaggtcaggaccagcctgaccaacatggtgaaaccccatctctactaaaaataaaaaaaaaatagcccggcatggtggcatgcacctgtaatcccagctactcacgaggctgagacaggagaatcgcttgaacctgggaggcggaggttacagtgagccgaaattgccactgtgttccagcctgacaaaagagtgagactccatctcaaaaaaaaaaaaaaaaaaaagaaagaaaaagaaaaaagaaagcaatgaatggaataatgccttcaaaattccggaaggaaattatttccaatctagacttttatgcccaatcaaataaatcaaaagtgacagtaaaacacatttttggaaaggcatggtctcatgcactcttttcacaagaagatattaaggggtgtgcatttccaaagtaatggaataaataaaaacaacaacaaaggaaaataagtgattcagggaaaacaaaatctaaccacaataggaaaagacgaaggtaatttccaggatgacagttgggcagccgacttaactaagtcttaccacaaacactaagactgattcaagaatttaaggacatttaagatagatgtctttataaaaaggtttgcacaagaacaaaaatgtaatcaaagtgtatcatctgtttcagcaatgaataacataaaaacaaacagcagacaacaatttaaccacaaaacaaaattaagagtctgagaagaggaaaggagaaagagagatacagacatacattagaattttttttttttaattaaagcagcagtaggaaaatggaagcaaataccagaagaaacagttaaaataatggaaagcagctgcctctggggagaaggcctaggaaatgggaaaaacaccagaaaacaggatgactatttttcattataaatgttgtagtccaatttcaccttttcaattgctctggtttccatttttaataaaaaggtaaaacgaataaactcatgcacaatttcagtaatcagttcataagctactatgacacaagtggtgggcagaataatggctcctcaaagatgtttaacttctggaacctgtgaatatgttaggttacttgcaaaggcagaattaaggttgcagttggccttttcctgaactactcatgtgggcccaatgtaatcataagggtccttataaatggaagggaagaaagaagagtcagagatctgaagaggctatggtggctctgaagatggaggaaggggcataaacaaaagcttgcggctgggcgtggtggctcacgcctgtaatcccagcactttgggaagccgaggcgggtggatcatgaggtcaggagttcaagaccagcctggccaacatggtgaagccctgtctctactaaaaatacacaaattagctgggcatggtgcacgtgcctgtattcccagctattcggggggctgaggctggagaactgcttgaaccgggactgggaggcagaggttgcagtgactcaagatcgcaccactgcactccagcctgggctacagagcgagactccgtctcaaaaaaaaaaaaaaaaaaaagctttcaggtgctctccagaagaaacaaagccctgctgacaccttgattttaccccaacaggacctatctctaacctacagaacggtaacagtgtgtgtgtggtttttgtttgctttgcttgtggtcatatttattactacaattttttacaccttctttaacaatagttgtgatcctggtggtctttggcaagagggcactcagaaaagcacgatttaacttttggtattatgagtgaatgagaaattattatcataaaaactgtgactatatgaatatgaaaagtaaaatatacatgaagaaaaaaatgcctcaacttttgtgaatactgactcacaatgtcaaataatcagcaaaattataaggctaattataaagtttatctgatccatgactgtcaatgagatattttaatatttcttctcagtaaatttaaaaaaacagtatttgttagtagataaattgttagaaattgtttattaactgctttcgaagaaacatgtccagcaactttgaggaaaaaatgtgcacattatttttaatcacatacaatcaaacataattggtaatgtaccgaagattacattcagccgtgagtaacaggaaacacccacaatattcctgatatgaggaaagtgcttattctcacatcaaagtactgggtgaaaccagtcactgcacaatgcggcagaggaacaaattcccatgtagctgttttttttttttttttttttagacggagtcttgcttttgtcgcttgaaccgggacgggttcaagtggtcccagttgatgctggagtgcagtggtgtgatctcagctcactgcaagctccacctcccaggtttacgccattctcctgcctcagcctcccaagtagctgggactacaggtggccaccaccactcttggctttttttttttttttaagtagagacgggtttcaccgcattagccaggatggtctccatctcctgaactcgtagatccgcctgcctcagcctcccagagtgctgggattacaggtatgagccaccgtgcccagccccacgtagctgtttttgacagtaccattgtagctgtcatcttgaatcaggaacagtcaataccagtatgaacagaggagtttactatacaaatcagatcttctatcaatttaatccatagactaggggagtcagatcatcagaggatattcccaaccatgagagtctgaacaggttgtccggtacacgttagggcttgcaggaaaatcttaagtgcagacggatttttagtatgagttgttttgagccactatttttttttttttttagacagggtcttgctctgtagcccaggctggagtgcagtggcacgatctcactcactgcaacctctgcctcccaggttcatgtgattctcccacctcagcctcctgagtagctggggctacaggtacaagccaccaagcctggctaatttttgtggggttttttttgcagagatggagttttcccatattgcgcaggctggtctggaactcctgagctcagtgatccacctgcctcaacctcccaaagtgctgggattacagacgtgagccactacacccagcccaagccaataaatttgtggtaatttgttacaagagcaataggaaactaacatgatatacaaaacacatttttcaggcaattaaaaacagataatgggatgtacattatgttcttactaaactcacaagtatttaactttacagttcaaataggacagcataatttgataccaagtccaaagctctgaaagattacaattaagtccctcccacctgaaattaagtatacaaaagactattaggggctgggcgcagtggctcacacctgtaatcccagcactttgggaggccaaggtgggcggatcatcaggtcaggagttcgagaccatcctggctaacatggtaaaaccccgtctctactaaaagtacaaaaaaaaaaattagccgggcatggtggcgggcgcctgtagtcccagctactcgggaggctgaggcaggagaatggcgtgaacccgggaggcggagcttgcagtgagccgagattgcgccactgcactccatcctgggcgacagagcaagactccgtctcaaaaaaaaaaaaaaaaaaagactattaggctcacacctcaattgctattttataggagaaatcatattttttctcttctctctggaggcaaaggaaagtaccaaattatttcaatgtcccttctagccttcatttaatgaaagaaggccataaaatctacggcgtggaaaggatgttaaagataggtgattgaattgcaaactaaatctcaaatcctctctacaatatccacccagcaattgctaacctatgcttgaatacttcctggtgataagaactcactgtcccaaagcagtctaatccatctttgaatagctgtgattcttagctctttattctgaggtggtatctctcaactccatccacagggtttatttcctgtcctcagcattaactaaaacacatctaactaattagacctcaagaaagtcacaaaatatgtattgtgtttgccctgagttctctattctcttggctacacattcccagcttagtcaatcatacttcaaatttaaatttaattcccagctctgctattaagtatataacatggacaagttatttaatcttttgaaatctgttttgttatcaataaaataaatactgctccttagggttcatatgagtgttagaaatgtgtcccaaaatctttgtatagtgcctgcacagagcagacactgactaaacagcagccattatgataataatggcagggacttgaattcccactaggtacaagttgctctcttctgaatgagctccattttgtttttaaccctaaaggatgatgcctcaaacaagcagtatccacggcttgtttgaggtgtactccttggtgcagaggagagcaggactatctctctctttccctcatcctagttaccatatttccaccaaagcagcctaagatcaaatctgttttatttcatggccatatcacactgttgcctcacagagaatacactttgattaaaatccatcttttagaaatattaaaactgggccaggcgtggtggttcacgcctgtaatcccagtactttgagaggccgggtgggcagatcacctgatgttgggagtttgggaccagcctgacccaacatggagaaaccccatctctactaaaaatacaaaaattagccgggtgtggtggtgcacacctgtaatcccagctacttgggaggctgaggcaggagaatcgcttgaacccagaaggcagaggttgcagtgagctgagatcgcaccactgcactctagcctgggcaccaagagtgaaactccgtctccaaaaaaaaccaaatattaaaactgaaaaaccaactaggtgcagcagctcacgcctgtaatcccagcactttgggaggccgaggtggatggatcacaaggtcaggagttcaagaccagcctagccaacatagtgaaaccctgtctctactaaaaatacaaagattagctgggtggggtggcacgtgcctgtagtcccagctactcgggaggctgaggcaagagaatagtctgaacctaggaggcggaggttgcagtaagccaagactgggccattccactccagcctgggcaacagagcaagactctgtctcccaaaaaaaaaaaaaaaaaaggataatacaatgcagtattcctaaatcaatgagtaggaaacactctgggaattgcctagcatatactaactgcttagtaaaagttttaagacttcccctccattaactcaaaacatccataatcaattctcagaagtacctccttttcaacaacataagcagccacaaaaataccaatagccaggcattctgctaagagtttatatatataatttcttataattcctaaaacaaccctttgagtacaggaaagcacaaaaagttaacaaaattaagtggcagagcaaggaaaacacaccctaaagagtgttgactccagagcttacctttctaaatactgattcacagtagctcttgtattagttaactgataaaacatctgctcctgggcattggctacactgtccactttctgaaaactcatcaagctacacacttagtatttgtgtactttagtgcactgcatgtgtgataaagggaagcctcgggaaaatgttaaaatcacttacattaaaaacatatacacactgggcacagtggctcacgcctgtaattctagcactttgggaggccaaggcaggtggattacctgaggtcaggagctcgagaccagcctgactaacatggtgaaaccctgtctgtactaaaaatacaaaaattagctgggcgtagtggcatgtgcctgtaatcccagctactcgggaggctgaggcaggagaattgcttgaacccaggaggcagaggctgcagtgagctgagatcgcgccattgcactccagcctcggtgacagaatgagactccatctcaaaaaaaaaaaaaaaaacaatgacaacaacaacacatacacattcctgaatccagtcaaaggaaagttttggttcagctcaaatttaacatgaacttggtggctataattgtttttctgtcttacatctgtctctcttaggtctatatatcctcctacagtattacatacttatgtctaaaggtaaagataataaaagggaaaaagaactctaatagatgttccatagtaacaaacttgaaattatctgaggatagaccactgaagtccaggaggcacactaattatatatgtttccaatgaataaattacagctgtacagtattttaaaacattaaggaagccatttataaatgctcttgtagttgcctatgtttaaagaagacaagaggaaatggaaccatttcagttgtccatttgtttgctatcattaatataattctctcccaacatataatactctactatcagtaacacaattgggtataatcaatagcaatgctagtagaactattccataaagaaaatgagtccaagacttaccttccaaataactgaggggcctgaggcaggatccttaactcagaaatgggattaatacccttacagaaggcctcttggaggattaaacaaaataatgtacatacagtttttggcatagtacctgagatttagtaaacatctactcaataactattgacaattattactctgaaatcttaaattaatgtaaacaatctaccagcttaatgtaatacagtaataaagtattagagaaggaaaagtccaccccaaagaactctaaaaaccaaaatacaattccccaggtcaactccatccaagaagtataaaggtcataataaaatgaacccactggattcctgtgggtccttaacccatggagataagaaaacctagcttaacattgttaaaatagaactgggcaactctggccgggcgtggtagctcatgcctgtaatcccagcactttgagaggccaaggcgggtgaatcgcttgagctcaggagctaaagaccagctgggcaacaaagcaagacctctgtctctacaaaaaatacaaaaattagccgggcatggtggctcgtgcctgtggtcccagtcacacaggaggatgaggtgggaggatggcttgagcctgggaggcatagggggcagtgagccaagatcgcactactgccctctagcctgcataacaaaaccagactgtctaaaaaaaaaaaaagaattgagcaactttgctcctccctttaaaaacctccagtggttcctcatcttctaatttactgacaaaaaggccgaactattaatacttacatggccaggcgcggtggttcacgcctgtaatcccagcgctttggaaggccgaggcggggagatcatttggggtcagtccaagaccagactggccaacatggtgaaaccccatctctattaataatacaaaaattagctgggtgtggtggcacaagcctgtaagctcagctactcacgaggctgaggcaggagaatcacatgaacccaggaggcagaggttgcagggagtggagatcatgccactgcattccagcctgggtgacatagcaagactccgtctcagaaaaaaaaaatgacaatggcatgcaagtccttccaagaattgaactcagttaccttcccagctctctccatcaaactgctttctattttccattttgcaaacagacatgctttgacttctcatggctttcatggctcttggccttcccccctctggaatggcatctgctccctcagtcctccacactgtactgcagttgtcactgggtccttaactcctcttttggactctaagcaaaagataacgtactattcatttatagttgtaacctaatataaaactatccatactgaaaagtcaataatgtctgaaatttagatggtaaaatgctaacttacatttacccacatcttcatctattttacttttactgtcataaaaaattaagaatagttgacgtaattgattcagtcactggcctattaccaccctgacaaggatggaataagaaatagggcttgtcatttccaacccaagctatttgcaatggaaaaatatatccatgctttcaagattcgtatttattccacagtggaagagaaaatgtaatgttctttcctttatttatttatttttttgagatggagtcttgctctgttgcccaggctggagggcagggacgaaatcttggctcactgcaagctccgccttgagggttcaagtgattctcctgcctcagcctcccaagtagctgggactataggcgcctgccaccacgcccagctaatttttttatttttttatttttagtacagatgaggtttcaccgtgttagccagggtggtctcgatctcctgaccttgtgatccacccgcctcggcctcccaaagtgctgggattacaggcaaaagctaccacacccggccgaaaatgtaatgttatttctaattctcgtgagatactggtataaaaccatagaatagcgattaaaagtcccagcaagactgacaaaacaccatgtgttccaccagaaaaatccacacattaaaacaaaggtgccgggcacggtggctcacgcctataatcccaacactttgggaggccaaggtgggcagatcacctgaggtcggcagttcgagaccagcatggagaaaccccgtctctactagaaatacaaaagtacctgggcgtggtggcacatgcctgtaatctcagctactcgggaggcagaggcaggagaatcacttgaaccctcgaggcagaggttgcagtgagctgagatcgcgccattgcactctagcctgagcaacaagaatcaaactctgcctaaaaaaaaaaaaaaaaaaaaaaaccaggctgggcacagtggctcacacctgtaatcccagcactttgggaggctgacgcaggaggatcacgaggtcaggaaatcgagaccatcctggctaacacggtgaaacctcgtctctacgaaaaatacaaaaaattagccgggcgtggtggtgggcacctgtagtcccagctactcgggaggctgaggcaggagaatggagtgaatccgggaggtggagcttgcagtgagccccgagatggcaccactgcactccagcctgggcgacagagtgagactctatctcaaaaacaaaaaacaaaacaaaggcagcattacttggctcactccacattccataattcttctgactgcttttacatccttcccttttgtcagttagtgtctcatatactaacagtctccaatgacacatgcagaaaggtagcttttaattgctacacagctatttctcctttttagtacctggatattgctttgagaacttcatttaggaagtgagtgaaccacacctatcagtgtagctttattctctaaggtgactaacacctaggccccaagttataagtttccccaggattcctaccactcaagacacatgttaaaataatctgttaggttaagaccactgaatcttaaatctgagacatcatattttatagaatccagctccctttatacatatgaaactgattctggaaaagttaattgtctagtttacaaggtaactagaatccagagcttcctgactctccaaacaatgttaagtatactacacgttacagtgttttaatctttttctttgttttgagacagaatttcactttgtcgcccaggatggagtgcagtggcatgatctcggctcactgcaacctctgcctcccatattgaagcgattctttttttttttttagacggagttttgctcgtcgcccaggctggagtacaatggtgccatcttggctcactgcaacctccgcctcccgggttcaagtgattctcctgcctcagcctccctcagtcctgcaacagagcaggactccagctcaaaaaaaaaaaaaaaaaggaattagttcatttctactcttactctctgctacaatatactttactgaaaaataagttccaagaataaaaatttaagatggaatgtagctatatgaattgtacagaaaccacctgatttttatcaagtggtaatatatcatcactacagcaaactctaaattcaagccggtgatctaaaagtcaaatgatccaaaacccattagccattaccaattccccaagctagttagtacacagagggctcaactcattgtgcaatgaccacgaatatgtcattgaatgtgaaatgatcaaatgttctggaaaatttataaaactttcactagtttgcacaattaaagttattttgagagaaaacaacttccgtgtgtatcattacattgaactactcaactttggctagtaaaatatgtactccaaaaggtactccctctggggaaagtgtcataaatatgctgctctggaatgtacgtggaacctagcaaccacttttaaagttgcatttgctgatgtccctccctgtccattcgccctacaagactaagtatctttaagaatcaaactaacgggctttcatcagtttttcccactgacaaaaatcatgtgattggtctctccaccattcgactaagtgaatcacccaattaaaaaaaaaaaaaaccgcacactacaatcttgctctaagacaagagacatttaacaattaattatgcgaaaagcacagaaggtactgttaggccttactctgagaattcactcttgcacattgcttacaatgtaaaattttaaccacctagaagttactagaacatagtggacatctctcctcaagagtttgacaagccggagaggatgatgagcttaacactttacttcctcctctctgccacatcaatctgccgggggatcaagtcctgttccagtttatggttcccaagaatggctggaaaagctatgtatggaacctcttgacagatttcttccactaagggtaaaaatcggcgggttctgatgtgacaagccatgggaaataggaaaagaaaagcgtcagttaaaaaaataataataataaaaggcaatcccagaatgggatcctttggaagaaagtgggctcattcttccaccagggctcctggaaatcccagaagctaaatcaggtaaaatgtcccggtaacctctgggaggcgggacatgactgctaaaccaaggttgcaggcccgtcaggggtgtgacctagtggccaagcgggtagtgacaaacttcgggtacccccaaggagggaaccccgcttgagtcaccacagcccagtatgagtgggtgagggcaagtctggtccagtcaccctggggaccacagcccacgccgggctcccggggccgggcagaagcggcgggggtggggctggcccggctcacctttgaagaagcgcagtgc

SEQ ID NO: 5760 - DNA, 1671 bp, Homo sapiens
agacgccacggtaccggctccaggacgtaaacactgcccttctcttccctgcccgcccgcaacttccttctcccgaccacggctttgcgggagcccactggaaaagggaggataccacataccctcggaagtgaggcgggagaagggcttaagcagctccgcgaagctgaggtgattgagacgagtgagccgctcggcttcgtcgctgcacagcgcagcgacacaggggacgaaggagtccgggattagctcctgcactgattgtacacactgggccatcgccgcagcacaggcagcggcggcgcccgccctccggcccaccctgcgaggttatcctgcggctgcagcagctaccgccgccgcccgccggcctggcccggccgggcggggccccgaacgcactggagcctagaaacaagaaggaacagacgccgccgcttcggtttctggggcacaatccactgaccccccccttcccgtcaccgccgcttctcagcgctcgtccccgcgtgctcgcattccaccccgataggtggagacgccgacagtcaccacttagtccttcggacggcaaaaccttggtcactgcccggccggaaccgccatgttgaggccgaaccctgaccaaccggcagtactactcccagctgcccccgcgcgcgtccctcacgtgactgtgttaaaggagacggtaggggcaagggaagagagctgaggagagggaagtgaaaaacgacggaggccggttgggaggctggagccggaagtgttgtgacggaagctccctgggcggggcggggctacaagtgcggtgggcgggggcgggggcgggggcgggggcggggggaggtgcacaactgtaggccgggttctcaagctcgcccttagcagagcagagctgagagccacctactagcggcaggtggagcctcgagacgggtgctgtcgtggtgatggaggcgcacgctcgcttcccacgcagtttggcctttttgacgtccctggctgttgtgggcaaccgatttggttggtcgcgctgcttcctacgctcgccggcggagcagctagtggcacctgctcggagagagggagtggatctctcggaagtgcttggggtttcgctgaagcggacctgaacagaccatgtgtcctttaaatacagccatgcttttagaaacggactgtcactttatgtggactcaaccattgaacagaatgtgtgcttttgtgagtgctgcaattccttcaagtgtaattgcgctactgcatttttgttggtcgcagggaaggggtgtgcctgcaaatgtccgcgtggttcgtcctcagcctcttcctttttacactgtgctaggatgtttacttgcttgtggtggaggtaggggaagccagtatttgtgtactgtgtactgtcctgaaccggctttcattcctaacttttcaaagattgctttaaaggggggggggcgcgggtcaaatattgttttaaagggggggacggggtgaggtcaatggtgtgtgccttgtaagtagaaatgaatgaaaggaattttactaatgtgtcactcaattgtttgagctccttctgttttgcatgccaaaaatataaggcaaggaaaaatgtatcattctatcatgattttatggtgctctaattaaaggtgtcttccccaa

SEQ ID NO: 5761 - DNA, 2917 bp, Homo sapiens
ggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtac

SEQ ID NO: 5762 - DNA, 91667 bp, Homo sapiens
agaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgacta

SEQ ID NO: 5763 - DNA, 1889 bp, Homo sapiens
aatgtcaggattgaaaatattaactatatgtttaactttcagtgtttcatacttcccttaagagatgtaccactgaatgcttagaaacctgattttaaataggtatattttttaaaggagacttaagagcgatatcaaaaaatcacattcagcattttcaatgcactatttctaagaatgttttgttgaattatatggtagaagactttttgtattatgaatacccatgggcaaattggaagcataaacttggattttctcatgtttaaatgacttaaagacaagttgtatatttttattcattgttacagatttgtttcctcttcatgataaatttatgtgcaggtctgattgtacagtttaaagtttggtctacattttgtttcttcctggctgagcacctctgtgttgagtgctaatagcttttttttttaatctaggttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagagagtaagaattagccagccagcatgatttgaaaatgtcacaggagggtgccagcaggatgatgtcagcccttgctttggcctatgcagcatagcacagtcatttcataaagaattgatactatgacacagggtgctggatgtgcattgggcacatctgtaattatagaactgagtttctgaatgagtcaaaacaaggtttagttagttcataatgttcaaaaatagctgtttttaaattagactctgctaatttaaattattgtttaaaaaattagcattttcagtggctgctttatattcctttagagcaatggcctacatgtttaatatagtcattttgaataggcattgctttttattcatgtaaagtctgtatttccctctatcttagtagcctggtaaaaactgaaccctgatttccagtattcagttgtttaaagattagtatattaactctgtatttttaagaaattttcccagtgaaagaattttctgaaaagaatgtcataggaaaatctaggctaatacttctctacacagcactcagtatttgttattgctctacagagtaatttaagttatagagtccattgaatcttgtggctgggttggatattacccaaagctgcattcaaaggaagagcagtggtaatatctaaatatatagtttgaactatatatgtggacataacttacaaatattaaaataaaaggagtagtcatatatataaccaaacatttcctctgtactgaggtatattcagtattatactatgtacatttaaaaagtaaccctgtaagttacactaatgcaggagtttgtatggaagtattgcatgttcgcaggatttcagaggcactttcttaataatgtgttaatggtgttaatgtctgttttatttattctttggatttttttgttttcatttttgggtttttgttgttgttacataaaataaaactatataaggctatttgtgccctatataaaatagctattttaaagagaattttaaagtgtcatattgtcttatgtgcccatgcatttatatagtggtcagaagtgtgtcttataaatagtataatcatgtagtaacgtcccctgtacctgagtttcagtgcagttaaggggcgtaattgcagggtcttttaatacacagtttactatctacaagtacttaccttagcaggcaattgtttttgttttttctttttttaaaaaaaaaagtatggtaaaccttcatactttagttttacaaagtaataataaactgttttgatattaaca

SEQ ID NO: 5764 - DNA, 1039 bp, Homo sapiens
ggagtctcactgtgtctcccagcctggaaagcaatggccgcgatctcagctcactgcaacctccgcctcctgagttcaagcgattctcctgcctcagtctcctgagtaagtgggattcagacgcctgccaccatgccaggctaacttttgtatttttagtagagacggagtttcactatgttggccaggctggtcttgaactcctgacctcagaggaaaaaaaataatgtaactagagaagagagttgagcagagaactgagctctttgaagtgctggtagtttgtctcaacccatgaagcagcttaacaagcaactataactaagcatagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctt

SEQ ID NO: 5765 - DNA, 1656 bp, Homo sapiens
gcattgtgtatgagatgaatatttcttgagacttttttgtttgctctactaaagaaatcaaccaagggaaaaaaaatccaaaaaacaaaacaaacaaaaaacaccctctaactcatgtgaagcatgcagggtgttgtaatttcagtttgcaaagcggtgtgatacaatgttgctgagccaaaagcacacgatagatttaatgtagccaattgtgtacttttgaaaaaaagagtaactgttccctgtgagttaattttggatttcttcaaaatctctcttttaggctttgtgctggattcttccagacaaatgcgtattccatgtgggccactgttctgctaaatgctctcagttctccttttgcaatcaagattatgttgctaaggagattttgcttttattgctgccattgatttgtgttaatacgttttgaatacctctcggtattctttcgtagacaaggccaaaagaaaaacttccccgagtttcccaatttacattacaaatggagcggtggtgtaatgaagccgatataaagtgggcagttgaaaggagactaaagaagggcactcaagtgagaaatgaagaaatgtgccgagtgcagtctgtgggctgcccttggtccagctgcaggaactggctctggccagaggtagagtgagtgagcacctccctctgcaaagaccacccacttttggagcctaggctggcacaccaaagattacctcattgattaatacagggcttgaaaatttctgaggtggcaaaatcacttctaaatctcttttttgagtccttcctagagcatgactgaggccacacttcctgtgccttatgacctgaagttgtaaaggataacctatggatggaccagttcttttggttctgaggactagtgtatttcaaatgttggaatgtattcctaggtgaggaggctattaactagattaaattggttttagttatatgcttcttactttgtgtcatattttagactccaaaaactgtcttcctaccaaaaaaacccaagtattccatctgtgagtggaaagagaccaactagatgtgtctttaaccagcgaagtggtttgctcaggttgcagtgcgtggaggtgctaaagaatagcatgggccgggcgcagtggctcctgtaatccttgaatgactttctattgacacgatttgttatttcagcaaaatagaagtctgtcagtctaatgttggatgatctgatagtagtgacattaattttagtaaaacctactttacgttctctatagataatatgcacataaagtctacataatgttttcttatgtaataaatgctttgggataatgaagggtacttcgagcatcattcctcagctgtttagtaaaccagctctacagagacttgcctttctaattctgcagctacatgggtagaaattaatctacttgaaaatgaattagcaatataaaaatgtaatattttatgattaatattaactagaaattaagactgaattattcaacttcagtttgccattctttgaaagaagttacattttgggaagttctgtgaagttagaaaaagtttgaaagtgtgttgcgggaaatagtggctgactagtgtaatgaattgaaacgttgggaactctgtgcccaagggacc

SEQ ID NO: 5766 - DNA, 621 bp, Homo sapiens
caagcaccgacaactccttttggctgggccttgcctcttttggccacagaccttctatatgaccccaggtgcatcagtcacagttgctcagaaccctgctcagtgataaacatcttactaaagctgggtcaatcagggtcactctctggaatgttaaacatgaagcctgagacaagatctctcttttatctggggtccccaaaggcaatgctgtacacttggagctgcctgctgccctgcaactactcccatttaccaattatctggaagaaccagtctacaatagaagacaacgaggccaacacacaaaaacacagtaaaagtatggacaaattagtgggatccctgaaatctattccaactatgtgcttccaagtcacatgactcaataaatgcttcagctggttgagttgtgcttggcgttcactaccaggagagttctgattaataaaaactcattccatcaattaataatttagtagctctctttcaacctgagccaaattcaagcataagctaaaggataagcagtgacccatggccaatttcctatgtcatacacttgccattagtgacgtaagttaagccattcttcaaaacattaaacagccttcaagaaca

SEQ ID NO: 5767 - DNA, 868 bp, Homo sapiens
gacatttacaagaactggcggcggcagcagcagcagcagcagcagcagcagcagcagcagcagcagcagcaactggatttgctttttcaccagaggatccagatttccctgtggcctcgcaaacaaaaaagaaggaagacggagcagcacagtcattcctttgtgaaaaaggcattcaggtaactgagtgactcagcaagcctgggtcttggggaaattacgaatacctggttgaaggacagtcctcaggcagagcccctgagacctgttgaactctagagtgtgggagcagaggagattcagggcctgcccaggggcagagtgcccccaggactcgccctggctcagttaaggactcccctcaggatctgcagaggtgcaaggcagggtgcagctctgcctggactgagctggaaatgcagccgtgtggctgaagtggccacttcctgctttctgtaaagcagccacagggacctgtgaacagacagagtctcaaccaggctggagtgcagtggcgtgatctcggctcactgcaacctccgcctcccaggttcaagcgattctcctgcctcagcctcctgagtagctggtattacaggtatttcaggacagccaggagggggcgcacatccgccgcgaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacctgcca

SEQ ID NO: 5768 - DNA, 1009 bp, Homo sapiens
gtcgcctctgtgctgtgggtccaggaatctaaggcatcttctttattctggaatgagcctgcccatccctcaggaagactgaaaggaattcggtcagaagaatattattgacttttatccagacttgatttcagtagagttctgggacctgccatatcctatgggtgagctctatccaggtccccttccctgaattacctgtcctctccccactgactgggatgacacctaattttacaacctgctgtagcatctttgctcccactgtgacagtaaactccttgagactggtggccatcttgggaagtgattagattcagaagaggttgagaggttggggcccccatgatgggattagtgtccttttaagaaaaagaagagactggagctcccactctcttcaccacgtgaggatatggcaagaaggcagctgtctgccaggcaggaagagggccctcaccaggaactgaatctgctggttccctaacctcagatttccagggtccagaattgtgagaaagaaatgtctgttgttaaccaatccatctgtggtgttttgttatggcagcacaagctgactaaacaagtgccaaaaccaaaccagtaactcccactttctagtctcggacccagtattaaggaattctggtcacatagtttattcatccatttaacaaatatttagtaagtgcttctgtgccaggcatttttctaggcctggtgatcatttaatcaaaagagactaacacctgctccctgatgcttacaatctgaaagacaataaagaaaaatatagtaacagtagtgaattatatggatgtgttccagcaattgattgctgagcaaaaaataatcttaacgcatacaaacgccgggcatggtggctcacgcctgtaattccagcactttgggaggctgaggtgggcagatcacaaggtcaagagttcgagaccagcctggccagcatgatgaaaccctgtttctactaaaaatacaaaaattagctggg

SEQ ID NO: 5769 - DNA, 502 bp, Homo sapiens
agacttagaacctctaaattattgacttattttttatataaggtcactccgatgaaaggtgattacaaaatcatctacattgctgtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattg

SEQ ID NO: 5770 - DNA, 2415 bp, Homo sapiens
taatgaaggtgatccagaaatatattggctgtcaaagttgcatcactggcttgctttttttttttttttaatgctggaagataaagtggctacctctgagacaagtttttcaaaactccattttccaccagttctgttgcaatctctaggtgttataatcaagaaattaaaaatgcttaatcactgaaaattgatcaattattggtttgcttccacttctacccaggtcacgtaaaacatgcattcggaccacagattttcagagaagtgtagctcataaaaattattgaagcttgtgaagaatggatgtgatcatctaaattacttaaaacaactaaaaggaaaactcaaatacattaatgatttttatcttcacatgaataagaaaagtttttttaagtccatgttgatagaaaattgtattcaagtcattaaaagagacatgagtgcccaatattcctctcaaaaagaaaatgttgaaccacaagaggttgtagcttttggaatgaagctaaatgtgaccagaattttttttttttttttttttttgagatggagtcttgctctatcgcccgggctggaatgcaatggcacgatcttggctcactgcaacctccacttcctgggttccagcaattcttgcctcagcctcccaagtagcactggctaatttttgtatttttagtagagacagggtttcaccacgttggccaccacgaacttctgacctcaggtgatccacccgccttggcctcccaaagtgctgggattacaggcatgagccaccgtgcccagccgatgaccagaaatttataaaatcatcaggtaggccaaaggagatgaagaatgtaaagtcagagacttttttaaatattaaggattttcttcctgaagtaatgctcaaaatgtccattacctaagtcttcagttgtaatgcatctacatttaagtattaattaattaattaagtatacagcaaagagctcagctggctcaaactggacatctctggtatcaaaatatgacttccttgatttgtatggtaggcctaaacactgattctcaaccaagagattgtgctaccttaggggacttttggcaaaaatatctggactcactttcagatatcaccacttggggtaggagggggtgtgcttgtggcatccagtgggtagaaaaggtgctgctaaatatcctacaatgcacaagacagctctcaacagtgaattatccagtctgaaatgttaatagtgctgaggttgagaaaccctggcccagacccaatcttaatagggcaactgataagaatagtgtaaaaaaaaaaattataaaggatggttttcaagaatgcaataaaactaccactatagtagaaactgtagagtccatagagaagacagcttctgtcaatatcacataaatgcatatatgattactccatagcttaattcacagtgttttagcacataatggtgcttctgcagcaatgttagaagtagcccagactctggttttcaagtaaaagataaacttcttgctgagaaaatatcatattttattctgtgtgagtgttgcattgtttcatgtgaagcatcagaatgtgagtaaaatggaaattcccatctttatatctggcagttgattttggcttggtctgagagcagaatttttgtattcttggtatgtctaggagccaaaaaagtacaaatatgatttagacattatttgaagggagatagtactactggcatcactctaaaaattttcagaagaaaaattgtttagaccttgggaaaaaacaaagtcaagaaaatgaatttcaacaagaaacacattacttacatgatttaatagataattttggccctgaaactaagtttgtgtttccttaaaatttattacttgaggatatgagagaccaaatttgtagctgatattgacaacaatttattgtggaggcaaggattattgatattcttcttgtagtgggaaaaaccatacaattgtagttgtcttccttgaattactgaaattagaatgtttctgaactaaaagtctgttggcagcagaattgttcttctttggcctttgtgtaatgtgatcagcctattttttttttttttttggtattggaaatttgttaagacctctgttagcattgtaagatttacctgcatttttgctgaaacacttaaggactaaatattatgtgcaaaattattttattttagaggtgaacaatctaagaggtgactagcttatttgacagcattgttgagtcagtttagcattatgtactatcattaaaataacgaacaatctatatagtattcagaatatttagaacatgtactaggagtccactcttcttcaatatacctgttggccttacctgccttggattattgatctgtg

SEQ ID NO: 5771 - DNA, 3119 bp, Homo sapiens
agttacgccgtcgggagtacgcagccgcttagcgactctcgcgttgccccctgggtggggcgggtaggtaggtggggtgtagagatgctgggtgtgcgggcgcggccggcctcctgcggcgggaggggagggtcagtgaaatcggctctggcgcgggcgtcctcccaccctccccttccttcgggggagtcggtttacccgccgcctgcttgtcttcgacacctgattggctgtcgaagctgtgggaccgggcccttgctactggctcgagtctcacatgagcgaaaccactgcgcggggcgcgggggtggcggggaggcgggcgttggtacggtcctccccgaggccgagcgccgcagtgtctggccccgcgcccctgcgcaacgtggcaggaagcgcgcgctggaggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctgggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgcttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggttaggcaacatctccctttttcttcctctaaatacctctcatttctgttcttaccagttagtaactgatctcagatgcctgtgtgatagcttccaaattgctgtctctgtctttagtgttatcttttgatccatcttacatcttgttaggatgattgtcctaaaggaagatagagcatgaaaatgacaggtgaaactccattactggcttgtactgtttacagcaagttgtctaacccgcgggccgcatgggacccaggacagctttgaatgcgacccaacacaaattcgtaaactttcttaaagttttaggagttttttttgcggggtgttttttttgttgttgttgtctgttttttttttttgctcatcagctgtcctttatatgtggcccaagacagttcttgcagtgtggcccagggaagccgaaagattggacacccctggtttacaggatgaattctgttctcgtgaatgtgatgcataaggtccctggatagactttcctcaatttaacagctttttcatttttcactattttccacatactacacacacaaatatgacctctctcctgaagtcacatggaatgaattgcagttacccaaatcatagagacgtcatatatctttgtggggtggttctttttggaatgctacccttgctgcttttaatcctgcagattcaaatgtcatctcccctttggtcatgccttccatggtctgttgttctatgacccaaactgcccttttaaaaaagcagttttcttctgactcctgagcagtttgtactgcgtgggtcatagtaattctggggttgttgtcattgctgatttaaattaccttaactattctgagctttttgaaggaatagtgtcttgtactcctgagctcctagtatactctgatgtctagccaactttaagtaaatggagtgagcgacatgtaaatgtctttatggtttgacattttattaatcttgagcattggaaaagtggctggtatgactaaagaactgaatttttattttttatctaatttgaattgcaactgtggacagtatagctgtagccccggacttgttctgtggattacagaatacgtggacattgatggttttctctttttactgagcagtaaggaaataaaagctgaagctctctggcccattacatttcatttaactgcttgttttgttttatttattatatatttagctgaaagctaagtccaacaaaccatttttaaagatgtgcctgccttggacaacagtgaaagcaagcgttaatgagtttggatttcaaaaaaaaatgcataatgaattttagggaggtgagattccattaaactgttacaggagctacatagttaaatatatcagaacttgaatgaagaataggtctgtgtgatacaaatgaacccagcctaaatttctgtcctacaagttttcacttcctggaaacacttgattggaggagctctaagcatcatatcttgagttatagaaaacaatcacaaagtaagttttatcctgaggaattataataccaacatttt

SEQ ID NO: 5772 - DNA, 2654 bp, Homo sapiens
aatatatgttctttagtaataaaaagtcttataatcactttaagttagaacacaggctcaattcactatccaaaatgctcccatgtgagaagcaaaactctgaaagtgatttaaagtcaaaacttcatcacaggcctctagcaggccagcagcctacagagggagaaagatgttggcagctggcaggtgccttctctagcgtcttgccttctgctgctgctgctcatctttgagcatgctaaccatggtttctcaaatctccagggattggcctggagaggaagcaggtgtggggttatatttatattgctcacagtggtggcatgtgggtggaatacagggaaatcttacatattgtcttgcctgacagttgctttaagtggactccttctcatggttttggagaccaccccatcactgagaatttgtgtctcctagagttcagtctaaaagccgagatcctacattgtgttccagggaagcttaagaaaattaggtctctgcttgatttggaaagcttagactgaacctaaatgaaaatcaggtcagtaaaaagtcagagtttaacaaagatagatgttatgtcccagagaccagacatttaagcattactttcaaagtgcactcagagagatatttgttcttcatttagtacttagagactaagtcttatccatgccatcaaaaaaatgggagttggaaaacatgccacacatgttaacaatgcattgattttttttttttttttttgagacagagtctcgcacgtcaccaagactggagtgcagtgacgcaatcttggcttactgcaagctctgcctcctgggttcatgccattctcctgcctcagcctcccgagtagctgggactacaggcgcctgccaccacacccagctaattttttgtatttttagtggagatggggttttgctgtgtcagccaggatggtctcgatcgcctgaccttgtgatccacccacctcggcctcccaaagtgctcggattacaggcgtgagccaccgcgcctggccaacaatgcattttaacttaaaccatgtaaatgaattcagatgaagaaccagaaaattactggagctactgcatcaccacactagtaatgtgttgtctctaatttccattaattctctaaagtggagtggcatttaaagacacctggaaaccaatctgatcccttaaatgtttaataattgtcccactcttaaatatgttttgtccacatctaactgaacagtgatcatttttagtggctcacctctagtgtaccaacatatagctgactagttcctcaaactaaatatctttagcatgaaaatgaagttttattttatgcgattttatctaatttctcaccagagggtaaatgcagatgtaagctggcacgagaggagggtgatgcaggccaagatggattgagtcctgggagttgcctgagatgggacataggttcccagaaatactgtgatatcaatactgttctcagtggaccacaatctggcatggacctgggtggtatgcgaggccactcctcctgtgtacctattttggctgctccgagtagatgtacagtgtggagtgcagcccctgggttgtgctggcccagagattcagccagccaagatccttatgcttgctcacagccctcagtggtctgggctactctttagtagcttgagtagcccttgagagtcattcttggaactgtgcacctgaaatcaatcttactccatgacaaatcctgggatatgaactagaagttggcagtttaataatgacagatcccacccttacatagaatgcagtgaccatgtttgtttttttttttctcgtggagtagtaatggggaagaggtggtgtccatttccataaaggaggcaggatgttgcaggaagtcctcatgaaaggatcttatggagggctctgccggactctcaatatgggacaacccttctcttttggcctcctgggtccccagcaagtctgagtctttcactagactaggttgggaagaatgagctgggccattgtgaagggaaactccaggaagctgggtcttcactgaggctacaaagcaaatgccatctaaggggcagatggaccaaggtcagggcatagaagcaatgtcaagctttaggtccaagagtgatgaccagagtcgtgtaagagatgggacagcaggccaatcaggatttgaggagatagggataagttgggaagttgtgtagggacagaaggaggaagaaagtttcaaatcttgggctccaattagataaggctgggcccaattcttttgggtgtgaaaaatgtgggagagggagtggcagctgtttaaaggcacggagctacacaggtttaacagcaatacacttgacccttgaacaacatgggtttgaactgcatgggtccacttctatgtagattttcttctgcctccacccccgccccccaccccccagacagcaagatcaacctctcttcctcagcctactcaccataaagatgaggaggatgaagacctttatgatgatccacttctgcttaatgaatagtaaatataatttctcttccttgattttcttatttttttcttttctctagcttactttaagaacacaatattcataaaaaatatgtgct

SEQ ID NO: 5773 - DNA, 775 bp, Homo sapiens
ggatccactgagagttggttagctgtgattaatactgtcatctgtgaccatgaaaatctatagtggtttgccccattacatatctgaaacattgtcttatgaaaacaaaatgaaacaaaattaaataaaattgaagataaaaatactctggaagcacaggatatctgacaagaatcttcagcacaaagcacatgtttgaaaacgtgaaacgatgactctttggaggacaatagctaaatatccaagaatcatcagtaaagaaaacaaaacgcagcacattcacattttcccgaggaactgtaaagatgatctctacagggataaacgttgtaaagcctgaagctcaatcaactgatgttggaaactctcaaagggagtaaaggcttgatctcaatggtctagaacatgtactgtaatttaatagaagagatggtcgtcttaatatttaatgatttaaaagaacttcccagtccatgcgaagagtacagtccaagaataaatcaaatttctgaacgcattttatgctacatatgtgtatactttgcgatcctcaggtgttcgtgccaaatattctctctcaataagtccttcaatacgtttcttaataacaactggacttggtaagaatcgcgccttcaactgctgagttacctaaaaaagaaagtagatagtatttttatataaacacataaaaattcgtatctttgaacagaactgatatgtcattttaacactcagagactgaactttactaactggattaccaaagataaaa

SEQ ID NO: 5774 - DNA, 91671 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgacta

SEQ ID NO: 5775 - DNA, 2555 bp, Homo sapiens
agtggcatgagaacaccccaggatgcctgctaacacatgtagcttctgaggccctgcactctggaggttcaaactgagaaggctctgagggtaagagtggggaactaggatctctagagaactctgaggcagaggtctgcttccctcactgacactgcctggctaccaggttggtcctgggttcttcacatacaaggagggaacggttttatctgttcaaggtgctttctctattcagagtcagcaaacttctctggagcaactacccaaatcagatgttgtgctggctgtaatttaacatttattttatgattatttgattaatgattatctccctcattatactataagttcaaaacaagggtataataaatttgcccatcttgctcactaatatatgccagggcctacaatagagttgatattcaatggctatttgttaaatgaatgaatggagtcaatgaataaataaaatgcaaacaaagacaaatgaaatccattccctgtcctcaatgtgcttataaccttttaggtagctgggcaagtaaacatttcagaacaataaagagttcttgctgtgttatgccacatgtggcccaggcatgagggcactatctccccagcagggctgaacccaaactaggtcaggcaggaagatgacaagactggatcatcagcatgggtgggctgacctgaaatgggctagacaagggcaagtcagatggggaacagtgggaataaaataaagataactgtcaatttgtcactaaggcaggtaagctgcaaaaatgataagacatgagttatcaatcactgagtgtctgcagtgggccaggccttctgctctggactcatatttgcatgtactttatcccactgaattctcacagtaatcttacaagagaagaagcatcagttccatcatacaagtggagaaactaaggcttagagaggttaactcctgtgaccctaagagcacagcgaagattcaaacccaaggcaatgtgagtccatggcccatgttgtgttgtactctaggcaggcagaataatgatccctgcaagaggacagggatgacaaatcagaggaagtgagtacaggacagctgaaagtctttccatgtatgaagttgcaccaacagaggcttgtggccaccaccctctttaaacagaagcattcggagttttctctcagcattaaccgtcccaaggtacctgttccatcttaatcttaaaaggtcctcaaaggaattttgtcacaaagatctggtcaacccaagtgtctttcacattatcccctccccttaccccacagacaatgccttaattctggcctcgcctgccttgcctagaccatggcaggagcatgctaactggtctctcctctaatctgctctccagccaaaaggaatcttgggaacacaaatctgggcatcacttccttgtatgaaacccttcaaagcagtggtcttcaatcaaaactactcattagaatcacatggaagattttagaacgtatcagtccctgggcttttttttcttttttttgagacagagtctcgctctgttgcccaggctggagtacagtggcgtgatctcagctcactgcaacctctgcctcctgggttcaagcaattctcctgcctcagcctcccgagtagctgggattacaggtacctgacaacatgcccagctaatttttgtatttttagtagagacagttcaccatgttggccaggctggtgtcgaactcctgacctcaagtgatctgccggcctcagcctcccaaaatgctgggattacaggagtgagccaccacgcccggtgatctacaatattttgaaccatttttatttaactgtaacctccaaagatgatttaattgacctgagatggggcccagccatatttttgaaaagctcctcaggtgcttctaacatggatccaagcttgaacaccactgcagtttaatggatgagatgcccacttttaagccaaaaatactaagctcagacttggacctcctcttccacctctccttcctgcccccatattcaacaatctaaccatactgagctgctgattccccagggattgcatatgatttcaagctgtcactcttcaacacatgatataatctttgtctggaacatgtcctatcccactttctagaaaactccttaccatttgtcttagtccattctctgttgctatcactgaatacttgatactgggtaatttatttaaaaaataaatgtatttcttacagttctagaagctatgaagtccaaggtcaagaggcaacatctcaggagggccttcttgctggtggggactctctgcagagtcccgaggtggcacagggcatcacatggcaaagggggcatactgagagccaaactagcttttaatacagacctactctaataataactaacccaccctgtgataactcaatccatttatccatgaatggattaatccattcatgaggtcagagccctcatgacccaccacctcttaaaggccctgcctcttaatactattatactgggg

SEQ ID NO: 5776 - DNA, 3485 bp, Homo sapiens
ttcagcggccaggctggcagaaaattacattcttggagcaatggtgtgtgcccagagtgctttttcctcttggcttcttgactcagttttatttgggtatgacaagtgacccaattcatatgatcaattttcatactatattttcctttgtaaactgtttgttcaactctgcccatttttttatgggttttttatctttttattattctaaataaaatcctttgtcagatacacacacacaacacacacacacacacacacacacaaatgtagtcttcaagtctttggcttgactgttcattttctctttttttctttctctttccctacaagacaaggcttcccgctgtcacccaggctgaagtgcactgtggtcatggctcactgcagcttacctcctgggctcaagtgatcctcttgccttggcctcccaaagtgctggcatgagtgactgtggttggcctgtttattttcttaatagtgtcttttgatgagcagaagtccaatttgtcagtttttaattttatagttagtgctttctggtaatgtctgggaagtttttaccctctcaaagccctcaaaaatatgtttttagaagttgtatagtttttagctattaagttttaggtctgtaatttatgatgaattatattttgtacatgatatgacatggagagtggagcttcaatttttttcatatgcttatctagcactatttgttgaaaaagattgtcccctcattgtattcctctggaacctttgttgaaaatcaattaactatacacgtgtgcatttctttttggaatttctatttgttcctccaatctattatctgttcttactgcaacaccttactgtcctgattactgtagctgtttttcttctgtttttgtctatgcttgttggtgtttctgggtttcccagcttctatcattccaagtctatggtgtgagatagaagaaaactctgagaactcaccaccatattcctcctatcctgaggtactgaaccggtctgcctccttctgtctacctttcagagtctttttttgtttcttcttcttcttcttctttttttcttttcaatctgatctgggaattttagttgtacgtaccaggaagaatagggataaataatctttactcaaattttcaataatttacaccaggtatcctcttgcctcagaaataagaatttctgatttttgttgtttgttttcttgcctttgaatatttatacttaaattttattatggaccatttgaaacctctctcttctgcccttttcttcagtgaagtttaggcttgctatagctccccagtggtcaaacaatgtgtcctaatgcaaacatgttgttcttcctttcttactaaaccgtcatgcactcagactctcactccttcatgtctgcctttagtggctccacttatcttcagctctagatgaattaacttgtcttagtctgtttagacttctataacaaaataccataacatgggtagcttataaacaacagaaatttattgcttttcattgcagactggaatgtccaagatcaagatgctgacagatttagtgtctgctgagggcccactttctggttcatagacctggccttcttgctgtgttctcatgtggtgggtggaggtggtgaattcataagaggaggagggagtgtcctcataagaggacactaatcccattaatgagaactccaccctcacgacctagtcacctcccaaaggccccccctcctaataccatcaccttggggattaagtttcaatatatgaattttgaggggacacattcagtccatagcacaagtcaataaatatttctttagagtagcttttgtcagataatctattaaatactttatgaacaaaactgtctaattgtctttatcagtctagtatggaaacaaaaataattgtgtaccaggagaacatggaaatgtagtatagtataacttacaaatgttgtaggggtgaatgatcaaaagccacctggcattttgctgctggtattcctgcccttactcctctcttagccccagttttgtcactttctggctttggaattggtaatgactcccacaccaggtctgaactcaacatgacatttagtgtctgagcccaccttatcttttaatgtcttttccattacttcttagcaagaactgcccaggtcaggctggtcttcaccccattctcataataagtcccaaatgttcctgtgtgtctttaaccacactgttcctcctggcataaatgtatttattccctttctttgtgtgtatacgtgaagggtggttcagtgaaaaaaaagtgttttgagtcaaacagatcccagttttatctcttacttgctatgtgatttagggaaagttatttaagctctctgagccttactttctctgtttataaacatggaaaaatactgcttttctcacagggttagctaaattaatgtatgtgaacgttccagaagccacaggaactcaaataaattgttgattccctttatttcctgaattagaacttaaggcttagggcaagattcatttcttctaatatttgtctcatcagcagtaaatatgttgagaacagaaaagataccaattagtttattaaataaacatttgactacttactgtgtgccataggtagtgttaaattttggagctcaccattagcaaggtgaacacatgcatatgtaattgaaatacagtatggtaagtgctgtgaagaggtatgttcaggatgttctaggacacagaaaaggagtatttgtggcttatactggatggggtgggtcaccagggaggattcttggagaagtgttgctagtgcttgatttttttaaacagctttattgaggtagaactcatataagatccactcactcgaagtgtataatttaatgatttttagccagtttatgggtttctgcaaccatcaccataatccaaatttagaatgtttccatcatctacaaaatcatgcccaattgtaggcctagtgttaaaggatgagtatgaattagccacgcaaaaatattgagaggaaggctggattcctgggagagaatgagcaaagacagagaagcatacaataacatggtatccgtgtgggtgatatgtctataagcaattttttttttctggagtgtaaacctgtgcgcctgccccacaagttgtgttttagcttccatggacttgagctcagtttcctcatctctaatgtatagttcctgttaccttgttgaactctaggtccttttaaactctcaactcttagattgtcaaaacttcaattaataggaaaagggaatgcactttaaaaaactatagccaaggccgggcctggtggctcacgcctgtaatcctagcactttgggaggccaaggcgggtggatcacaaggtcaggagatccagaccatcctggctaacatggtgaaatcctgtctttactaaaaatac

SEQ ID NO: 5777 - DNA, 986 bp, Homo sapiens
aaaatagtacacaatctctgataacaaaaaaagcatttagggtcaaaagacatccaacatacattgtaacaatgcacacatattaattaaaaaaaagacccatgaaataatttttaaaaaactttcaaaaggaaaaaactattttggcttccttctgctgaaattcgcctataaacataccacgccagctagaccagcattccctttcacgtggtctgtacaacatagtactgcacaatgtgagcaattactttgatgaacacattgtttttgaataaaattgttggttctgtatggatgatccagacataaatccatggttccatttcacaaaaatattcataggctggaagagcagtgacaaccattttccaaaatcttcagttttaacaaaaggcgcagaataaactactaaatctagatgttttcacattattttgcatgagtgtcaaatactatgtaaaaattaacgtaaaatcttaagttggccaaaactagtgtctctaaagatcaaaattcttcactcttttagcatggctgataaatcttttctgcctttgtcactaatgcttgtcaaaccaaagaactttgcaaaagaatatgcactgctgaaggaagacagtaccaaaaataccatattgaacttcggtcttaagacacacacagttcctgttggatactggactgtgaaagtttattatcttcagtcttttcatgtcctggagcatggcaagtagtcttccgcttaaataaccgaagactcaatcgaagtaattcattgtctaccattggagcactcgtgtaagcttgttttatggttaccttctcatttttaacaagctgctttcgaattgcagaatcccgtctgaagcacaacgccttacaacatgggccaagattactaagaagacttgctctttcttcttttcgtagtaatgcagccatattgagagcccccaattcatgttcaaagagattgtctgcat

SEQ ID NO: 5778 - DNA, 1088 bp, Homo sapiens
gagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggtaccacttcccagacctccagcctccccactgatgatagatacacaaaggtcatcttgtttctttatgaggcaatggattgtgttcacctagccgagttgttaagcataagagaatgtatgaaaagtaattacaaggttcaaaatcctgagctttgataaatgatagatatgatgatgagcacatgttagtgatattactgctctgcgggacgtctgaatcagtaattgctgtcttttaagcatctgttgtgtgccaaatactgcactaggcactttacgggcattgctcttgtttaagtcgtctggtcaaagttgcctagacaataaacagcagagcaaggattttaacccaggtacagctgacactgctgcctctatgcttagcagttaaactggtttttatgtttcttgtttgtacacccctccttcaccagtcacttgtagattcaccttgtgaagagctaattcttccctctaataataatactctttgaccatttactatatgtcaaaccgtattttaaggactttaaaggtattaattcgtttaatcttcacagcaatcctgtgagtaggtattattaataccttcactaagacacaggcttagaaaagtcgattaacttttccaaggtcaaacaaccattaaggagcagagccagattcaaacccaagcagacagaaccctgaacctgtgtttttaattcctgttttaaactgcctcggtagtacggtaagacttcattagcgctaggtccatgcctgtttgtgcaccattatttccctgacagccagcatggtacttgttcaatatttgaacatttgatgaatatttgaacactggaaaaggaaaaagcttaaaaatgaagtataa

SEQ ID NO: 5779 - DNA, 1615 bp, Homo sapiens
tcagcctcctgagtacctgggactacaggtgcaagccaccgcgcatagctaagttttaatttattttttgtagatatgaggtttcactttgttgcccaaggtgatctcacactcctgggctcaggaggattgcttgagcccacacgatggagaggtagcactgagctgagatagcaccatggcaccccagcctgggcaacagagccaggctttgtcttaaacaaacaaagaacatggtttgtccatttagatttccttttatgccctttagcaagttttatttttttttccataaagttcttgaacattttgtggtggttaaatttattattttacttatttttacatatagctattagagaggatctttattttttagttctcatatgttttctagttagttactactagagtaacctatcatcctagtttatacctgctacatgccatccatttattcccattgtcctggtttggataataaattaaatcgtgtggccttagttattaacaattttatcatttaggatttcattcagtttcaactaataaaacctcactagtggattgttaacaaataagaggtatatttatctcataacagaaatctgcatgtaggtggtccagtgctcgtgcaacagctccataatatcttcaggaacctcgccttgtcttccagcactactgtctgtagaatgtatctttcatcctcatttgtaagatggtttctgcaccttctggcatcttttctatcttcgagacatacaggaataaaaatgcagagcaaaatgagtttttgttttcttttctggaaagagtgagttccccagcagcatttgcctgcatttgatttaccagaactaccagacacatggccatctagttgcagaggcagttaaggagaaacaaggattaaatacataatttaagaacttaaactttatcctgtagagaggtatatgttattcaaggtttttgaaccagggcatgacataataaaacggagattagaaagattcatttggaaatggtttggagaatgagttaggcaaatgattttgaaggcaaagaaagcctagcagattgattaaagtggagaagagcactgaagtccaattagaagacttgtttaatcaatatactcagccttttgtgataatggtaatggtttgtgggtagattagtaaccttgaaaacagaaaggaatagtggcttatactagtgactgtccagaaagacctagctgatcattaaatttttggaattgttgagaaggccagttttctttcattctaaacagttaacatagttaaggaacataggtaaggatacatttaaggaaatagaatgtttcaaatagcttaaaaaattctcttggccaactttttgatgaagttggtaaagtagcagtgtaagtccaagagcccaggcatatttactgtcatgattttcatagcaatgaataggtaaagaaaatacgagcactagaagctagaaaacatgccattttcatggcaaatattaatgttcttcagctaaatgttgtttggatgatgctggaacaagaaggctaactcatgacacctctgttgtgacagagcaacatgcctaggga

SEQ ID NO: 5780 - DNA, 2169 bp, Homo sapiens
aaagcaagttcaggaccacgataaatgttcctggagagttacatgcaagctgaatttttaaatattgaaataaattcttgaggatgattaatggtgaccacttaagcatctactaatatcccatttttgttactgtgcagacacatagaaggaaatacaagatgtgatattctacttccagggccttacattgaattgagcatcacaacaagcctggtcattgagttgtgaatttgtagtgagactggttttgtcgacatgtccctgaatggggggcagtcactaccccgttatcttttcccccattccaatacatgtctggaatacattcattcctaacatttatagtgactcattactaggaaattctcaatggaatgggattggtacccaggaggcatatcaaaatcttgggggagggagagagttgtaaaaaacctagatcctaagtatttctgatatttgcttcaatggctgttcaccccttcgcacatgtgtgcatgcacacaaggacacacacacactcctactgccataaaatgggaaggatgtatttaagagaaggcagaattggaaacttcatgctagcattaattgatatcatttaatgctcaccgcagcaatgtaacatcggtatagagataatagtaatagaattttccttgaaataagctgattaaaagacctggtatccctggaagactggagaactcgctgttggaagatttagatgatgttcatggtggtggttattgtaagacttactggagtgtgacttggttggtcatagggaaagggggataccagtattaactgagtgtctgttatatgccaggcaccatgctaagccttttatagtgttatgccatttaattgggaaactcgtttggtctctgagcctggattaagtgatctgtgaagtcccttgtacttcaagcattctggatgggatttccagttgtcatccttgtattctctccccaatatagcaccgtgttctcaattcatatgtacatgtttgtaaaattccttaaaatatttatgctcaaaccaacatttccattttatctatcttaaatatatcttcctcttctttacgcctaatttcttaaactcccagagtttttttctgtaagatctagtcatctgtagcacttctcacaaattgagctctcttatgccccaaacagtaacgaaagaggtctcttagttggacaataagcagtgaaagatatttcttatgggacaagaaattaacattattagtcaaatgttgatgccggtaggctgagaaatgattctcacttaaaagcccctgggttttaaacctctcttagaaaaacattagttagatgaaaaaaaaaatcaaaatattttcctctggaaaacaatgttcctctgaaaacaagcagattattaaaatatcccttgtactacttcaggaaattgtaatcttataactgtagtggccttttagcttttaaatatatgaacttgagttggacacatgctgatctcattggtactttgcatgataagaaattatgatatttacaatgtgcagtctcagaaagaactgagagttttgctagacatttgccctaaagtttgagtcaatttatggtttaaaggggtgtatttaaggctagaaaagggaaatgaagggttttcttaggattttttccaattctatttaaaattgtttgcaaagttttgaaagcatatgtcatgagtttggcaaaaattatttcaaagcttgttttttttttaacctcattcacctctgctaactcctgaacttcagtgctttacttctgtcttccaaaaagacgttgtctaaaattagtcatgaaatttaacttaactgtaagaacttgaaacataaagtttgctctgaaaaagatctgggaaacctgatgtatatttcacatatcaatacatctgttgatgtattgataaaatctatacatctcagttgaaaaaaaatctaaattttgcccaatatatagccacaaattatttagaatgtaatgttcgtgttagtaggtgatatttttgtcttcagcttgtcattgacccatctaaggatccctgcgaggtcttgtcaaaaactagcctggggcatacccaagaattttaaagattaaataaaacttactggaaaatgtg

SEQ ID NO: 5781 - DNA, 2706 bp, Homo sapiens
gtggctgtcagttttgtccaaaagcttatgaaaaggtttctgtttatttcctttcagtatcatttcatctccttaagagcagctagttacttcatagatacaatggggataaggtattgggtagatacagccgttccaaatgggagaaattggccaaaacaaaggggttacagcgcccatacaagtctgtccaaagtcttttctaaaataatttatatttggtttataaaacactttccagtgagaaactgaaagcctttatatggtccttaaaagtataggtcggttggaatcctgattgcagtggatttgagaagtgaatgagagttgaagaagttgagatattagcaacagattattctttccaagagtccagctgtgctgagaacagagaaaggtaggtaggtaaggattaagggaagaatttagattttatatgggcaagacaagaaaattatatgatgtgagagtgagtgttgatatatacagtcgatccttgaacaacacgggtttgaactgtgtggattcctttatacactaattttctttcgcctctgctatccctatcttcttttgtgtctaaatgcctacagcaagaacaacccctcttctttgctcctcagcctactcaatgtgaagacgatgaggatgaggacctttatgatgatctactttcacttaattagtagtaaatatcttattgacattttgttttctctttaagaatacagtgtataatataacattcaaaatatgttattagttgattatgttatcagcaaggcttctggttaacagtaggctattagcagttaagtttttgaggagttaaaagttacacatggatttttgactgtgtcggaggttgatacctctaatcccctcattgttcaaggctcaactgtatatagaaagactgaaagtgaaggaaggagaaggaataaacagtattctggagagataaagtcagtagcacagatggaaaaatgagagtctaacaagacataaaaatttttctccttgagactgggaatagctgtaaataggtttgtgatagggaattaaggataattcatgtattcacagtctggttcagtcagctggcctaccttactttggccacaaagaatgatctttctgatttatttgttgccttagtttatgatatcatttccagacttttagaaagattagctgaatataacatttagatagactatgtcttaaaatgaatcaagtctagttttttctcttcttaattttaaacattgatttctgggaaagttaaatttataatgatccatttacgcaaaaatcaaataattgtatcaataatctgtttgctatatgcaaatgttatgttttattccacaagttgatattttaattatcatgaattatatttgccttttatggcaggttataaaactgatgttagtagtgtggtttatcaaaagaccattgactttggaattataaaaccctgagttaaaaatcttagttctatcacagattaaccatttgatattgagtattggcaaacttgttttccttttttgagataagagtcttgctctgttgcccaggctggagtgcagtggcgtgatcataggcttactacagcccggacctcttgggctcaagcaatcctactctctcagcctcccaagtagctgggactataggtgtgcaccaccattctcagctacttttttattttattttattatttttttttttgtagagactaggtcttactatgttgcctaggcttgtctctaattcctggtctcaagaaagccttttacctcagcctcccaaagtgctgggattacaggcaagagccattgtgcccagcccaaacttcttgtaaaatttatcttaaattggagataatactggctacttgataagaaaattgaaaggattaaatgagttatgctagttttctcttaactgctgaatgaaacctttaaaatgtagaacctgtttgtgaggatttccactaccagtatctgtttaagatggtgccattcctattttcactaaaggattaactaccagtgttgactacagtatactcataaaaatcatatttaaagcatggtattcattccctttcctgaaacccacattccctttcttctccccagggcactgttttacagttagtttgcataccaacataggataggtggctctgtgaattatataatgtagtgtggaccaccccattttaataaacacctacaacttctaaaacgtagttttcatgaaattctaaaattgtatttgaagagttttagtgacatgtaggccatattaattaggtcactgaagttttagatttcttatattgcatttaatttttaattaggcttggtgaacttcctcaatgctcccaaagaccctagacccacctcgtgggctttattatctaataggaagttaaattgagtttaggattgggaaacattaccttacatagagcaaatatttgttggaacataacatttacagattgtcagtccaaatgctgggccattttataagctacaatgaggtgtattgtttattttagattctagtgtatgattcttgaagaacttcaggatgttagcaataatagttacgatatactgaattccactgtatacatagagtagaaaatgaggctcagaaaggttcactgacttgcttaagctt

SEQ ID NO: 5782 - DNA, 3010 bp, Homo sapiens
agactcaaatagcaactggagatggtaagaggtgaggctccctctcctcctggttgggaaagaggaagtacataaccccaatagctgcccgcagctatcaggaggcgcgtggaacgtgacagcagtatgggtgaagaaactaagaatcagaggagttctaactgagccatgaggactcgattcctgaaaaccttatttataaaaaacaggaatgggaactaaaacaaggcaacctgtgcaagcccttacaagtttttcatgtattacagtaaaaggtaaagcaacttaaaaaccacttgacattttttaacatttgtaaaattttgtaatgcacagttgtctctcatttaccatcccttgctagaaacttcttaggctcacccttcactgcatttccaacattattttgctgataatgtatacgcccaagtgacatgttttcatttggcttaactttcaatgcctttttgattttatgatctagtcctttattgctggacccttgaattgtatctagtcttctgctattacaaaaaatgctgaatcaaataaacctgaacatgtaacatcataaacgtgcagttatatttgcacagcaggtcaccagagtgggatggctgggtcaaagaaaggtttatttaacctgaacagtatttcttaaaaccctctttcctttttctgatacattaccaatacagccttagctctataattaactcttatgccaaagctaggactgcagtgttggctctcagatttagggagcaattgctgacatgtgggttattattattcctcagttccctttatcactcccaaaccttagttgcagatttctacatttattctagtataagctttagctcccttaactatttctaacacatttttctttttcaattgtctccgttagactgttgaaatttatagatgaacaccataacctttgaaattctggctgagaaggtacatggttacagattcaaattttatgcagaggggaacttacaggggcacaaaatcaggatacagttattctttctattcgccatctgttacattctcaacctttttttgcggtcaccaatgaatgaggaaaagttctgaaatgagttttaagatactgctggtaatttctaagtattatttaaaactatgatctaaacagaagaaaagggagtatcaggttacttttttctgggttaaatctttttgggggaaaggtagtagaaatgtaactgaagcgttacttcaatattgctacaaagtaaagtttgggaaattatcgctgtttacatagtagagggaagcaagtagaattccagattttagccatagaaggtttagatcagattctctggcattaaggagctgacagttcaggagtgtaaaaagaatttaaagtaaactacctgatgccttgtctctaagtgccaagtgttttttttttttttttaaatactctgctagtggttgggcacggtgtgtcacgcctgtaatcccaggactttgggaggccaaggtgggcagataacgaggtcaggacttagttagagaccagactggccaacatggtgaaaccccatctctactacaaatacaaaaaatagctgggtgtggtggcaggctcctgttaacccagctacttgggaggctgaggcaggaaaatcatttgaacctgtgaggcggaggttgcagtgaaccaagatcatgccattgcactccagcctgggcaacagggcaagactctgtctcaaaaacaaacaaacaaacaaaaaaccactatgccaacgtagaaagaaattaaagtaaaccttaatgaaaagtataccacacatctctttcttgcctgtggttctgaacaggctatacaagctcacctgctatagaaagagcatttggaacttaggcaaaaatctcggtggactctagttaacatgtgttcatttagagcagggtttggcaagcatttttctgtaatgggccacagagtaaatttttatagtaaatttttatgttttgcagggcatatggtcttagcagcaaaacacatggccatggctatgttccaataaaactttactgaagcaggtggtgactttatttggcctgagggccatttgctgacctatgatttagataatatattacatattttttcccccaaatgctctaacatttatttattttttttagatggaatcttgctctgttgcccaggctggagtgcagtggtgtgatcttgcctcactgcaacctccacctcccaggttcaagcaaatctctgccccagcctccctagtagctgggattacaggcatccaccaccatgcccggctaatttttgtatttttagtagagaccgggtttcactatcttggccaggctggtcttgaactcctgacctcatgatccacccacctcaggttcctaaagtgctgggattacaggcttgagccactgcaaccagcctttaacatttattaaacatgccaactttttgatatatggggggagtaaagacatcttaatcacttttacagattttacaaagaatatattttggctattagcagaaatagaaaagagggcacagaattctagctagaaggaacggaatcaggaaaggcagggagatgtgacttcatagcacacagggaaactgaaaaaggtgaacaggactgagaactgtgacagaaaaggaggacttaggaagggaaatgagctttgacagaagaatgaatttgattttcgaacttttagagtttggaggtaatggttaaacatccaagtagaatacatggagttatcttaatacttggcacactacgaacactcactgttagctaactgcgagcttctcgtgagctattagaaatagaatattagtgttagactgaggttacggctggggaacttgcaagggaaaatattgaaaacttatggaagcagattccttcaaagaactaagaagcgagtacagttgatcctcaaacaacatggatatgaa

SEQ ID NO: 5783 - DNA, 6937 bp, Homo sapiens
taaatgtttgtaacctggcttccctcttctccagtggtataaagaattgtgccgctttaaggtttgggtttttttctctccagtaaaaattttggtaccttatttgatgtttacattaaaatgtgacattatacgtggcaattcaaatattttgctagctgtcttgtttgaggaacaccattaaagaagaaatataatgtttgtcaaaaatgtatcaaaattcatcagaatctggggcagaaaactacccttgtttttcatgtctttcaattcttctaaaataccccttattgaacttgtacacaatataaaatttaaatagccatcttaaatattctaccatctaaaaattgctttgaatgaattttggtaaaatccaaaggaagatgtttaccctcttgaaacttatggtcttgtcacacatttaaagcaatatatgtccttattttcctgaccttgtaatactacttttatatttcagaggtatctcgaaactacaatataaacttttaaaaaaaaataagatgaggctggggaacctttcgaatgaacccaatcttcctgatgatccattcaaaaacaggtttttggaagaccactttcgataggcaatcctataatcaaagtacatttttaaaatcaggttgtaaaatggcaaaggtaaagaaaaattactgacatttcttctatgattggagtttagtttatgttggccagctacaaccccttttaatcctcagacagtttgggataaaagagtgcctttggttaatggttagcaagctccaggataagcgctgcgtgcctcttgtattcagctctacctttctgctaagagtgcggttcatttgtgtgtggctttgcgttccaggctgtgggtctctgtgtaaggtggcagacatagacttgtaaactgcagacgtgttaatggttagcataaatcacagctggaaaactgagccggcaagttacagcaccactctttctctgtatgatgtcagatcaccacatttagcaatgtcaaattttactcaacattctttagtaggaagaaaagaagaaaaagttttgccacgtagctatgtgcttttaagtctgtgacaaaactcaagacatatccgaatgaaaattagatctctctgatgtgaggatgttatggaaaataattttcccatcagtgattatccaccccccagcccccatatacaggactacaacgcaagctagataaatgttcaaaagcaatctgataatatgaagacagaattgtcaagtcagggctttcagttgaccccttgtcatgaggttattgcctaattttctgttttctatacttgaatctttaaaaaatatcagtttttaaattatttatatttatatttagttaagggtcatggggtcgtgtatgcaccccatcaccttatataaatatgttgatgatggaagctttggataaggaagctattaagttgtcatgacatccttgttctaagcagttatttctaaaaactaaaaataatagctacttattggcccaccgctctgctgtgagtatatgagtacttctcattccttatttccatagccagtcaaggattctaacgctgcttccatctgatactcttcttagattctgcatcaaatgcttattttgacttacaacaagcttactcttcctcagcattacataatgccatctttccaaccatgctttaaagaacctgctctttacgcatagtatcttataacattttgaacacgtcttgtgtaagaatcattgcaagtttccatcaaaatgaggcgtgtcttctgagtacagctgatgttctttgggtattacttgagtagtagtagcaagtacccataaatcagatttatgaaacataacttatatgctaggttcaacccttatatatgcatatatatgtatagtatatgtatataaaatttttttccagaaaacttgatgatagctctcagataataccaagtattaccagcttccatttcttcagagcagatttttttctaagtgaggttaattgttcacataatgtctttttacatctttgtcctttgtatcactctgaagttttctttttcttgccagaatatttgtttcactttttaatttcagtgctacttgagattttctttttttttaacctgaaagacgatattttggatgatagagtttgtaaagtgagccttcatgctgaaaaaattcttttcatgatctaaaaatggtcttttgttacgatttgaagaacctcattccgtgtaacatggatattttcttgtgtgtctttaaagggggttttggttgtcatttgggcatatgctttgccaaattgttatagcagaactttgtttttgattaatcagtagttaattattgaccatttaaactaacatgaccttaattttcctttcctcacacagatgtgctttctatccaggtcattttttacacgtgaaataacaaactgctttgtgtagattttttttttttttaaatcatcagattttagaataagtttaggtttaatgtaaacatcaactggtcttttcagttcagagaactgcagaataagtaaaataagcagaattcccactgaataagcattacctaattaaacatagcaacatctaagaccaatttatgaaaatactctccttttttatggaggcattggagctgctgagaaagctaatgaatttcccaactttgggataattaatatatagtattgtgttgctctagtgtagttgattttatgtgtttaatatttttcatgtcaagagcaaagctgcagacgtaaaagatgtttctctagcccccttagctagagcgagccacctttgttaagagtcagggtgtgaagaacaatttcaagataaattttagtatttcaaccattgttattaagaaaattagacttactgaaatactcatttaaaaacagacaccttctatagcattgttttatagtggagttatttttaaaaagggaatcccagaaagaatctataaaaatacaaggttaaaactttaaatgtattgaaagatacaaattggtgctttcaaatgtcatgtaagctagccattgtgtttttttttttccctccagctcctcaatggtagtaatttgtcttttatgatttaccgtacattatttcttgctcaccatccccttaacatatgaaaatccttaatttctactgccgcgctatatgtcttcctgaatctcaaggtataaatgtcttaatggatctgatttgtctccactctttgccatctgatccacattcaaaccgcctagaaattagaaagaataggtaatgttctatctacgatttcttgttcaaaatatcacgtagtggtgccaatcacttacaaagacaccatctccatcttgaaagagtaactggcatgttagtcttgaaaatgctcattatgatatgctcctcacatttcccatctgcttgaggatggacatttattagctgagactttaaagctgctaaattcacactttctactttcatacctttttaatcagtaatgtcaagaccattgttgcaaggagtgaatcttactaaacacatcctgttattactttaaactagaatatgagattcaagagatttaaaaacaattttaatgtaacgtttaaaatttttgaaccaattgagaatgtctactttggagtgaagtttaaggaaacagtcaccagagtttctaaaaattttttggagggaggtacctaatagaagaatctagacttagaaatgtgaactgtggttaaataccaaacccagttccgcagtggtcgtctaaagcgtctaaaactggagtgttaagaaaacccagagacattcatatagtttcagttatcagagtattagaccagactttatttgcaatttgttcaacagagagattttattttgatacagatattaagcataaagcatagtaagttttatataattctatgagttcattaaacaatattatgaaattttcattatgttcgtggggagtctttttaactgtttctacctcatatatgaggtctcttctgtattttactttgcatactagcatgtgattgcctgccttagaactatgtagaggaggggaaatcgatattaccttttaagaaatttttgattttatgaagtgttttcattaatacttttttaatgtttgagaagtaaaggggaaagggtggcaaattacataggttgcaacacagagtagaagtcacatagtactatttacagatctgtcctgttttaagatttgagaattgtgaacaggatggagcaatggttctcaaacttcagccagtatcagaattgcctcgaggtcttgttaaaattcagatagctggacccacccccagcatttctgattttggtctggagcctgatgatttgcatttccaacaagtttccaggcgatgctgatgctgccagtccaggaaccacactttgaaaatcactgggtctgattctcgcagtttgaaagtctcagagaccttcagagtctgaacgtcttttcaaccatgtatttatttactcagtgtaaaaaactgatctctggagacatttttataaatctggtgccatgactggaacatttgtggagaaaggtctccatggagcgacaggccctttggattggccaccacccctcctcactctcacccctgctggggtctgcactgctcttccgcagtagggtgaaggagctctttggttttagggtgagtttgcttttgtgtacgctgctgcctggacatcagtctggaagctgtgcatttgtttggtgtgcttagggtcaatcttgatccacatgcatggaagtgagaatcctggaaagaagccatcagaatgccatgagagtgcacctagcatgtatcgaggcactaagtgcaggagtccctgtcctaagatggcagtgacatggagcatcgaaaaccacagataatccttaaataataaaataatagttttgtttttttttcttcggggcagagtctcgctctgttgccctggctggagtacagtggcatgatctcggctcactgcaacctccgcctcccggcttcaagtgattctcctgcctcagcctcccaagtagttgggactacaggcatgcgccaccacgcccagctaatttttgtattttttagtagagacggggtttcaccgtgttggccaggatggtctccatctcttgacctcatgatctgcccgcctcgggctcccaaagtgttgggattacaggcatgagccactgcgcctggcaaatgttttagtttttatggttattattattttttttttttgtgggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaatgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttgga

SEQ ID NO: 5784 - DNA, 440 bp, Homo sapiens
aaaccctgaaagcccccgacacaggctgggcagtcccagaggaaggaggtggctggcctcccccacccccacgggctcgggaaggtcaggcccagccagcaggggtcagaggcggctcagctgtgcggctcaggaccccacctccgagggcgcctccgttggggccatggaggccgggctaggcccgcctaccgcagcccccaggggagttgtgtcagaagctgcggagtcactcggggggacactgtcctggggggcgtgggggaggcccccagcagggcccagcgggctggctggacgccgctccaggagggaggcgctcaggccggacaggaaggaggcgtctgtgatgatggcagcggtctctgccatccaacccaggtcaccaccggcagctcgtagtggtggaagaagtagatcatggaatgctgcgggaggga

SEQ ID NO: 5785 - DNA, 10938 bp, Homo sapiens
gcctacgggtggccgggcgggatgtaaccggctgctgagctggcagttctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggcgaatctggattgggaaagttgatattaatcaactcattattcctcacagatttgtattctccagagtatccaggtccttctcagagaattaaaaagcctgtacaggtctacatattggtatttttaattgatgataagctggaataatattaatacacacaaagcacgtgttgtaactttcattatgcttccctagaggtaagatgcaaatttgcccttagccagtgtaagatggtaaatatgacttcataaaatcaaaaaaacagaggaagtacagttaatcgaaagaattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatagtgttctatattagtcagtgggataataccatatcatagttgaatggcaatagcaattctgtaaaactcccatgctatatgtgatctaatttactgcttctcagtctttgctacgcattccaatcctgggtatcctgttaaatttatttcttctagtagttctgagatgggctgcctttctacatttctaacaagatcccaggtgatgctgatgccgctggatggtagatcacactttataaagcaaggggctagactctagatatgcactttttattaaatagtacagcagcctgtagccacatgtggctattaatctttgaaatgtgggtagtctgaattgtgatgttctgcaaatataaaatatgccacagatttctaagactgagcatggaaaagaaaatctccgtaattttttatattgattgtatactgcagtgataatattttggatgtatcgggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatgtaggacacgagcagagaggaggcacgtgaacagttctggctgaagtaggcttcattgaggccgtgatgcttttagctggatttgaagaagtggtagtgagcatcccagtgcacaggataggaggacagtctatatattctgagcagtaactcatatatatcatactgcaagaccccaaaggagtaattttttgaagtaaatatcttatttctcctttttaatgtttctattttgggaatttttttttttttagtaaccttcatagggcttgagatttaaaattacctgcaaaattctactctaaaaacttgatcctacatgcttatttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcactcgcattcagtattacaacccccaaagataaacaccttactgactgccttctccataaatttgcctgttcttgaacgttatatacgtatacttttttgtatctgttttctttcagtgaagattatgtctgtattatttactcatgttgggtgtagttgtttttttcatcgtcgtataatactccattgtgtgaatgtataaagtatatcctttattatttattgtagataagcctttgggttttcagttttttactaacgggaacattcttgtgcatgtcttagtagacttaggcactcattgctgttgtgtgtgcataaagatataaaggtatttgagtttattttatttgatttctagtgaggttgaacatgtcttgtactcaataactgttcagatttcattaaagtcttttggtaatcttaatattttctgtcattttcttgctgatttataggagtttgaaaaatctaataatcccctacattttagatattgcagacattttctccccaggtgagcatctgttaaagatgtgacatgccctcaatttattttagaattcttacattggcttagcttcaaaataaattgcctaaacccattttaccttcctttaaagtaacacttcaaaaatatcctcttctgttgtgaatatcttcccggaaactctctttatcttgaaaacaaaggggtaatggaggtactagagaatatctctagtaggatttttaagacaggcctgtgcaccactgttaaatatcttttctgtaccaaaaagaagacctgtaacatttgagaaccagattgatccttagtagaatcctgtagaagtcctctttcctgattgaaccatagaggtgtattcctttatatactgaaaactagctgaagataatctaaactcttgtgcccagttaggaaagaacatgccatattatggacagggtcagagtcattcaagaagcctgaatatagttagaaaatgagaatgtaatctttttaatagttggctggctctttaccaagcccagtagtcttgaagatataggggaaatagtgtaaacggttgtcaagatgaatctaaaatggaaattaatcagttccctagaatagattgagaaattagctttaggaaaaagataaatttcacacacactgtaccatggaaggtacagtgctgattcagacagactgggaatggtctcatttttaagtggtgatgtgaggtacttcactgagcattgtgacaggcacgggcttgggaagagcctattaggaaatgggagaggcatgagactaaggagcacataagagtaatattagcagagaaattctttttgaggttgaaggtcatgaattttatggtataggaatagaaagaggggttaatccagaatgggatttgagttggaaagggaaagaaataaaggttttgggaaggaggttgctaatagaaaatgagaggggcaagggatttgaggtctcagtaaggagacagggatatgaggagtggagaggttcagaatagaaagccaaattagagttttgggatcaactttcttctcagtaaagtagtcctgggtcttcgtgagaaggaagtattcttcaggcataactgttctactattggttacttcctctttcattgtcttgtggaacacgatgaaacatttaagatgatattcatcttttgagccaataaataagggaaatagatagtttttgtgtttgagctaagtggagtatctcaggccattccaatgtcttcagagttttggctgtaatgctacctcttgagcaagtgtaggtagaggtaagctcttgacagaaaattttaaccctctcttcaaaatgttatatgcttaattaaataacttcttaatttaccttaataaatggcgtataaacattaagttagaaaaggttagtgtatatgaagctgtataatcaacattgtttgactttttttcctcagattgtaaaactgaaaactcagtatactaatactcttgtatactgtatacactcagtattagaaaatgagtacctttgatttctggaatctcggatgccaaaagaggtctcaatagatgaattatacatagatgattcatagacgatagttttagttttatttatttttcagggaaaaacatttgacaatgttcttgattcatttttttggtattaaattatgcagctaatcttagagaaccctgagtgatgccataaaagatgttgatgtggcctgcttaaggaaagtgcacgggaaagtggccatttggaatagatttgttaagaaaagtttgaaattcttggactcgaactaatttgttttccatggatcccatgaggatacttgtaaaagcagatgatagggtccagttggatcctgtgaatggcactagtttgcagttatgttttctggatctcttccatatgtcgctgacttctttgtatttgaccatgtatggacatacagaatttcataggccagagaagaaaagaagctttataaacattccttatgtgtgtaaaatacaaatcttcatttgtcttagcaagtcaataagtaattaagttgttgaactgattttttttttaaacagggaaatatcttaaaatttaagctgttaggttaaaatgtgtgtttggtatacagcatattactgaaggtagaatgggcttcatttggtaataaaggaaccagaaatatttttaagtaaaattgggagatgattcatgtagattaactatatttttgtatcactttctagaatacagtactatgttgtttaaaagagtaagtaggtaaaggagtggtataattactttggatatttctgcgtcagccacagttaccatgaataaatgatctgtctttataaaggagatggaagtgaattcaagatattgagatgttagatttgactgggttgtcctttgactagaagatcaccagataaagaaaatgtaaacttcctaaaccagataagatgatattgttaaaaaatttttttggcccagcactttgggaggctgaaatgggaagattgcttgaacccaggagtttgaagctgcagtaagctatgatctaccatgcactccagcctgggcaacagagtgagaccctgactaaaaaaaaaaattttttttcctttggttctcatgatttcacactgatgaatctgattgttttctctgagtcattttgcctctctcatgttattagggtaacctgataatagacatgttatctgagttatgtggtatgtaacagtgatcttctaaatgatgtgcatccatcactgatactgaggatgatcagaaactattacaactcttatttattgatctttacttttaatctacagataaatgataatacatattaatacttaatattcagattgccaatagtatatatttggtgggtaaatatcttttggatctgcaaaattttcactgatagtttgtatcaggatcaaagcagtttgaagaacattaatctaaaagataagactttggcatctcatttctctaaaagataagtcatgcatgtacacactcaggcaatttttttcagttttataagttttattcttgataataaaattcttttaacagaaaactcttgattgctatagacctctgctgtgtattcagtagtcactagccacatgtggctatttaagttaattcaaattaaataaaattaaatatcagttccttatttgcactagtcagattttaaggagtaagtagccacatgggcaagtggctaccatattggacagtgtggatacacaacaattccatcatctcagaaagtgttattggatagtgtggctacagacttttcttgctcagcaatcttagtctccgcatgttagtctcttcatgcattaggtagcatctataaaacatgccaaaaggaaataggctatctctaaaagtgtcccaaactttttgtcttgtaaattagcttatcagcatacttggagcctcttgccttaaaaaggacttgatataaatgtgtatcaggagaaagcctatcttatgaaggaattattccctttttatttgaatccatgtttgctttatcttcggctcctgaaaactgatactttgcatttaacagcagcatatgcccaggatgaatgataatacatctcctgatacagagcttgaggttacagaatatcttaaattgttccaggaactgttgttatcatttaagtccaataatcagtaagatttcaccctaccagaatacacttttttttattaactgtctggacctttgctgattacattgtccggaatgtggagtatcgcatttgagaagaggattggatcctagccataacataaatataagggtaattacatccatgctgagaaagatttaggaatgatagtaagttcatttgagtgagtggtttgggccaaacttgatagagaatagtccaggaagacatttactataaacagtagattaaatgttcttgcctggttaattacatttgaactctgttaatgactgaatcactcaaactgcttaattgtattattagatgcacatttaagttatgtattacatgtctttagtggtgatcagaattttatcagttcctctgtctttctttataccaagtatgactcataaacccagtattaatttgccaagagattggcatactatttgtatatatgcttttctttcaaataatctggattcccaatgcccacaatcattgatcctaaagaaaatgtgagagtaggtagataaactcaaacatccctaccatcacccctggtaggaaatcactggtgtaatgtatgatattaacatctgcaccaattactcttataggtggaacaatccaaagttttaatcagagaaggtggtgttcagttgctgcttacaatagttgataccccagtatttggagatgcagtggataacagtaattgctggcagcctgctatcaattacattgatagtaaatttgaggactacctaaatgcagaatcgcaagtgaacagatgtcagatgcctggtaacagggtgcagtgttgtttatacttcattgctccttcaggacatggaccattacataactgaagactcccaccttcaggcaggtttgggtagtacacgtttgtaactacctggcattgccttttgttgaagtaatttcagtttttattagtagtagtagtagtatactttaagttctacagtatatgttcacaatgtgcaggtttgttacatatgtatacatgtgccatgtttgtttgctgcacccattaactggtcatttacattaggtatttctcctaatactatccctcccccatcctccatgccacgacaggccctagtgtatgatatttcccgccctgtgtccaagtgttctcattgttcaattcctacctatgagtgagaaatacctatgcggtgtttgggtttctgtccttgtgatagtttgctcagaatgatggttaacagcttcatccatgtccctgcaaaggacatgaactcatccttttttatggctgcatagtattccacagtgtatatgtgccacattttcttaatccagtctatcattttatggtgttctcagtttatatatttaaatcactaaactgactctttgacttaaaaggctcaaaaaaagtcatctcaaaaatacaacacactttataaccttttataagtatttgtgtagcttcttgaatttatatttttaaatcattctcatttaacttgtcagggccttttcctgaaagccaggagagtgaaatcttaacctgcagttaagtcaataaaatttgtcagcttataaccaattttattattttagattttctggactctctccaactacagtaattctcatgaaatcacattcctgccatccccttggggaaaattttatttcttaaaattgcatgggaaatgagagcttttttaaaagaaaaaaagttttatattcaaatgatatgtagtggctttgtgccatttcttattcatcacaaggggtaagatgtttaaaattgctatatcttatatataaaaatgtacctttgaataatttctcagtttaactatttttagaaatggagcaaagttttgcccattggtacatgatattgtggattaagtgaaagaatatgaggctgggtgcggtggctcacgcctgtaatcccagcactttgagaggctgaggcaggtggatcacctgaggtcgagagttcgagaccagcctgaccaacatggagcaaccccgtgtctactaaaaatacaaaattagctggccgtggtggcgcatgcctgtaatcccagcgactagggaggctgagtcaggacagttgcttgaacctgggagatggagtttgcggtgaaccgagatcacaccattgcactccagcctgggcaatgagagtgaaactccatctcaaaaaaaaaaaaaaagaatatgacacagaattttatgtatagagttccaggtaccctgctcactacagactgaaattctgtgcagtctaataaatgaatcagagcctttccatcttgtctgggtagtccctaggttccctttttagagggttttgtttttagagtgattataaattcatccaacagtgcactttcagtgcctcctacctccctctaccaagtatgaactgcatgcatggctgatatatgattttggctattatcgcttcatgtgcattgttcactattttgtaactgttattaaagtaaaatactgacttggaacatgaattttaaaatggtgttttatccttctagtattgattcccacttttagaaaaattggtgtcattcagtgagttttatatagaaggattttttcccttagaaatacatacatacatacatacaaaaaaaatttgttattttccctgtagttgtttattatgctgtagaatttgaggctaaatagtcttttctctctgctgtgggtttatcttctagaaatgataaaggattttctattgcttaaaaacaagatttaaaaactaaatttgttgacgaaaagactagccaatataaatctaaatggacagagggaaaaaattcaaccagaatgtaatacacatgtgaactaaatgttttctgttgctgacgttttgtaggcttctgaaatttaatgagacttttacaaggtttaccttttttcctagagtttaatttttaaactgacttaaatgttttttgacactttggttatatttaagaagttgacttctctaatttccttgtcatgtttatttttaaatatctttctctttaaaagttgggatactataataaatattcagcaagtattttgtgtttaaatataaaatcttgttatttggattttaatactttatatatagtatttatatataaatataatataaacaaaactaaagactctatgaaagaatcaaatggattttctataactgaaaatttcaatgactaaaattaagatattaccagataggtttaacagcaaattccataaagttggtaagaaaacaagaatactcaaaaaatggaaagaagtagaaaataaaagcactgagaagcatagaatgcaaatttagaaaagagcttaagagacatatcagacatggtaaaaggtttaacacacatataatcaaattttcctagctctgttcacggaaagggcctgggagctgcaacacctcaacagcaacgagcacacctgctacctagaacttggtttctaaaaaccatcctcctctaaaaggaaacagagctctttgaagaaatggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatgggacaatttgaacatcagaataaaatggtgacagtcacagaattataacccattgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacatgagaatcttggcagaaccactttaatcaagaggtttagttgagcattatcagtaacagagtaaatcaaaatcatgagccacttgatagatacaatgagaaaataaagcatcacttctgtgacaccctataaaaaatgaatctaataatgaggaaacattagaaaaaaaccaaactgagggatattctacaaataaatggtcctgtaatcttcaaaaatttcaaggttataaaagtcaagaaaaacagacaatcttttccaaactcaggggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggttttttagaatgttctagtcaacaggtaatatgaattaaactaatcgagggtgacagggcattatatcagccacttatcaacaaacatttcagagaaaaatagttccttgtattgttattgcaattttctttgagattgccccctccaaaacagtaagaactttcaaaaacaaacaaatatatcaagccacagattcaaagtgctataaactccatgcatgattagttctcactcataggtgggaattgaacaatgagaacacatggacacaggaaggggaacatcacacaccagggc

SEQ ID NO: 5786 - DNA, 1402 bp, Homo sapiens
ctctcttctgtagatctagagataacgagtcctaactctttgccaaggatatggcaaagactctgatggaaaaggcagtaatgtgtacacaaaggtgaacataaataaatgtgtgtatgataaacgctgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattatatcacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagctaacgacttgttcattatgagtgatgatggataaagacttctcatgctgagatgaaatcaagatttatatgcattgtttcctctcccaacttgtgggaagatcatcatcatttaattctatctctgcggccagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaatctttgagctatttctcaagatgattatttctcaatcctggtatatatcctttaaatatcacagctaatactataag

SEQ ID NO: 5787 - DNA, 1100 bp, Homo sapiens
tggaggaaagtaaggatggcctgagcctgcatatggggctgagagccagccagtatctgtggtgttaaaacgggttgaagagggagaaggctgtgagaattaaaagccttatgagtcaggcaaggcaggggagatgggaagtcataggaacaaagcatctgtatcttagaataatggcttgtttatataagtcacttacattacaaaattatccttcactgtattttatgggagaaagttacatgttcaagttgggtaaaggtaaaagtcacaagacataatccacaatattagcaaagatctacacgataaatgcaacacttatgtggcttaccctgatcctttggaagcaaatagtacactgcaataaatgccttgatggcagcatggacttgttcacagaacttctgggtttcctatgaaaggtccagaacagtgtttatgtatcatttgtgtaaaaagaagctgacacatgcataattttcaagtattttctttgatggagatgagacctgaagttgtgaccaaagcaccgctgcagcaagctccaacacatgtaagccatcaaggggatgttaaaaaacgccagctggaaaagaacagaaccatagcttactcccaagtccttggaagaggttcactcagtgctcaatggtgcccaggctggagtgcagtggcgtgatctcggctcgctacaacctcgacctcccatgccttgggatcctgttgatctgtgaccttacccccaaccctgtgctctctgaaacatgtggtgtatccactcagggttgaatggattaagggcggtgcaagatgtgctttgttaaacagatgcttgaaggcatcaccactccctaatctcaagtacccagggacacaaaaactgcggaaggccgcagggtcctctgcctaggaaaaccagagacctttgttcacttgtttatctgctgaccttccctccactattgtcctgtgatcctgccaaatccccctctgcgagaaacacccaagaatgatcaataaaaaaaaaaaaaaaaagaaaaacctcaaggagaacaagttggtgaaatatctctccatcatttcaggaataattgatt

SEQ ID NO: 5788 - DNA, 2717 bp, Homo sapiens
gagacgtgggcggtcccagtgaccgggagccggagctcgaacgggacgggcgaacagaagcgcggagggcttcgcagcgtcggcgtctgtgcgtgggccaaacatcagggcctcgaccagggatacaagggcaaccgctaactagattcctgattcctgatggctggcggcggctgacaccaaaggtaaaaggccttttagggaaagaaaccatttgtgaaaagctcttgggctaaactcgctctgcaaactgggggcgcacgctcgtggccaaactctggcagtgggactatcccggagcacccgatccctggaatcatgttctggaaaccaccgcgacgtgcgcagttctcgggcgtggccctggtatcatcccactgaatcctaggaacgcggtgcggtaggtatcactgtccgcatttcacagaccgaagtccagaatggggaagcgacttgtcttaggcttcctggccacactggggaccgtggtcatggtagcgtccttggacacctgtctccaaggctctgcagaagggggaggtgccgggccctgacggctgatgtccaaggaccagccgggatggaccagccccaggaggccccagtggaggaaaacaggacgaggttttcagtaagatgatcttatactaattcaagggctataatttgttctccacatcgtgtgcctccaactttttcggggaaagggtgttaaaattccgttacagtgtttttacttgtcaaattagaagcagcaaccggctgggtgcagtgagtcaagcttggaatcccagcactttgggaggccaaggtgggcggattgcttgagctcaggagttggagatcgtggcatcgataacatggcagaacctcatctttgcaaaaaatacaaaaattagccaggcgtggtggcgcacgcctgtggtacccactactagggagactgaggtgggtggatcggcttgagcccaggtcaaggttccagtgagctatgatggcgccactgcactgcagcctgggtgacagagcgagacccagtctcaaagaaaagtagaaagcagcaacccaacttggctccccaaatgttggaaggtatcttagcttatccttgcattctcaaaggccctaggcccttctggatacatggacacaggcatggtagtccctgcaggcaggggtagtggggagctgcaacctatcccaaaactctagagatgctgataggaggccaagctctgcaccctaatatcctccagctgtaccctctgtggatcagagtaaagtcacatccttgggacaccatgtctcagcagagctgttaaacataggcacagtgaaattaggaaagtataactataggcaccctacagcacagctgagtgtcagatacttccactgacacactgacatgctttgtgttttagttctcacaactctggggtattctcaccccccaaatggggacatgtgcacaggagtgaagagatgagctcagagccacacagctggtgggtggtaggcctgggttcaacctcatcctgccttcaaagccactttgcccatggccttttgttggggaggggagtgtgttctgcaccaagcttttgccaggaatccctgctagctctcaaactggctctggactgactgtagtcttacaggctggaaggaacctttggtttgccctgtgagactgcatgtcttaaggtgtagctgtttcttcatttgtgaaattaagcagatatgggtaagatgacctattccaaagtgaaaaactggaaaaccaaagtcttagcctacagtttcagggacgagggggaactaaaagatgagcactttatagtcaagggagaaaaatttttttggagtcagcaccaaccagctaataaggcagctgggggccagggccatggggtggcctttcagacacacacacacagctctgagcctctgggccataccttgtaagaactaggtattttgttgaggtgggggtagtcactgagacctgtgctatgggagcctcctacagagggctgctctctaggccaggtaaagtctgggtgagacaagaaaacattccttaatgtggccctgaatgaataaaatgtggaggtcctcccaaatgcagcagcaggctaacaggtggactgcaaggctgtgccctgccctgtctccctgcattgcagctgttggggtctgggtgttcctggctaataatccacaatccaggaaagggctgatttggttgtgaaggtccaaatgagaaaagattctcagactggtttgtgcaaatggttttttttttttttttatttccacatttatatcacaaggtgtccacttactggaccaaatagcaaagttgctcccttctgcgtcctgagaacacagaagtctaggtactgtacattcactaaggctccttgtttttgcaaatcgcgtttatgacaaataaccataaggcaaacgaatctaaaggaatggttatgagtgtttccagcgtacagacaggtcttccccctcgccccacagtacagcataaaaccagtagcacccacaataacttttgtgttgttttggggggactctagaaaggtgaagttttctagatgtgtacaggaagggaaaaaagaaaagggaggaagaaaggaaaggtttttttgtctggtggtctgatggaagaggaattgtttaaaataaacatgagaaaactt

SEQ ID NO: 5789 - DNA, 673 bp, Homo sapiens
atccatgaagtcatgcttcacttatgcatcattcagaaaacacttcttggatactcactactcatgaatatgcatgcatatgacttgcagtcaaagccatgagttctcaatagcaaaactgttccagatatactcagagagttaaaatgtttaaaaaacttttttttaaagaaaattttccttttatttttgttgttttgttttgtttttttttagaagcaagatctcactatgttgcccaggctagagtgcactggccattcacaggcacgattatcactcacacactatggtcctgagatcctgggctgaagtgatcctcctgcctcagcttctcgagtagctgggactagaggcatgtgccactgcacctggcttagagtataaatttttgtgtcacacaagatatgaagaacatgcacaggcactggacccatctgtgggttcatctttctgtgggacccactaagggacccatctttctgtgaaaaagtcacaagtgaagtcctggccaggaattcaagaccaggctgggcatcatagtgagacctcatctctacaattttttttttaaaggaattggcttctagtcaatgctttgtcaaataccagtcttgggacattagatgaagctccttcatctaatgtttttctaatacataaaacagtaata

SEQ ID NO: 5790 - DNA, 17953 bp, Homo sapiens
ggtgtagcccagaagagagtgatggcggcgccgcccaatggacgcgtgggtggaagggcccgagcctcctcatccaccccctccttccgccccccacttgtgcatgcctctgcccccccgggccgcggaactctcctggggcgaccccgagtcccaccccgctgctccgtgccgtcctcgcagctcgagccctcctccagcccagcagtgctcccgcagcgtctggccgctggtcgtcggcagacgaaagggcttgaaccgcggctgaccttagcctttgtccctcggcctagttccgcagctgccgtcgaggccgccagcccctcccccagcatgtttgggctaagccgcctcctttccgcctgcgttggagagagaggtaccagaaggaatgaaaggactggggcttgtctccatggcaactgaaagaaagagagaaaaattggtcacctccaggactgagaccctgacccttccaagcatccccactaccaaaggctgcccaagcccggaaggatcccatcccgttctgtactctgaggtcacttcctcactccgtcaaatttcactggactgtgggctaattaaaagtgcctccgtattagcggggcgtggtggcccatgcctataatcccagctacttgggaagctgaggcaggaaaattgcttgaacccgggtggcggaggctgcagtgacccaacattgtgcaacaagagcgaaactccgtctcaaaaaaaataaaaaataaaaaagagtgcctccctggggagactgtaatgcccactgggcagtgatcctaatgccccttgggcagtgatccttattcccctctcccataatgattggttgtagcaggctgaacaaaaaggttgagcttcgcttgtgcttgctgaatagaattctcacgcccactccacgttagctcccctcactgtaggactagctctgaaaattctagctcctgtaggaagccaacacagacggatctacaagaaccaaaaacagctatagctactcttctaaatctcagtgcctgacattgcctctctttctgcctcctctctccaccccccaaaaaatgtggtcctccttgacctgagggagcttccgtccaagtctgagctctgatcatcctgaagaatcaaagtatcatcatcccttggctggcaagatgaactccaacatcaaaacacttgaaacagtagtatttttacacaatttgcccactgcctctacatctcacttagtccttgcagtaacatttggatgatgaggtaacttatccagaagcacaaagcctaaagaatgacagagcttggactcctgagaagttcagctactgcccgccttatgataaccaaaagaaagcggccgggcgcagtggctcaactcctgtaatcccagcactttgggaggccgaggcgtgcgaatcacaaggtcaggagtccgagaccagcctggccaacacagggaaaccccgtctctactaaaaaaaacaaacacaaaaattagttgggcgtggtggtgggcacctgtaatcccagctacttgggaggctgaggcaggagagtcacttgaatccggtaggcggaggttgcagtgagccgagatcgtgccactgcactccagcctgggagacagtgagactccgtctctaaaaaaaaatgaataaataaataagaaggcacaccacaagttcgagaccacttctacaaaaaataaaaaataaaaaaaattaggccaggcacagtggctcatgcctgtaatccaagcactttgggaggctgaggcgggcggatcactggaggtcaggagtttcagaccagcctggcccaacatggtgaaaccctgtctctactaaaaatacaaaacttagctgggcgtagtggtgcgtgcctgtaatcccacttactccagaagctgaggcagaagaactgcttgaacctgggatgcagaggttgcagtgagctgagattgcaccactgcactccagcctgggcaacagagtgggactctgcctcaaaaaaaaaaaaaaaaagaaaatgaagatgaccaaatgggcttctagatggctaatgatattctgtttctttgatctgggtgggggttacatgggtgtgttccctttgtaatatgttatcaagacattttgtgcacttttttgggtattatactgaaagaaaacatttattttttaaaaagttgaaaaattgccttggagcagagtaaggtaaatctatgattaagcttagatttttttattttttattttttattttttttcaaaaaaaatgaggccaggcgcggtggctcacgcctgtaatcccagcacgttgggaggccgaggtgggcagatcacgaggtcaggaggtcgagaccatcctggctaacacggtgaaatcccatctctactaaaaatacaaaaaattagccaggcatggtggcaggcacctgtagtcccagctactcgggaggctgaggcaggagaatggcatgaacctgggaggcagagcttgcagtgagccaaggtcacgccactgcactccagcctgggtgacagagcaagactcgtctcaaaaaaaaaaaaaaaagtaaaatgaacctaacaagaggcatcctttctctgtggttattatagtgagaactaagttctttatcactctccggttatttacccctagagagaagccaactttctggttgtatacaccagaataagtacaagaatggtaagcatagagcttcagagaaactagccagattctaaaggaatgacttgaaaatcgagagccgtttcaatgacaaaacatcatacaaaatattcatctaccacattagaggcctatcgctaggtaaaaacaccaaaacttcagcttaaacagtagtatgtatgtatgtattatcccagtttctgtgagtcaggaattcaggattgataagctgggtggttcttgttcagaatctttcaagaggttgcagtcctctgaaagtgtagtgggttggggtatccacttccaaggtggcttgctcatatggctggcaagttggtgctggctgttggcaggaggcctcagctcacaatgcaggctttcataggactacgtgagtgtcctttcaacatggcagcaggccttccctagagctagtgaaggatgagaaaacgacaaatcgcaatgtcttttatgacctaggctgggaagttatactccatcatttatgcaatatcctgttatcacacaggtcatccctattcagtgtaggttggtactacacaaggacatgaatatcaggaggaagagaatctctggaggccatcttggagcccatagtccgccttctgccccctaatgattcacgtcttcgtctgttcctgctctctaagagccaggaggcagacttcccttgagctttcttgcagctaaagtagagcatcattagcagtaaaaattaagatatcatcacaaaggccaggcacagtggctcaccatcttcccactttttctcattgctttattatgcttgcataactgttctaacaaaacaaatctcacaattctctagataagccttattcttacccagctttggctcatccttcatctctacatcttttttttttttttcttttgaaacggagttttgctcttgttgcccaggctggaatgcaatggtgctatctcagctcaccgcaacctctgcctcctgggttcaagcgattctcctgcctcagcctcccaagtagctgggattacagggatgcaccaccacacccagctaatttttgtatttttagtagagatggggtttctccacgttggtcaggctggtcttgaactcccgaccacaggtgatctgcctgcctcagcctcccaaagggcatctctacatctctacataaaattccttcccgccacatttctgcttatcaaaatccaatccaacttctatggcatggcccaaatgatacctcctccttaatgtcttcattgattaccacagttcactgtaaacctgatctttttttttttttttttttttttttggagacagagtctgtctctccatcgcccaggctggagtgcactggcgcaatctcagctcactccatcctccatctcctgggttcaagtgattctcctgcctcagcctcccaagtagctgggactacaggtgcatgccaccacacccggctaatttttgtattttttagtagaaacagggtttcaccagtctggtcttgaactcctaacctcaggtgatccacccacctcagcctcccacagtgctgggattacaggcatgagcctctgcacccggccaaccctgattttttttttttttttgagacatagtcttgctctgttgcccaggctggagtgcagtggcacgatctcggctcactgcaagccccgccacccaggttcacgccattctcctgcctcagcctcccgagtagctgggactacaggcgcctgccaccacgcccggctaacttttttttgtatatttagtagagacggggtttcactgtgttagccaggatggtcttgatctcctgacctcgtgatccgcccgcctcggcctcccaaagtgctgggattacaggcgtgagccaccatgcctggcccttttttttttttttttgagacagggtctggctcagtcacccaaggtggagtgcagtgacgcaatcatggctcactacaacctccacctccccggctcaagcagtcctcccacctcagccactcaagtagctgggactgcaggtccacaccactatacctggctaattttgtattttttgaagaggcagggttttacaacgttgcccaagctggtctgaaactcctgagctcaagtgatccgcccccctcagcctcctaaagtgctgggattatggtgtgagccaccttgcccagccttatgtcactctcagtggcatttctcgtacttcctggtcctaagattcttggtgtacacgttgtataatcccaactagatatgagagctatcagattaagactttgcatctttacatcccccagtacctttcagagtgtgagtgcacacacaccatttgctaaggaatgattgcagtgacaataccaagtttaggatcccttaaaatacctatatcttgggcagaggttgcattgagctgagatcatgccgctacactcagcctgggtgacagagcgagactccatcttcaaaaaaaaaaacagtccgggtgtggtggctcacgtctgtaatcccagcacattggtaggccaaggtgggtggatcacaaggtcaggagttcaagaccagcctggccaacttggtgaaaccctgtctctactaaaaatacgaaaaaaaattagccgggcatggcggcggggcacctgtaatcccagctactcaggaggctgaggcagagaattgcttgaacctgggagacggaggttgcagtgagccgagatcacgctactgcactccagcctgggcgatagagcgagattctgtctcaaaaaaaaaactacatcttcatagtggacatatttgacatctacccaacttacaaccattcctcctatagatcatagattaggccccaacagccatgtttgtacctcctaaaccccaccaccttggaatagagacttacttctcaaagtgtgatgccacattcctcgtggggtcaaagaagcagaaaaaattggtttgcggccgggcgcagtggctcacgcctgtaatcccagcactttgggaagccgaggcagacagatcacctgaggtcaggagttcgaaaccagcctggccaacatggcaaaaccccatctctactaaaaatacaaaaattagctgggtatggtggagggagctactcgggaggctgaggcaggagaattgcctgaacccaggaggccaaggttgaaatgagccgagatcgcaccgctgcactccagcctgggtgacagtgcaaaactgcatctcaaaaaaaaaaaaaagtaggtttgcacagagctccaagagtgaacagatgaacagaacagaaaaagcactttgccagctctcccagtcctgcctgtttctatccattccctaggctgaatacattcctgtctgtgttccatatgtctccccccgcaacattaaaataagtttattaagtctcccgccccatattttaatctagcttacattgtcttctgttacttggaaccaagagtctttttttttttttttgagacggagtcttgctctttcacccaaactggagtgcagtggcacaatctcggctcaatacaagctccgcctcctgggttcatgccattctcctgcctcagcctcctgagtagctgggactacaggcacccgccaccatgcccagctaatttttgtttgtttgtttgtttttagtagagacagggtttcaccgtgttagccaggatggtctcgatctcctgaccttgtgatccacccgcctcggcctcccaaagtgctgagattacaggcgtgagccaccgtgcccagctggaaccaagagtcttaattaaacaatcatgatggagaccaagcccacatttttcaggtcacctaatcctggcctctccatgatccagtaacctgagttacagctttcctaccataaggacttagagctaatttcttaaagcctgtagtggaggctgaggcgagaggattgattgacacaaggagtttgagtccagcctaggcaacataccaagacccagtctcttaagtaaattttttaaaaaatcaatttagtttccaaatgagatcaacatattaacatattatatttgattgctttgccttttttttttttttttgaggtggagtttcactcttgttgctcaggccgaagtacaatggcacaatctcagctcaccacaacttccgcctcccaggttcaagcgattcttctgcctcagcctcctgagtagctgagattacaggcatgcaccaccacacctggctaattttgtatttttattacagatgggtttctccatgttggccaggctgatctcgaactcccgacctcaggtgatccgcctgcctcagcctcccaaagtgctgggattacaggcatgagccaccgcacctggcccaggtttgatttctttaaaagaattcttcacaggtgctatttacctttttaaacattatttttctatttttgttttgtttttgagacggggtctcaccctgtcacccaagcaagagtgcagtggtgcagtcacagcttactgcagcctcaaacccctgggttcaagcaattctcccacttcagcctcccaagtacctggaggtacaggtgtgcaccaccacgcccagctaattttttttttttttttttttttagagacaagggtctcactatgttgcccaggctggtctcaaactcctggcctcaagcgatcctcccaccttggcctcccaaagtggttcccacttataagtgaaaacattacaggtgtgagccaccatgtctcactatttactttttattcatctcatcaagagaagagaaattcataacattaactacttacgttaggggctacagcccctaccgtaattttctaatcaggtagtttcttctatgcttggttaactggaatttgtgtgtgtgtgtgtgtgtgtgtgtgtgtgtgtgtgtgtgacagagtctcactctgtcacccaggctggagtgcagtgacacgacctcagctcaccgcaacttcctcctcccaggttcaagcgattctcctgccccggcttcccgagtagctgggattacggctgtgcaccacgacacccagctacttttcttttgtatttttagtagagatggggtttcaacatgttggccagtctagtctcgaaatcctgacctcaagtgatccacctgcctggcctcccaaagtgctgggattataggtgtgagccaccgcacccagcctaactggaatatttctataaagaatcttccctcatcaactctttgttatcctgaagtacctcaacctcagcctccagaggagctggaactactcaaatagaaaaggcaggatcaattctttccctttactgaccagttttcagaatgagttggtttcctggggcatcctctagaggtcaacaatgaattctttttagtattatcatgaactggtggctttttttttttttttttgagacggtctcactctgttgcccaggctggagtgcagtggtgcgatctcggctcactgcaacctccgccttctgggttcaagcgattctcctgcctcagcctcctgagtaactgggactacaggcaagtgccaccacgcccagctaattttttctattttagcagagaggaggtttcaccatgttgcccagggtggtctcgaactcctgagctcatagaatccacccactttggcttctcaaagtgctgggattacaggcgtgcgccaccatgcctggtgttttttttttttttttttttttttttgagacggagtctcacactgttgccggggctggtgtgcactggcgtgatctcggctcgccacaacctccacctcccgggttcaagcgattctccttcctcagccccctgagtagctgggactacaggcgcgtgccaccacgtctagcttatttttgttttgttttgttttgtttttttgaggcagagtctctgtcgcccaggctggagtgcagtgacgctatgtcggctcactgcaagctccgcctcccaggttcacgccattctcctgcctcagcctcccgagtagctgggactacaggctacctgccactatgcctggctaattttttttttttttttttttttttttttagtagagtcggggtttcaccgtgttagccaggatggtctcaatctcctgacctggtgatccgcccacctcagcctcctaaagtgctgggattacaggcatgagccaccgcacccggactgtatttttttttttagtagagacggggtttcactatgttggccaggctggtctcaaactcctgacctcgtgatccacctgccttggcctcccaaagcactgggattacaggcgtgagccaccgcgcctggccaactcatggattttaaaagcctatttgatgagtttcagtccactggagtcaggtctttttttttttttttttggaagtgctgtgatcgtgactcactgcaacctctgcctcccaggttcaagcgattctcctgcctcagcctcccgagtagctgggactacaggcgcgtaccaccatggccagctaatttttttgtatttttagtagagacggggtttccccatgttggccaggatggtgtcgatctcctgacataatccacctgccccggcctcccaaagtgctgggattacaggcatgagccaccacccagcccaaagattctatattatatatacagttttccactttttttttcctcttagcaaaacatcatggagttcactccatagcagtatagagatactcatttctattcacagctgcatagcactccaatgtagatataccttggtttattgccaatgttctgtagatggacattgtctgagttatttccagtcttttgctatttacacagtgggctataatgactagccttggacatatatctttatttttgccaatgttatctttggcttagactactagaaatggaattgctgggtcaaaaaacacatgcatatgtcattttgtaggacagaatcaaattcccctcctgaagaggcagctgctataatggtgcttccagtggttcctacttctgggtaaattgccccttgactgcaatttacagaagtgatgggagtggatgcagaggctcctgcctgtaatcctagcactttgggaggctgagccaggaggatcacttgagcccagcagtctgagactaacataggcaacacagtgagaccgcatctctactaaaaatcatgaaagttagccaggcatggtagcgtgtgcctctggtcccagcaactcaggaggctgaggtgggaggattgcttgagcccaggagtttgaggctgcagtgagacattctactccactctactccaacctgggcgatagagcatgcccttgtcttaaaaaaaaaaaaaaaaaaaaaaaactgctgggatgtcactttcaagattaagtaccaaaggactgtgacttctgttttgctctcatacattctctgtctgagagctgggagcttgtctttaagtagaaacccacccatccccagggagaaggcaggagggaaaaggaggagaggtcacagacaagccccctgactctgttgatcttcactgcagtagcttctcattacaagcaggcatctggccattgtagaccattataactgtagttctagaagtaataatagcagatttattgtacagaagtgtccacgggctcacaattctaaggacatcatcatgacagcaagtaggaaaaaaaattaaagtaattctttcaccaattaccagtttatctcttctccaattcctttggatacgcctcctgcaagaagccgatttccagctgtatgtgataatgaaagggtttttctttcttatgttaaatacaagcgaagtgattaactggaagatagcgtctgattgcgaggaaatcagtgattcagatggtgtgggaatggcacctggggatgggggaggcaggacggagatggaggaagctggtgcagcctagcctgccttgtgccaaggacacccaagggcagagggactgagctctgggggaggacagatttgacataactggtccagcctcacagtttacaggtcctggagggtgaggaaagtgggagctggctgcggatgcaggacaagaacccagggcttcccttcattttgcctgccctgccacttcctcccgccacttccacccttcctacccctccacctcccttgtgcctttcactgccttttacagcatttacattacacttcagtaaaaagttgtggttttggctggttttttttttttttaaataaaaacagcactgaagaagtagaaggaagatattcagggtttttatttttattttttgagtctgggtctcgctctgtcacccaggctggagtacagtggtgagatcatagcttactgtagcctcgacctcccgggctcaaagatcctcacacctcagccttccaagtagttgggactacaggcatatatcatcatgcctggctaaattaactattttattttaagagatgtggtctagctatgttacccaggctggtctcgaactcctggcttctagcaatcctcccacctcagtctcctgaatcactgggattacaggctggggccatcatgcccagctctaggtttttaaaatgtaggcaaggaggtcagcatttacacaaaagcagggtttgatcttaggaagcttaataaagagaggggtctaatcaaggtttcctgtaggatctgggctttaagttaggccttaaagaacgaagaatgtttgtgggtgtagtaagcaatgacttggagcagagccctctagccattgggctcaccctcacaggcaggcgccactgaccctaggggggtgtaggcagctggaggaagtactgtgtgtcccccattccagcgatggtggcccctctcagagtcaatacccttccttccaagagactgaacatacaactggacaatggccaggccacatatgacaatagactctggccagaaacccatgaccagcctgggaagccaaggaagccaaaccacagcctcagcagcaatcggacccagaacagtctgaacttagtggctgccagcttcttcccaatccccagccaccacaccccctcttccaactccagaccaaccagagaaagccaaatatacccccccaaccaaccaaagatgcccctccagttagtccgctctgtccccatgccaacaatctccaatcacagcacacccagagccttccctttttttccactataacatttcacagtccctgcctgcctttgacccctgccaaatacaagcaatcatggctgactcctttgcaaactttgaccaaatggcctctctgctcttgtttaggtggtttttatttccacatctccaacagggagtctggaaacaaactgacaatactcgtgaaatcaacacccagatgaggtagaccagcactccaggatgcccctccccagtatccctcccctgttaactgttcccctggcttctaacaccatggatcagttttgcttatttctgtactttttgtaggaagagaatcatacaatgaattctctcttgatgatgaggactctgacctcttttgcttgacctcatgtctgtgaaatttatccatgttgctgtgcatagcgatattttcattcatattcgttgctgtgcagtagtattcgaccctgtgacttcactgtagcttcaactgtggatggacatttgggttggtggatggacatttgggttgtttcaggtttggggctacagtcagcgtgtggttagaaacattcttgccaatgtctcggtggacatagctttctgtggtgtacatacccaggagtggaactgctggatcagtttatacgtatgttcggcttttggtagatactgccagttttccaacagggtcacaccagcttggtccattcaggttacaatgaaacaccttagcctgggtaatttgtaaacaacaaaaaattatttctcacagttctagaggctgggaagtccaagatcaaggtgccagcagatccagtgtccagggcgggctctctgcttcagagatacggtgccttctcactgcatccacacatggtagaagggacagaagggctccctcaagcctgttttataaggtgctaaccccattcatgatctccaccctcatgacctaaccacctcccacaggccccacatctttattatttttttgagatggagtctcgctctgtcacccaggctggagtgcagtggcacgatctcggctcactgaaatctccacctactgggttcaagctattctcctgtctcagcctcccgagtggctgaaattacagatgtacgccatcacacctggctaatttttgtatttttagtacagatggggtttcaccatgttggccaggctgatctcagactcctggcttcaagtgatctgccccctgccagcatcccaaagtgctgggattacagtcatgagccaccatacccagccccaaaggccccacctcttaatgccattgctttgggggttaggattcaacatatgaattcaaagggtacacctacattcacaacacagcactgacttagattccctgcaaaacccatgagagtttcatttcctccatattttcatcagcatttcatcttgtcagatttactctctataggttctaagtattattccccctctgctgatttacttattataaacagtacataactgatcagataaacacttgtccctttgccacccctaatgcctgcccccacttcatattccaggaacactccattaaaccaccccctactgtactggtgggtggtgggagggggctcatcgggtggggtctttgccgtattattctgtgtcactgaggcctatcacagtgctctgcacatgtaggtgcaaatatctgttgtatgattacataaaagaatgatgtgaaagcctatttgtctgtaccacaatcatgaacgtccccaaccacttgaaggcactcatagtgtcttaatcatcttaggccttcgatctggcataggtaactcctttaataaacaatgtctgctaaaccaaatggcttcctgaggcctggcattttaggctgtgtcccctgccccacctcgcccagcctggggcattgagcctggctgggcacacacgtgatagttgtaatcatattgtcataacatccctgagactacattaattacatattgagtgttatagtactattatagcaggtggcagatgttggcacactgggcagagatgtgttggtgtgaaaaacctctatgtactttaaagacagggtctccctctgttgcctaggctgaagtgcagtggtgccatcatagctcactgtaacttcaaactcctgtgctcaagtgatcctcccacctcagcctcctgagtagctggaacttgaggcacataccaccacacccagctaatttttaaattttttgtagagatagggtctagctgttacctacactggttttgaactcctggcctcaagcagtccttctgccttggtctcccaaagtgctgggattataggtatgatccaccacctccagccaaaatctcactttaagtggggtccctaactccagacatgtgataagctgtggttcacaggcataaagaacatccagcctggggccccggggtcagagttttccctcgcattgtcccctgggtccttcatccctcctaatcttgcaaaccagctgtcaattgggttgagatggtatctctttcatagggtcattatgaggattaaatgacttaatatatgtaaagcacttagcttaatgcctggcagacagtaaggtatggagtaagttgtaacccttattattattgctgttgctgttagcaacagagtgaggaatgctaggagtgaccatgcccagcaccgaatgaggccttcatagccttgggctaaaagaaaaagagcagaaaggtgaacacaggggaaggcctcaatttcaacacagatgcattagaccaaggactctgaactcactttccctggaggtgggggtgctatcagctgcttaatggagcatcatggaaaatgtgggactcaaggcctgaaggactccattcctaagagatgggagcaggagacatgctacggagtttgaatcttgcctagcacagggatttctgcctgctggaagggctctgtcagggcctagtggaagcccctgcctcagtggggcaaactgccactggacacacccatcattcatcatcacctctctgggacagtagtagcagccaggcacctccaaagagcttgacaacagaggaacccgcttcggcccctcctctgaagacaggatcctgcgctactccaactctgaactggttcaaggtgagagacgtcatccacagaggccacaaaaccaagaggtggatgcctcattgttacttcatgctgtctgggagcaaagagagggccttaggcacaaaatcctccagacccgcatctgccccttggctttctcaacccttcactctccaacttctataaataacctgtacagtggccaggcaccgtggttcacacctgtaatcccagcattttgggaggccaaggcgggcggatcacttgaggtcaggagttcgagaccagcctggccaacatggtgaaaccccatctctaacaaaaatacgaaaattagccaggtgtggtggcgggcatctgtaatcccagctacttgagaggctgaagcaggagaatcacttgaacctgggaggcggaggttgcagtgagccgaagttgcaccactgcactccagcctgggcaacagagcaacactctgtctcaaaagaaaagaacctctgcagaatgaggggaagcagggaagcaggcaggggtgaacaagatggccatgaattgataattactgaagttgggtgatgggctcatggggatttgttattctactctctctacttttttgtgtttgaaagttcataataaataatgttgctcaaaggaagctattaatagtttgaggccaggcagggtaaagagcatctcctagattttttttttttttttttttttttttttttttttttttttttagagatagggtcttgctttgttgcccaggcttgtctcaaactcctggcttcaagggatcctcccacctcggcttcccaaaatgctgggattacaggcacaagccaccacatccaacctccctcatatttgactaagaagtctcataaatctgagaacacctagcaaggaattaaggcgagggtgtggcactgttctggcttcagtctatcaccaggcagagtccacgcattcttcccagggagaaagaagcagtgacagctcttgggctttgagggaaatgattcagcgggagaaagaaggtggagaggggctaatatgcagataccattgctgcaggtggctctgcccctaagcactgaggagggcactggtccctctggccccacccagccttcaccccaaggtgaagtacgctttctcaggtccccaaggatgggtggccaggtcccccactgggagtggaggtctcactcccttccttgggttctgacctccacattatctggctgtgagggtgacctgcctggctttccccaccaagtgcagctccccgcagctgaaagccacactctcaacacaggactcctgagatctgacactggccaattcacaccctgcttgaagctggcatttgagaggccttcaggttgacaacagcagcaacaagtttgctgttcaaagtaggccaagtcacggctttgagcggcatcatttgaaaagtgctgggatcagccaggcgcagtggctcactcctgtatcccagcactttgggaagccaacgcaggtggagcacttgaggtcaggagttcaagaacagcctggccaacatggagaaaccccgtctctactaaaaatacgaaaattagtcgggtgtggtggcaggcctctgtaatcccagctactcgggaggctgaggcaggagaattgcttgaacccgggaggcggaggttgcagtgagctgagatcatgccactacactccagcctgggcaacggagtaagactgtctcaaaaaaagaaaaaggaaaaaaaaaagtggtggggtttgggtgcagtgtctcacatctgtaatcccagcactttgggaggctaaggcaagatctcatgaggccaacctgggcaacataacagcatgacctcatctctataaaaaatttaatttggctgggcgcggtggctcacgcctgtaatcccagcactttgggaggccgaggcgggcggatcacaaggtcaggagatcgagaccatcctggctaacacagtgaaaccccgtctctactaaaagtgcaaaaaaattagccaggcgtggtggcaggcgcctgtagtcccagctactctggaggctgaggcgggagaatggcctgaacccaggaggtggaggtcgcagtgagctgagatcgcgccactgcactccagcctgggtgacagagcaagactccatctcaaaaaaaaaaaagaaaaaaaaatttaattagccaggcatggtgacaggtacctgaagtcctagttactcagaaggctgaggcaggaggatcgcttaagcccgggagtttaaggatacagtgagttatgattgcaccacttcgctccaggctgggtgattctctaaaaaaaagaaaaaagaaaaagatgggaggatgggaggcggggctaggggactgggaaggtccctcaaccctttctacatgccttacccagggtatctcccatcatggctggttactgtgctaaaattataattttttttctttgagacagagtatcactcggtcacccaggctggagtgcagtggtgcgatctcagctcactacaacctccgcctcctggcgggctcaagtgacttatcttcccacctcagcctcccatgtagctgggactatagatgggcgccgccatgcccagttactttttgtattttttacctaggctggtagtgtgctaacattctaccacttgggcaacagtcttcggggctacatactgcctttttttttttttttgaaacagaataccactctgtcgcccaggctggagcgcagtggcacaatctcggctcactgcaacctccgcatcc

SEQ ID NO: 5791 - DNA, 7864 bp, Homo sapiens
gtggtcacgtgacaggaccgagcgatgggaggattctggtgcaccccggaaggaggatttttaattcttctgttttcttgtctatcgcaaaacagagtttacatgtattttccttttttcttagcttaagaattgaagactttggccggattagacctggttgtgtggagaggagaattaataactacagtggagcgagccctcctgcgagagtcaggatactactatgctagtcccgactctgccccaaatgcctggagagactttggctaagtcactttttctttccgcgggctgtttaccgttggtaaaaggagagggtcacccactcactccacaaacatttgttgagtcattggttatagcgggaacaagacaggcaaagttcttcctgaattctggtcggagatggataacggaaacaactttgttgaggttcccaatgtgcccggcactgatgtctttaaatatttatggttacatcaaagagaaagtcactatgctaatctttttttttctttcttttcttttttctcagggtctcgttctgtcgccctggccggagtgcagtgtcatgatcagggctcgacctcccgggctcaaacaatccccctacttcagccacccaagtagctaggaccacaggtgcgtgcagtcgcgacgggcttttttttttttttttttttttttttttagttgagtcaggtgttttactgagctcaagtgattctaccgccgcggcctcccaaagtgttgggaatacagtaatgagccaaggcgccaggctgctaattttttttttttgagacagagtctcgctttgtcgcccaggctggagtgcagtggcgcgatcttggctcactgcaagctccgcctcccgggttcacgccattctcctgcctcagcatcccgagtagctgggactacaggcgcccgccaccacgcccagctaattttttgtatatttggtagagatggggtttcaccgtgttagccaggatggtctcgatctcctaacctcgtgatccgcccgactcggcctcccaaagtgctgagattacaggcgtgagccaccgcgcccggcactaggctgctaatcttgtagtaacctgcttttaacatttgcttatctctctctttttttttggtgacggagtctcgctctgtcgcccaggctggaatgcagtggcgcgatctcggctcactgaaacctccgcctcctgggttcaagcaattctcctgcctcagccttccgagtagctgggactacaggcgcccgccgctcggctagtttttctgtattttagtagcgccggggtttcaccttgttgcccaggctggtctcgaactcctgagctcagacaatccgcccgcctcggtcttccaaagtgctaggattacaggcgtgagccaccgtgcccaaccttcttatttatctctttaaaaccaaataactttttttcattatatctgattttacagttattacccagcacacttactgagcgctccacttcccaggcactatttaatgatctggaggttatagcaatcatcccaaatctctggaaggagacagacaagcacataaatacatagcaatattgtgcagagagaagagctgggaaggaaaatgaaacccagtaaggggatggctagtgagaggggtgttctttgagataggtgattggaggaggcctctccaaggagatctggactgtagtgactggcatgaaaatttaactaggagtgctttctacaccgaaggatccctgaagaagcagcctgcctgggatgtttaaggaaccacaggaagctcattgccagaggagtgagccagggcagaaatgttcagagaaaaagcaggagcttccctttgccaaccaggctcggatcaagtcatcttcccagcctcagtttcacttagatccccactcctaagtactttcccctgtttaattttcttcacaacatttatgtaatctgaaattatcttgttcattttttcataactgaatcacctgccctcctcctccttctctctctgtcatacacatgccaactagaaaataagttccgtgcatcagagcctgcccatcttattcacctgtatccccagaatctagaatggtgcctggcataatagatataataaatatgtgatgactgaaagaaccagaagagaccgccaggaggaaacaagcctactccagcagttttcagacagttttggtctcaagacccctttacactcctaaaaattattgaggatcccaaagtttttgtttatgtgggttaagtctgctaatatttatctgataagttaaaactgagaattttaggctggaggcagtggctcatgcctgtaatcccagcactttgggaggccgaggcagccggatcacaaggtcaggagatcaagaccatcctggctaacatggtgaaaccccatctctactaaaaatacaaaaaattagccaggcgttgtggcgggcgcctgtagtcccagttacttgggaggctgaggccggagaatggggtgaacccaggaggcagagcttgcagtgagccgagatcatgccactacactgcagcctggttgagagcaagactccgtctcaaaaaaaacaaaaacagaattttaaaaatcaattcattaaaaaataattcattaaatgttaacaaaaacaatctttattaaaactaatactctattttctaaaataaggaataagtaaaaagtatggcatcattttacttttttgcaaatctctctctatatatatatattttttttgagacagggtcttactctgttgcccaggctgcagtgcagtttcacaattacagctcaccataacttccgcctcccaggctccagcaattctcccaatcagcctcccaagtagctggaactacaggcatgtgccaacacacctggctaattttttgtagagatggggtcttgccatgttgcccaggctggtcttgaactcctgggctcaagcagtccacctacctcggcctcccaaagtgctggaattataggagtgagccaccgtgcccagcctttcaagtctcattaatatccagtttacctaacctcattgtaaatttcctgcgaacatggtcagtggtatttctcttgcagtcctcctagagtactgcacaaaaaagcactaacattttttggattttgctgaaaacccatcacttcatttataagatgagagaacactgccttagaaaaattactaagaacaagataatctatgtagaggtttaatactgtgccttgcataaactaagttgctaaggagtgacacgatgtaactcctatttttaatttttagagataaggtctcactatgttgcccaggctaatcttgagctcctggcctcaagtgatcctcccaccttggcctcccaaaattctgagaatacaggcatgagccactgggcccggcctgatttatgttttaaaataatctttctagtcatacagataacaggagaacaagtggagaaggcagggagaccagtgaaagagagtaatctaggagtgcagagaggatggtgacttgtaccagggcagttgagacagcggtggtgagacttgggtcaaataaacatgatttgtttaacaaccaactggttgggaatggaatgttagtatgatttgaatgtacctttttttgttttgagagggaatcacgccctgtcacccaggttggttttggagtgcagtggtgcaatgttggctcactacaacctctgcctcccgggttcaagtgatttctcctgcctcagcctcccaagtagctgggactacaggcacatgccaccacacccagctagtttttgtatttttaggagacacagggttcgtgaagttcctggcagctagatgtacattcagtgacaactattaaatttcatctcagccaggcacggtggctcacatctgtaatcccagcactttgggaggcctatacaggtggatcacttgaggccaggagttcgagaccagcctgggcaacatggcaaaacccatctctactaaaaatacagaaactagctgggcgtggtggtgtgcacctgtagtcctagctacctgggaggctgaggcatgagaatcgcttgaacctgggaggcagaggttgcagtcagttgagatcgtgctactgcactccagcctgggtgagagaatgagattgtctcaaaaaaaaaaatttcatctcaaccagattaggtaagccacatgaaaccagggcctgtgctatgctttttgtataccacacactagtaaacacaggagttccactgttcctttatccataaaaagcctttgacagaatccttctatcaaagcccgactgaggctctgtatcacccagaataaatctgttttcagttttcttcataagcctgtaattccaaccctctaattccatctttcctgatgaagtgacttctgaacatgaataaccagggaaacctgtgtttgctcactacactcaccgggttttaattctaataaataccacaaacaagcatgcccatttccattccctctgtaaaccagtttagatatacaatatttttgcatgtcaaatttcttaaatgttaaaattaacagtaacaaagagcttttcctgttaaacattttcaaagttaaaaaaagggcacacatcccattgatggattaatttgattcatcggatacaaaagtaaaaacgaggagagctttgttctaagtctgcaccaatggaattatgttgattggttatagtttcaggaggtgagcaaacagttttacccgttgacagtccccgttttttttttttttaggagatggggtcttggtttgttgccccagctagagtgcagtggctcatagctcactcatagctcactgcagcctcaaactcctgggctcaagcaatcctgccccagccttctgagtagctgggactaccggtgcaccaccacaacacccagcttatttaaaattttatttatttatttttgagacggagtctcgctgttgccaggctggagtgccgtggcatgatcttcgctcactgcaacctccacctccagtgattctcctgcctcagcctctcaagtagctgggattacaggcatacaccaccatgcccagctaatttttgtatttttagtagagacggggtttcaccatgttggccaggatggtctcgatctcctgacctcaggtgatccacctgcctcggcctcccaaagtgctgggattacaggcgtgagccactgcacccagccttaaaaaattttttatagagacagggtctcactatgttgcccaggctagtctcaaactcctgggctccaagttgtcctcccacaatgtctcccaaagtgctgagattacaggcatgagccattgcatctgctgtcccccccgccacctgctttttgttttttttgagactgagtctagctctgtcgcccaggctggagtgcagtggtacgatcttggctcactgcaacgtccgcctcctgggttcaagcaattctcctgcctcagcctcccaagtagctgggattacaggcatgcgccaccacgcctggctaattttttttgtatttttagtagtgacggggtttcaccatattggccaggctggtctcaaactcctgaccttgtgatccgcctgccttggcttcccaaagtggtgggattacaggtgtgagccaccgtgcctggcctgagacaggttcttgctctttcacccagggtagagtgctgtggcatgatcagggggctcactgcagacttgacctccagactcaagcaatcttcccacgtcagcctccccagtagctgggctcagctgacagtcccttttatgatcgtttcttttttcagcacactgttgctggcttgaattctttttaaaatttaagaaaatagagacaagggtctaactatgttgcccaaactggtctcaaactcctggcctcaagcaatcctactgccttggcctctcggaatgctgggattacaggcatgagccactgtgcttggcctgtggtcatgtttcttacttcagtacttcaaataaattctacatccattcaagtcactgaactgaaaaagagcactgcagtgtaccagtgcagcagccagaccacctggcttgaactttgagctaccagttacttgctctgtgacatcagtggcatgttactaaacttctcttgtgcctcgtttccctcatccgtcatatgagggtaataacagtacctgtctcattgggtaggactcaataatttaacacctgaaaacactgaggacagtgcctggcagatggtaagtcaacaatggttactattattctgactgattcattttggaaatcatgggccaagccactattacccaaactgatgagctcaatccctgagtacctttaagtgatgaggaacattgagaaaatacataagccactgtgccccaatttaattacatagttcatacaacatggctacagagacgaatgatattctagtaataagttactgggtttgtagcaatatgtaagtaaatatcagagccacaccagagagcacaacaagttgcatttattgtttctgacaagtgcatagtaattttcagtttgctcatgttcctagcatcacaaatctgagttacaattttgcttctcaatgaaaaacatatactctgaaaagtgattaggaagttctaaaaattttaatcatttatagagtatcttaaaaatccttatcaagtaagatattaactttacctttataaatctttgtgtgaaatgaaaaaaaaatcaaggcatacaaatttcattgtgttctacatttttaaataccatcctttgtctccgttaaaagattttcatccatttattcaaaaaccttttaagttcaactgtccaatttaagacagagtgaagacatttttgagtatctgaactaagcattgtcttgactgaaacgaagtaagaactcaatgagagtccttgtgggcctcccagtcatgcctttccgtagatagggaacttcatctttgttggtcatcacgcctgctatgtctaaatgtgcccacttaggatgagttacgaattctttcaggaatgctgcagctgtacatgctcctgcagatctgaagagaaagacaaaaagcactttacaaccccatgtaaatgtgcactgagatcccacatttttgctaagtacattctataaccaaagaacaagagtcaagcttgtaagacctattaagatgctaacccacatatcagtttcagaatatttattttcagatattgctttaagcagtaaaggataaattctatattcctttttgctatggtaatgaattcccatattttccatctctttcccttaccatttattgaaaattaccattagattagaaatatgcaaattttgaaatctggttgaagaaatacttgaaaattcaagacattaaaaatcttacaagcactacaccaaaaggaaattaaatagttaaaccttttatataaggggataaaattgaaaatagctattttggcaatcaaggatgattgtataaatgtacatttagcttagcttacatacctgtattttccaatgttgttaacatcagcaagctggcaatctacaacctgtcttgtataatgttcgaagagaggcatcctccagacacggtcccctgtttcaatgctggcctagagaacaggtatgacaggtggaagagtggatgaggcaggttgtgggaaattcatggcattaacatgctcaatgcatgaaggaagagttgttctaacctgttactctaaaacat

SEQ ID NO: 5792 - DNA, 501 bp, Homo sapiens
ctaaagccctctccccaacccctccactgaatgacacagatccaggtaaaaccacttctccagtggagaaactgtgcaataaaaaaaggaaagttgcagcaagacctacatccaggaatggccatgtgactcaagacagacatcagtttatgctaccaacagcgctatgcattgggagaggctgacctagaactgtatggatgcccaatccctagagaacctacgttcgccccaaccaagggcaggtcatggaggctgtggggtctacaccgactcatgaattggctgggctgatgagcacacctggccacccatctgctttggagtccacgcgcttccactggaccttggattatctcttctccagcagggcaggatgggtggtgggaggtggaagggcagtgaccactactgtcaatcctggagaggcactggcttcacagtgaaagttaataaggccctgaggctccccaagattctaaaataaaaagattaaccact

SEQ ID NO: 5793 - DNA, 1823 bp, Homo sapiens
gcaatttaagtaaaacaagatgaagcaggaaccgactctcaccatccccactcccacctccatgaattccatcggacagttgtgcgaaagcgggctggctttcgcacaaccattggtggactgtctgtcctgtaagccccccaggggctgatgccctcccagtctgcctgccctgttcttagcacagcccctggcaccccgtgtgatctcaggaaacacttgctaaacatggtatcggaggagaaacggagcccacagcttagtgcaaagacctggcggcgtggactgaggctgcagaaacgcagaaacgcgcttttcctgccagaaggggacatctgcgtggtcgggagtacctctggggcacgtgccctaattccagaaacatctaagctggagcgcagtggcactgtaatagcttactgcaaccttgaactcctggcttcaagtgatcctcccgtctgggcctcccaaagcactgggatgacaggtatgagctaccgctctcagccacaactgggttttaagagcactcctccagcccactccagtgtcttccatcattctgtgaaagcaccaaaagaggaccaagcccaggaagccgccagcaggcctctcaccagccaagatggctggaatcctaatatcaagaaatgaaactccagcaggccatggaaatgctaaggggttggcatttctgctctagagagagccaaagagaaagctctatttatatctccttgcgtttggtcgcagcctcatcaaccaaaagaaccttccgccccactcaacacatcaatcaaattggggagggggtgtgaacagcagcagcgggtgttacagaggagtctcaagggtatcttagagggtgcctctctgaacagtcgtcccctccaaatcccccccaagagaattactaggacattctccttcccccgcaagcaacggcacccccagatgattaaacgcgctggcgtcggaaagagctgggatcctggagaaactacttgtaaactgtgtgggttggtgagttatttaacttttctgagccttcgtttccttaactgtaaaatgaagacaacaccactcagctcctacagttgtccagctgaaatcacctaggtaagaacgaccagttctttggggagtaatgtcccgatggtaccattcaattgtcaagaacaccaaggcaccgtcaggcacccgggcggtatcccactctcctggaagagagcagggggttagcccttggtttcaaagtccctagggagcagtaaaccttcccctccgagagccctgagagaggaataattgccccttcccactccaacccacggcacacccgcccacatccacgtgcggctgtgcccagcatctcagaggtaggacttctcaggaatcggcgggaagaagcccccttgatggagtctggtggggttcaagatctgcaggtcccaccttccagggaacacctgcacaagtgagacctgcccgatcagccccgcgctccatccgcaaactgggcagatcccaagggtgccacgcgaggaccctgcaccttggccgctccagggcgccccccacccgcgaccccggaaatctcgcccctacctgcttcaccctcgccccacccacagcgcacttttcgggacctcccagcggcccttccccggttctctggacccccgtctccccgccctgcaacgcccccatcctggtgcccacgaaaggtcgtcccagttcccctcttctctacctcaaaggaggaggtgcaaatgaggaagcctaaataaaaacaggaaactcgatttttttaaaaagcctca

SEQ ID NO: 5794 - DNA, 2460 bp, Homo sapiens
agatttcaggataagttacccccaggcccgaagccccagcttgccctggcctgtgcctgcctcaggtgccagctagatgtctcgctccacctgggtctgggacctggctccacaccagttacctgggaccagtaggtgcccttccagcctgaagatctgggggcacagtatagccacatgagccccaagtgtggtcctgaactggggccgggtggggaagagtgagatgggataacatagcccctgcttggaggcccttctctgatggggtgacataatcccttcctcctgggaaacaccagcttttggggtgatagcactttcaggcaggagctatggttccttcctcaggaggcctccaatctgatggggaagacatggcccctccccctggggagtgccctgtgtgatggaggcgatacagcccctaccttcagagagcacctggcctgcagctcatccaaacctgagtctcctctcccttggaggcctcattccagcgccccaaggaggattcaaactgttggggctggaagaacttggtggcctgggtccctggagccctgttgaaggagctggtgacattctgatgctggaggcaggtgacggggagcacagactttgtgtcctgcacactgagctccaagtgtgccccagccactgagccttgtgacttgagcagatgtccgaagccgtttcttcatcccatgagaccaacaacactgtctgcctcagaacatagccgtgatcaagatgagcacggaggctcgtgtcccagcacctggcacacagtcatgggatggcaggatgcttgtctccaggtgtggcctgaagggaaaagtgtggacagtttggtgtgatcaaggaaatggaaccacgcttaccagttgcccttgtccaggaagggctggctcccttaggacgcccacatggagcatgaggttgggccaggcacccccagaggtccccgccttggcaggttctgttttacctgttgaacgagacactgtatggggaagtgacatgcgcagtgcctggcccagtgctgtgcacacacgctgcttcgcttcctcaggttccggggatgggatgggacagaaaagctggttgcttagctggtggcgttctccagcaaagcagaagggatggtcctggcagccctgtgccgagcactggaccccgcgccctccctggctctctcagccccaaggtcccattagttatcaaacctggttttttgtttttgttttgagacagagtcactccgtcacccaggctggagtgcagtggtacgatcttggcttactgcagcctccacctcctgggctcaagtgatcctcccacttgagtgccaccacgcccagctagtttttgtatttttggtagagatggggtttcgccatgttgcccagcaggctgttctcaaactcctaagctcaagtgatcctcccacctcagcctcccaaatttgctgggattccagggttttgaagccacagccaagacgacatggccttccattcctgaagccgaggaaggggagaaagccacaaccttcaccactctccaccctttctgtctgtgtgacttggctttcatcggagctgaatgacgggaccccagaggtgccgggtgacagccaggtgcagagcctcaactaccccagatggtaaagctttaaactgatccactggccaggtgaggcgactcatgcctggaatcccaacactttgggaggctgaggcaggtggattgcgtaagctgagttcaagaccagcctgggcaacgtggtggtgtgcacctgtagacctagctacctgggaggttaaggtgggaggattgcttgggccctggaggtcaaggctgcagtgagtcaagacagcaccactgcactccagcctgggtgacagagaccttgtctcaaacaaaacaaaacaaaacaaaacaaaacaaaacaaaacacaggaaaacctggatctgcttagcattggccctagggcagggagtgggttaccttccaccgtggattaactcagttcaactgataactactcctccaggcccccagcctgggacagccctggggacacagtcacccagtagcagcactgtgcccagcacaggtaagcactcaataatgacgacggttactaagtactccacccccaccaaacagtaggcagagactgtctctcctgttggccatcataaccccagtactcagtaggcgctgaatgtttggtgaatgagtaagtgaagggaaagctgaggcaccaaccctcagggagccctcagtctggtggatgtaaccaacaaccacagaactacagaactgtatactttagatacatgaattgtgtggtatgtgaattatatctcaaagccatttgaaaaaataccaaatgtgccattaagatttggatgggaagttatgggtaatgagaatataatgacatcttg

SEQ ID NO: 5795 - DNA, 1917 bp, Homo sapiens
aaatttccctctacacactgctttaattttgaaatggagttttgctcagtttcccaggctagagtgcggtggcatgatctcagctcactgcaacctctgccttctgggttcaagtgattcttgtgcctcagcctcccaagaaactgggactacaggcatgtgccaccacacccggctaatttttgtatttttagtagaaacagggtttcaccatgttggccaggctggtctcgaactcctgacctcaagtgatcctcctgcctcggcctcccaaagtgctgggattacaggcgtgagccaccatgcccagccccatgtcctttttaatgcctggattgactttgtgggacatgaggccaaggtaccttttaagatgtcacctgtatagcatactagtagtgaatgtaggctttgaagtcagatgcatctggctgtgagctgtgactagtcatatactagttgtgtcattttgaacaggttacctaacctctggctcctcagtttgttcatctgtttaaaaattgtgggaataacagttcctgctgggtcattgcaagatgtcagtgagacgtgtcaagtgcttagaatagggcttggcataagtagagtctcagtagggtaggtgttatttaatcccagaaataactgacaactttggaagatgagagtgaatgtctccgatcattaatttatttaacaaatacttatctagtactatgtgcccggcgctgtagacactgccatgttttatctcattcaatattcacagtgactgcccagtgaatggtattgcctccatcctctgagaaggtaaagagcctatcccagaccccacgagtggaggcgtcagggaggggttcttggcaggagatgggtcttgtagaaaggcttctgctttgctttcactcacggcctgtggccagtttgctcagacagctcccatcaggacaccattggcagcttttgcatgaccctgcctcccagggtcttcctgcgtttttccttaagttgccttattctttggttgtttccctacttgtttttgttagactgtgggaggaagaaatccatttcaaatctgctgaaacctgttaccaagcaacagcagtgattaaaagcaacctgatgagtgagtaaagaattagggtttcagacctgtagttaatgatggtctctgtctccctgctgccctgcattcccttcccttccgttcactgctgggtgaaggagggcttgctgcattttggaagttaagggaaccaataaggtgactcttttgcagattggaatatggtgctcagccagccatatggaagcactgtcctggcgtgatctgccctgggctgttggctctctgagtgctgtcttgggaggagcactgcccttcagaacagaagagatggcttccagtcccctctcccccttctcccagtctctctgaggctgcttgttgggtattgggcgtgctgtgtactaactcactcccgtctcttgtctcattatctgaaatgcatccccttttgcagaaagggctcaaacggagccttcagttctgctcctctgcatagccgtagctcagatcctagctcaagatgtcttgtctgggaagggcaaaacatggtccccagtgtagcattttcactgggttgattatctcagtggtggatcatctatcacccttgtgtggtgactttgtgaattatctgcctgagtgccacttcccttccaccctaatcactgcaggctcagggagcaagaaataaaatcatgaaatgcattccaaataaaattaccttttggctgggtgcagtggctcacacctgtaatctgagcactttgggaggctgaggtgggtggatcgcttgaggtcaggagttcaagaccagcctggccaacatggcaaaaccccatctctac

SEQ ID NO: 5796 - DNA, 314 bp, Homo sapiens
caatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttca

SEQ ID NO: 5797 - DNA, 770 bp, Homo sapiens
cggcgccccagatccggccgtccgccctgcgcgtgcgcggcccgaccccgccgcggtctggctgtaagggcgctggaggggagctgggctgccccagccttcaatgctggagggacggccgcgtggggcttcagaaaggctaggcgccgaggagtgtaagcagcgtgtgcccatttaaagacaaaatcagtgtgtttttcaggcagaaacgagtctttttttaaccatattcatcacctggtgccagcaacagaagtgttccctaaaaattcctagaataaaccaacacgtgctgactagattctccatcttcataaacggtgatacaaactatgcacatcataactaccagcttcatgaggtcaagactaaatcaaaaattctcaaggacttttctaaaaatttttttagcataaactgtttcctctaacttaaacttctcttaagtgaacgtgtctttccactgggatgactgtctacatgctcaggaatcctgaattcatgactatgttcaactcccacgaccatttttaaatcatcaaaatggcagcaaatgtcattacctggaccaaaaagctgcaggttttgtggcaaatgggaaatgtgttatagaatatgactgggaaagagggatttcttagtgctgcccagaattaattcagcaaacactgaacattactacgtgccacatataggatcatactgcatttcaggtcaccatcaaaggtaaattacaaggctgggcgcagtggctcatgcctgtaatccca

SEQ ID NO: 5798 - DNA, 740 bp, Homo sapiens
attccagatgagcaagcattgatggccagcctgtttgacccatgggcaatggaccttccaaagggagctatctagcactttcctctccacagcatgtggcttcaggtgtctgcctatcctgctctagccagatgacctgtccctttgattttgaacagagtctcagtgatgacctcaatggatgaccctcccctctgctgaatgcctcccctggggctgagcgaagctgcccacctcttcttcagtgctttgtctccaaagaagtggctgaagatgaagtcctcaaagtcatctacttcatcatcatcacctgtctgttgcacagccacctcctccaagctgtcctccagggcatccacaaaatcccggaagcggaggcggtcatgacggaagatgccatcctcaccaaagaaagcagtgctccaggcagaccacaccaatcaatcacaggtgataccatgtatgtttcatgtaccatgtggaacagccaggggcaccatgggctgaggtgggccggcctcccggccccgccgtctccgcagaccctccatgtccacgtcggtgtcatcgtcactgctggagcagcggccctcctccctgatccaagctaggggaaaggacagggacagggcagtgaggtgactggagagatggggagacacagggagagaggggaatcagaggaaggcacagggagggaggtcgtcagccctgaccccagagaggggcacatgaagacc

SEQ ID NO: 5799 - DNA, 3626 bp, Homo sapiens
acggcctcagtgaaagggaaccgctggtgacagggcctacagaccccgaccaaaaagcgcatataactcacgtgcaggcttcgatgcacaaagaccccgggggccggcggagcagggtcggagagcgcgacagcccctgccctgagaccccggctttatgtgctacgcatccacgcgtggcactgccccttccatgcagtctccttccgtggataaagtgacacattttgttttgttttttttttttaagatgcagtctcgctctgtcgccaggctggagtgcagtggcgctacctcggctcgctgcaacctccgcctcccggagtcaagcaattctcctgcctcagcctcccgagtagctgggactacaagcacgcgccaccatgcccccctagttttggtatttttagtagagacggggtttccccaggttggccaggatagtctccatctcttatcctcgtgatctgcccgccttggcctcccaaagtgccgggattacaggcgtgagccaccgcacctggccgagtgacacactttgtaagacaaaagccatctcatgaacttctacacccatgaagtgtgtctgggaggccccctcctctgggcaccactgccctacgatggctccatctgtagcctccttttccaagaggacttaagaccgacaataaatggatcccagatacagattcccctgcaagcggcaaacgtccatccccattaccggaaacctccagatacttcacacttactggcagcccaggacacggggacccaaatccttgcctgccctgagcagtggctctcgaggccaggaaggggggctcgtgctcagagccaggctggcctgcctgctcacttctgtttgccagggcaccatcatctcccaccaaggatgaacctgaagcttcagggcaacgaagagaaacccagaagcgaagggacttgcaaccaaggctgcccaaagtggcccctgtccaggcccatctctaaatacaacccacaccgaggatgcctggtggggcagaagtccctgggtctcgttcccgtcaggggcgagtgaaccttcacaacctcccggggctttggaatttgacttaatgatgaagggcaacatggaccactggacaaagacctggagttcccactacctgcaccgctctggccaatcccatttggaaatcagtcagcaagattcactctcctctggactctgagcccccgggaggagaggatgggagaggtcaagcgtgtgcaattctgttgcagcctcacaaccaacaagcagccgtgttccgacggctctgcgggaagcccagagggactcccgtggctcatacgggggcagagacgtgcagggccccggggaacgtgaaggtgagagacagaacataccgtgaagaagccactgagagtgggagacagaggcaggaacagggatgacactggaggacagcaggcctgcctggaggccagcattctctacaaccttccacaaaccaacagcaaagcccgctccgggccacgtgcctggcagctgctcggccactgccccgctcctccctaggcaaaatcccagggaagcaccttgcgtcgtttccatttcctcacctcttactcttccttgaacagtccccccaagaaactgcctacccaccatcaacaactggcacagggcagatccacgggtcaggctgtgtgcacctgaccgcttcataacccctgcgtgggcagccagcaccctccatcagaaatcgtttgatcccgtggcctctgggtctccatcattcgagctcgggagcaacatcccatcaccatctcctctcctcggtgggcccctcctcgtgttcacccctgcactggggggaacccaggctccactcacagaggagccaacctctgggcagcctgccagctcgctgtgaaagtcctcacggccctgactcctcctggagctctgctggcagcacctaagtgcccactcagacctgaatggtggcaccagcggatgcatgaaatgccagcccagcacccgccccggtctctcccagctcagcagcagacaccgctgtgcactaggcttgagggccacctcccaggagccgcccctgactccattctcttgaccggtctgttcatcagacctcgaccacggcccctgcccctgctctcctgcccgttctcccgcctggcctaggagaagccacagcaaaccccacgttccccgccacaaagagaaggaagtccagagtcagtgccaggctgccacggctcaggggcccagcccaccacagcctttcatgcccccccacacactcctgcccaggagctgaaagagccccacactgccgccagcccctacccagccctaagactcttggcagcgcatcttgctgccgggaagcctctgacacggatcgtcagtgcacgtccagctcctccaccaaaatcgaagcttctcgtgggcagagacgccacccggcatagcagcgcatccccatcacccatcaacctgcacttggcaagcacctccaaacagagagagcacacacactccgccggcagccgaaggagctgcaggatggtgctgagagtgggagcaggccagaacgaagctctaacacagaagagccgggtgctggggagagacggggaggacaggtgggaggactcaggcccctccccaggcaggatggggaggccacgacacttgggccagcttggagggtggcgggggaggagaagagcagatgcagactgcacctgctgggggtgacgacggtgtggcgtggccagcccagccactggcaggcccacaggtcagctggatggggcagaggtggggcccaccccaacttccaccgggccttgcctcccagattcctgagccaaggtttaataacagaaaagatggcgctctaggggagcaagggacgccgaccaagcaagccgcagcagagaggactgtgctggagccacatcggtggcttctccgggaggtaacgtcctgtgcagactcccagccacaccctggcgctgcctcggctgcctccctgaatgtcagcggcctgagggaccccactcggcagggagcgggggctgcttgtgggaacacacagggtctgattccaagtgagaggggtgactggtgtggcttcagacggcaccaaccacgcaaaggatacacagcttctcgtcgtcctgaaatgtgaagtaaagcttaacaaagaaggggtgatccaggcgcgacatgacatcccgctctctggttacataggggaccttgttctcttttatgatatgtcgcttctccagaattttaacttcaggtgagagagaagtgagttactatcagaaacaacaaaaaacactaaagacatgactcacaaaggtaactggtacaaattaaagtctttcaaacattgtacacaacagcctggtggtctctaaagccaacagtgtcctgtaccctgaaatcagcacagaaacaccggccctgccaccccagccgccctgcacggagccgcttgccctgctcccggacgcacagctccctgcagcccatactcactcgcatattctctggaggttgccagttctcgagccaggacaacctggttggg

SEQ ID NO: 5800 - DNA, 791 bp, Homo sapiens
gtattttacacatcagcagtgccagtccctcttaccattgctctttttcgagagcttttttaggctaaacctgtgtgtgtgcgcatgcagagagacagggtctctctctgttgccctggctggagtatagtggtgtgatcacagctcactgcagctttgacttcctgggctaaagtgatccttccacctcagcctcctgagtagctgggaccataggtgtgtgacaccacatgtggctaattaaaaaaaatgtttttgtagagaaggggtctccccatgttgcccaggcttctgctgtttttaagtatcaaaatacttgccgacacagtttttttcagatggcagttggcagctttgttcacccttcctgaattctctttccctttctttccgtttcctccaaccccatcccctcaccatcctcacttcaaaaacactccaaccctctcgcttattatttagtatctgcaactctactgttctctgcaattcaaatctgtaattattatatatttctctttatcctctaaccaatcttaagatctgctcagttgcccatataaaaattaccacaaagacttttcctcataactggaaatgacttgcaatccattataggtcttgagatgttctcaccaatggtcacaatattttaatattgtggcccttggacatgtaacctcaacgttcaaatgattaaagatataaccaatttaaacttacccttttcatttcttgttgccaaatataatttcttgaagaaattatacaaattaaaattctctaccaac

SEQ ID NO: 5801 - DNA, 2376 bp, Homo sapiens
gcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccttctccgtgtatttttaacagctttagtttttgtatgtcaatgatgctatttagtttattagcattcacagcaattacattttcctctatgagttttaattttactcaatgaaaggtgattctttacattatgttttaccataaattctactttgtttgatagaaatattgttatccctattcaatttttgcccatgttgtataaaatgtgtctttacaaatgacgtatacttcacaggttccaggaattccttagtgtttctgatccactaaagactacttctctgttttctagtgctactaaaaagttttccttatttttgtctttcttcagtcaattattaaatctgtaatctttacattgtttttattatatagatcttcacttccataattctaaactataatatcttaattctatttttttctagttttcttccacctattactgcccttacaccctacagtcttatttccttgtgctcattataactaagcataatttacaattctctaactgggaaaaaacctggatactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccacccgagtaatttattaaataaagccaaaataaattaacagagtaagataagatgacgtggtagtgacaatcaatgattcaaaaattcattaaggcctactcaaaaaaactctgcaggcatgcaggtctcccaaattttattgatagaaaggaactaaaataaggtgccatttggagcattggaatgatgtaggtgtttagccagttcaaacaggctaacagaacaagtttgaaagtgtaagagacttagaaaattcattgtggaagtaaaaaacagaacattcttacagtgtacatgagaagggattaagatagtaaccagttgacaaatacatatttctttctcatatttctctgtcaaacaatgtgtggtacagcactgtaatttttatttttatgcttttatttattaacaaggagatgaaaaagtaagctatttaaagtggagatgttctaagtatctttttttaaaataaattttcaatgggaataggactagtttctgcaaaatttatcctgaaattgatatggaaaaaataggcataaaaatgtctggtaaatataatattggaaaaaggcatttagcataataagcagggaaaataattagttaaaataaatgaacgttcaatgagaaatatatttccttaaaagtactggaagcaaagtagtggaaacactgtgtattagccagagcactaagaaaacatttgatacgaaacaatacctcagggaataaatgtgatgggacagcaggccccatactggtctaatgtctataattccatctaaatgtcagtaatggaaaaaatgagaagaaggaagaagattacaaacaacacatgtgtccgtctgtctttctgcatgtaactctatagggattctctattagaattacataatagtggaatctggtctatgacatgtaagacaaattatccacaaccatgacattttccatgctacaactgtaggtacataagtatagtccagaaatcaaattcttagttttgtcacccttgtaaagcagcaggaacactggaaattttcccccttatatttgggatctacttgagaacctcccttcaccccacacaaaacccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaa

SEQ ID NO: 5802 - DNA, 3513 bp, Homo sapiens
tatgtatcaatcaaaaatttataaaaaccactgctttctagtatatgtcagggattttttttttttaagagactgaaagtctccctaaccaggctcaaactctttgcctggcttcagtgttacccactatgtactcactcaaggtgtccctgtactcattagtcagtcacgtcccttcaggagatgattttaaaaaattattttcagtcctgcctctagggtttgctcacttaccagccttagcctacagcactgccctgctttcctcctctcttccttctaagttcagttccaattccatttataaagactcagcccccaccatctgctctagttccagtgatatttttcctcttatgaatttctactcaatatttttataattctctaactgtcctatatgttagtttttcttccccaaccagactaaaaagctctaattgaggagagtcttagtattttgctccttttgcacaggaagagcttctgttatgtgtcttcctttcttgctgagagcacataatcccatatacaagggaccaggtacaccagaggcaggaggaggtggacgtgtttctctacaccagggagtgatagcacacacagcccttctgcctccaagttcacacagaagacagacagttgggacagtcagccagcaagctgagagtgagtaattttctccaccagaaaatcacgggatgaaggatgtatgctgagtgtcaaagaggacgctttaacaaagaaggggttgaaattgaggagatcctaagcatggattaatatgaagactttctcttgcattgacctctttgagaaccttctcaagaatggctgtaaagacaagcagagtaaaatgttgaggactggagatgctaaacgcctgatgtttaaaaaaaacagcaagttactgcataaaaatattttggtttatccgatgtaatataaggcacggagttaaaagctggtacaactgggttaaaaaagactttgagtttatggtgaatgacataagagcaaatgcctctaaatatatatattcttcaatgggaaaaataagaaaagaatagccaatagggaaaaagtctttatcaagaaaatttgttttgaagaaattatagcaaatttactggagatgtggtggacactgtgatcagcgatcagttctaccccagaagccctttcaggattaaaaaacttattcccctggctgcagagagtgccagcagaagagggtccccatccaagatcaagcctccttccaggggcagtctgcacacagcgatgggtcaatgcagaggtaaaaaggccagtcctcttgctccaaattggaaggactttgaacaactaccctagctccagagctctctgtggggttggttcaggacttggtagagaaccacttcatagctcagcttcactgagtggttgtggttgcatctcctcccttccaaaggtattgatccccagagatcaattctgttagatctgtcaggtatctctaacaacataaggcatccaaatctcaatctcagagtgcgcttcctgggtaacccaacctgtggcaaagataaaacttgtgttttccttagaaagtagctcattaagcagagtacatatatttaagtcagtttcctcatttacaaaattggaatattaatatatgagcacaataaggttcctgcaaggattaaatgaggcactacataaaatactttgagtgcctggcaatgctaaatatgcaataaatgctaggccattattaaataatgttttaaatcctgttttaaaaaacaggattactgtttaaaatcttctgaagaactgtaaggaagatattgaggataatgatagcctatgaaaagttactgttcatgccagtagcttctaagctccctataccatcttcctgcaaattcttgatttttctttttacttcccagtcaacccttttcccatttccttaaacatttctccctgtgcccagtaattctgtaattacattataacaaaattataaaaatgtctaagaaggaaaaaagaggggagggaggattgagagatatgacccaaagtaaaacagatttcacatattccagcagtcctgaggctgactagggcaggagatcatggattggttattttaaaaatacaaacctacaatctgacaaaattctatctccaggattctaattcagaagatcttggggaagtgggcacagatataattataattattattattattattattattattattattttttgagacagagtctcgctctgtcgtccaggctagagtgcagtggcacaatttcggctcactgcaagctccgcctcccgggttcacaccattctcctgcctcagcctcccgagtagctgggactacaggcgcgcgccaccacgcctggctaattttttttttaatttttagtagagacggggtttcaccgtgttagccaggatggtctggatctcctgacctcgtgatccgcccgcctcggcctcccaaagtgctgggattacaggcgtgagccaccgcgcccggccaatatttgcatttttaaaaactccccagggacagaaagaattgcaaagaaatcttaaacttcgttcagaattttattgtaattcaaaactatatatgtatatatgaatcaaataaatatattgcaagttttaagtgtgatatacaaatataatttttaaaattaatgttaaatttaaattacaaatactaacatgaactcatgattaagagaaatacacatatttccttgcactgtccactgaaaaggtcaagaagcaaagatacaagtacaataggtatgcctaacacttagagcttgatttatacataccatccttcactaaaaagaactgaggttccttgaagaaatggttgatttggggtctgaggcaggaaattggaaggtgagcaaatttagttgtgtcagaaagaaaagtagccctgaaaaaataatgggaaaaattcgatatggtgagatctactcgaaacgtggtaaaggggaaggattacaaattaccctaactttttagaagaaactgtagtcgacccacagttgataaagaaatgctcacctttacagaagaaggccagctaatcaatgtagatgtaacaacagagtctgatggaacaatagattctggtagggacaaaaggatggtttcctttaggtgaaatgttagcaacaggatattcacatagtaccaaactaccatccagacacgtttgttatttacaaaaaaaaagagatctgctacttaccaccatgaacaaatgattaaatacaattaccagcgatgaaacaacctgacgtcatttgccacctgatgtaatgcaatatgaagtacacacatcaatgaagaagtatttttatcaataatgttttacctaaactcaaatcaagccaagacttatacagataggtctatgtatatacacacagagggagagaaaggcagagagagaaaccaaatttgttaaa

SEQ ID NO: 5803 - DNA, 22735 bp, Homo sapiens
ctcttgagctccttgctggagcccaatcccagtctgtggagtgtactttcatttaaataaatctgtgcgttctttgcttcattctttcattgcttggtttgtgcattttgtccagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccaattcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtgctgctgtcctaagaagggtcaggcctagtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaattaaataaataagtccaagcaattttcaagttcatgtgacttaagtaaatcttcattaaatagctggctttaaaattattggtaaaatgaaaatagaaatatcttcagaattgtcagcatacatttttgtctgggttttatatttgtctttgctagaaatgttgaagtgtcagcatttggcatagaagattataaagctattaacccagccaaaacaaaatggccttagtttatgtggcttctttgacaaatgagactaatttaatattgttagctaaatcttctgggttattggcaaaaacacctatgtatttaactgtgaggttcttatttaggtgaacacataatgttcattggctattaaaaatggttaacaaataaataactaactttaaatgatggtgtctaatatctcagttttcagaagtaatctagataaactgttaaaaatgaaagacttaagtacatgtaaatgggatgaatgattaggtaaattttgtgtaatttaaaatcttaaaagtatttttgatgcccattggatatctcagtcatttccaattaagaaagggttatgatagggaggaatatgtttccaaaaattgtggaattattctcatctataaaatgctaatatctgatagtttaggattttttgcttcctaaggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccacataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcccgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcagtgagtgttacagctcttaaaggtggcgtgtccagggttgtttgttccttctggtgggtttgtggtctcacttcaggaatgaagctgcagaccctcatggtgagtgttacagcaattaaaggtagtgtggacccaaagagtgagcagcagcaagatttattatgaagagcgaaagaacaaagcttccacagcatggaaagggacctgagcgggttgatgctgctggctgtggtgaccagcttttattcccttattcgtccccacccacgtcctggtgattggtccattttacagagcactgattggtccatttcacagagtgctgattggtgcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagctctgggcagagcccacactgaattccgggtctccaaaaagagaattattatgaggctaagaccatgtgatggttttatgagtgcactctccttttttttttttttttaacaaaaatgtttctctaagtgtctgaactactctcttcctaactttaaacacccaacagtaacctctgttgttactctttgactaaaataattattttagttaaaaaaaaaaaaaaaagaagaaagaaagaaaccaggtaacactatacaaaaggaagcagtgtaagatctgagacgaaattttctcttttacactctttgagttccataaggagaaacagaggttgctccccaaaagggagtctagtgccttctctgttttctttaaggaatcccagggtgttagaaactattttagattcctcatgcagcacagggtagcaagagaaagaagaggcagcagaagtaaaatgaagaaaacagaatttggttgacggagaagaaaaaaacttttgctcaaaaagttgaaggagagaaataaaaaaggccttaactacacacacacacacacacacacacacacaccttggatgttagcttttatttaagcttttagccactaagctccttaaaaaaaataccttcaaatctcattactgtattttagctagtacaaactgctgatatttcaaaagtaatgcaaataccaaaccagaaagggcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaaatcaaaaaaaatttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacagttaaaagaatattggcagagaaacagccttggtgttccagcaggagtgaagaggaacaggaaaacgagtggcagtagccctgaaacagccacttctggtggttgccactcacctgaggatgtgagtcttggcaggccaggcttctggggacagggggcccaaggcacagtagacggtaatttttaagattatggatggactgttgggtactggttaagaattctgggtttggccaggcacagtggctcatgcctgtaatcccagcactttgggagactgaggccggtggatcacgagctcaggaaattgagaccatcctggctaacacggtgaaaccctgtctctcctaaaaatacaaaaaaattagccaggcttggtgatgggtgcctgtagtcccagctactcgggaggctgaggcaggagaatggtgtgaacctgggaggcggagcttgcagtgagttgacattgtgccaccacactccagcctgggagacaaagcgagactccatctcagaaaaaaaaaaaaaaaggaattctgggtttgaatcctgcctctccgtctgctagggatatgatttagggcaagttgcttgagctctttgggcctctcttattacatctgcataatagaggtggtattgtttgacttccatttgtgaagtttaaatgagatttttttattgttgtttttatgttaatccctagtacatggcctgctgtaaacacccaggacacccaggatatggtcattgctctttgattttcctcatccccagtctcaaggggaagccaggacaatgagaacagccacttgccatcaagagtcactgaaagggcctcagggtgggatggtggggggataagaaccatgagagaagtcggcacaaaggagttatgggacaaagcgtccaagataggcagaaaagaaaatgtagccagttgatggggaagaaaggaagtcagagggcttagacactgagggggacagaacatctccatgtgcattctcatctctggtagtcagcaacaggtatccacggggagggccctacatcatctgctaccctgaaggatctggaggtaagaggctctggggagaggtgcagtgaccctgcaggccagccctccaacctcctcccacagtggacacggcatgcccctctgccagctgagacagcccacacacaccccagccttaatgattgttctctctacctctcccccactcctcctccacctcctcgtctctgcatgcacctcagagcccatgccaagaactagcagtagtcctggacccgaggtccataaaaatcagtcaactgaataacaccatcaaatctttggtaagagtccagtggggtccccttattccacgctgccaatcctgggctccagtttccccttggggccctgaggaaaggagctgggggcacctggtgccaaggacaaatagggaactggggcgcccaggcctcacctagagggaccccagagcatgcagtatggctcttcttttgctgccctctttgccgactctctcttctccagacacccctggagaggggtataaacacctttgttttatcaacccaaagtgccattgatttaaagacacctctatttgagaaatgttggaaatcgtatgtcttagaattgatcaaatacaccagaatgtgagctgaaaagaaagcaccggacttaaaatttaggaagtcactggtgatcttacttggagaaatccatttcagtagattggtaagtgcagcactagatggctgtgagttggacaaatgggaggtgtggcattgtatgcagcagagatgcatggatggtgtgcagaccagtattgcaaaaaaattgtggtgatgggaagatgtgataaagctcaagatgtggtacgatttaaaggaaggtaatttttgtatgaggacaacttgagcctttgtcaaggctaaggagaagaagctgatggagagactaaaggagtatatgaggcgctgtggaaatagattagtggagggggcatagatatgaaattagtcagggctggccttaagtgtaactttttaacttattagctgacgttggacatctcacctctgtgagctcaggaggctcacaatctcctgagctttggtctcctcaattgtaaaagtgagttaatcatttccctaccttatggaactgttgtttgtattaagtaatttatctacataaagttcttggaacattatggtcaggacatagtagatactcaataaatggggtctactattatgaagtagatactcaataaatgggatctactattatgagactacgagagacagcataattgattagccacgtccaggtgggaagggatgggatcaagctcacaggttgaagaattcaccctgaaaaggaagagaaatccctctgtggtggtttgaaaagatgtccacagattctttgctatcccttccttcaaaagataggatctaattcctctcttcttgagtgcaagggatgcttaatgaattacctctaaataatagaatgtggttgaaatgacaatgttcagcttttgagagtaagttgtaaaaggcatgtgacttactccatgcttcttctcttggatcacacaatctggaggaagccagctgacttttcacttgaacactcaagcactctctggggaggtgccgggcagtgagggactgaggcctcctgccaacagccatgtgagtacaccatcttggaagtgaagcctccactcctagtctagctttcagatgactgcagccccagctgatatcttgtctgcaacctcatgaaagactctgtactagaaccactcagctaagcaacctccaaattcctgactcacagaaactatgagataacacatatttgttcttttaagctgctaagttttagggtaatttgttacaaagggtaacatatacagattttctctgaggcagaaggaaatcagagaatgacaggtgaaagatgaaaagatagaaaggaaaaaagataaatgtttctgtaacattaaaatatgaggtatgttgtctgctgacaatgaggtggcttggcaagactgctaagagattggaacagccaggcagaaaacaggaaagggaattaacttggaacacaaataagattgagcctacctacctttatgctaaacccaactacagaaatcattttgctaatggaaccagatcagactccacataatgagtctttatctcaatcgtgaaattcagaggctgggggcctctctgagcctaccccagagaccacctttgtgagcaaactgctaatgagtgaattcagggatgaggatggctcaggcttatcttgaaaagtactccctgatgtcaaaatgatttgctacagctacatcaagtctagcacattatttatgaatagggatagactaccagaagtattgtaagagaataatcaacaagtcttatgtaatctgcagcaaacatactgcagtaacaggaaaatccactgtctttcaaatgactcaagtttgcattattccttcctgtttggactgtctctctctctctctctctctctctctctctctctctctctctctctctctctctctctctctctccttctctctctctctttctctctcccttccttcctgcctctctccactctggctgctagcaagagagccctgggaattctctgtgatgtagccagccaacagtttttagggtggtgctccagcacataaaagggaccaggccaggactgccatctcctaaagttaatttaaagaaactaagccctggtttttgtaaaccccacaggtcaaccaggaattgagtcactgcatctccctgcagaatgacaaatcatgctctccttagtagctttacaccagttctgtttgcaaattggggaactgaaacatcactgtaaaattggtgccttttgtatcttatacaatagggctcattcattcattcaccctttcattcactcagctgtttatttagcaactgattattgagtgcctcttccatgaggggacaggcatgtactaattttgggaataaagagatgtatattgtgatcctaaggagaagcaaaatgtcctggcacatagtaagcactcaataaatatatattgaataaataataattcctgctctctctgggcatcatagtctagtagggggaagaggcatgtaaacaaataaagttgttttagtacaatagtaaaggaatcgatcaagtactatacatgtagaataccatatctacctggaagttagggatgatttgatagaagaggtaacatttgcttgatgttgaagaacaaatatgagttttccaggaatggaaagtaggaaaggtctttgcaggcagaccaaaattattatactcataggtcttattgtccgcgggattggttttgtcactcctgtctaatcctaacttgcaaatataaatatttatcaatatttccctggattttaattgtttttgtgtttgtttccaagacagtgataggtggtcaaagttagatgcaaaataactctacaaaagagattattttttacaaagtagatgacattaattcaagaaaaaaagtattttaagtttcttcctgaaagaaccttttaatttcttgtattttctaggccaggtggaagatattcttcctaaaaaatggtcttcagattacctctaaaccttcctctttgacacctggctgagaacccagaaaacaccccctgttccatagcagaccagtgtttactgttatttgcctctttagagcagttcagaggaccatcagctaccatacccactaaacgaaaatggcaaaaggacttgtaatggccaaatgcagcaatataatttgttattatcaattcactagtgatttgaaatattgagaaaattcccaattgaatgacagcatggaaaatcacattacatcagggaatagtattttctaggccaccagatttctctaaattggaatttggaaataaattttatttgcagcaagaaacatgtattaatactgacacttactaaaatgttttaatgagttagagcaagcattttgtgtcaagatactactggtctaacaaggcctgccactattattgatgcccattatgtacttttccgtgaagttgtctaacctgttctattaaacccgtaaactgctttgacaatcgtaaaagagacaaaaaggaacaaagtaagaatgatgggaaatagaaagccaaggcacccaattttcttctagtttaatcaataatttggggctctatcacatttgctctcagccttacagtctgatccttattttttgccaggctgcaaccctcactgcatttaatagaggttgatggatatttttatagccctgcagtttcaaactgattatcaggtgtttaaccagcaaagccatgcaatatttgtataaatcaatcctgtaatgaaaggttatcacccacaaacccagtcagtgtcaaaccagaacaaggtaaagatttggaatgcttccctttctggataacacactattgcttatcttcaattttctggataatttaggattttattgaatatgattcttcaagaactgaacgatcatcctaaacaaatcaaagtcactgtatcatcacagagcagcatttcccacactctcagtaaaacgctgtctacatcaaaggggttctgtgacccaggaggttttggaaactcaggattaaacagagctccacaggttcccttgctacaggcattctcagctgccttcataaggcgatgtgcattgtgaatctctaagtggaaatatggaatgcagtgttttccaggtcactggaccacagaagccttgtttgagaatcacctagtggccccagtggcccacagatcatattttgggaaatgttgctatttgagtataattgttattcttgaacaccccaaattgttttggtgtgggattttttgttttgctttgtttttgtttttgttttgagacagggtgtcactctatcacccaggctggagtgcagtggtgcgatcactgctcaccacagcctcgatcacctgggctctggtgatcctcctgtctcagcctcccaagtagctggaactacaggcatgcattaccatgcctggttcattgttttgtattttttgtagagactgggttttgccatgttgcacaggctggtcttgaagtcctgagctcaagcaatccatttgcctgagcctcccaaagtgctggggttaccggagtgagccactgcgcctggctaggtttctcatttttttttaaaggtgaaattcacataacataaaattaacgattttaatgtgaacaattcagtggcatgtagtccattcacattgttgtgcatccaccacttctatctagtattaaagcattccatctccccaaaataaaactctgtacctgatgagtagttaatttcctattccctctttcccctagcccctagtaactaccaatcagctttctattcctatgggtctacctattctgcatatttcatataaatttaatcaaccagtatgtgacctttcatgtctggtttctttctaatagcagcatgctttttagtttcatctacattgtggcatacacctgtgcttcgattctctttatggctgcatgacgttccattgtatggatagaccacatttgtttgtccattcacccattgacggtcatttgttttcacctttggaccattgtgaatagtgctgctatgaagactcttgtcccagtattttgtttccaatttgtttggggatacacctaggtgtggaattgctgggttagagaattcatcttgccactacaattttgtggcttcctaaggcaaattgaatagttcgtatgacttagctagcttgagacatcatttttaataccttttgttgttgttgttgttttgttttgttttttcagagatggagtctcgttctgtcacccaggctggagtgcagtggcgcaatctcggctcgctgcaagctctgcctcccggattcccgccattctcctgcctcagcctccctagtagctgggactacaggcgccccccaccatgcccggctaatttttgatatttttagtagagacagggtttcactgtgttagccaggatggtctcgatctcctgacctcgtgatccacctgcctcggcctcccaaagtgctgggattacatgtgtgagccaccacacccggccccatttttaatacgttttttaaagatgcatataaaatgcattaccctctggaagattccagtaacttactgaagcaagtttctcctctacatatacctatttctgccatgagtaactgttcattttcagtgagtcatttgagtttctgttattcaggtatacagagttcctgttgtctttttagtcaacaaagtttaacaaagaccataataaagatggctttcagcagctctgttattgggaagggttgtattcatgtgaagaaagaaattattttattttatttttaagttttagtagagggggggttttgctatgttggttaggctggtctcgaactcccatcctcaagtgatccacctgcctcggtctctcaaagtgctgggattacgggcatgagccactgtgcctggacagtaataatattttttaaaaggctgacatcagcagatcagctattctggaaagatttttaaacactcagaggtttttttgtgtttgtttgttttcttttcttttcttttttagaggcagggtcttgctctgtcgcccaggctaaggtggagtggtgcaatcatagctcactacagcctcaaactcctgggctcaaacaatcctcacacctttcataccttaggcccctgagtagctgggtgggactacaggcatgcatcaccatgcttggctaatttttaattttgtataggtggggtcttgccatttgcccaggctggtgtcaaactcctcaagtaatccttctgcctcggcctcctaaagtgccaggattataggcctgagccactacacacagcccggagtttttaaaaaatactcaattaaaatgcttcatttaagtgtatgtctctaagaaaatttaataattgattaaatattgttgaatagactgaaagcacaacatccaagcacatgaattaagcaaataatgcaagcatagctcccacactccacaaatgttttctagtcattccaaagccattctttttagaggatctttaagaaaatgcttggctctcatccgattattatacaagagattaagaatttactgagtttacagttctttctatgaaggaaagaatgaggtctacacccaaaagaaacattgggattttcatttaagtaaagctgtattctcatttaaaatggtactagtgctcttgttggcaacagacacatgaagcaaaattttccttttacatttgaatttcaactgcatttaaagtgttataaataccatgactacataagctaagggaatgaatgtattaactctgatgcagtctgtcaggttttaacagtagtgaatcttgggatcggtacatctcattccagtatagctatggtaaatgacatagagatcgctgaattgttgtatttccaggacttttcaaaagtgactattaaggttggctgtgggatctagcaggttattgtcctagaacacttgtggccttctcctaaaacagactgggaaaattctggttctttattcactgacatctcaaagggcaaagagggaggcaccatgacattctgcagttgcaggcctctcaggatgagactgtatttttccatacagcaatgttgatttgatctggcctaattctccgattgatgtggtgagaggcaggactacttgggaatgtattcactgtgcctgatttctctctgggcaatttatttggtcatcaatctttttatcctcctgacatttgatttctagatattggcccaaattccataagataggaatttttgttctgaattttaataacatatgtattttaattaatagtatattttaaaataaaagtaacacgacaaaaagaaaaaacaaagacaaaaaagtaacctaagaatatatgctcaaaagtgccaaaaatacaaaagactacagaatttttaaaatagaagctttttgttcaacttgctgctcttcttcccacttcttcaattccatttcttttcctataggtgatcatggctaacattttggtgtttgtctttccaaagtgtatagttatagatctgaatagaaatgtagatacagagatatcaaagatgagcatgggctaagcactcaacaataaactacgttgggtctatttttcaaagttactctcaaaacaagaatacagattgtccattaaacatactggaattttaatacattcttttttttcccccagaacatttctgatttcatatattctggcatgtttcctgccatgtggcaaaccataagctgaaagagatataaatataaataacactatgtctaacaaaatttgctcagaatatgctaaagcattagtataaatgtctacatcttaagtcagagctaaagaacaagtttctctcagtaaatcaaggaaagccaggggaaaagaccatagagaaaaaggatatgggtgcctgtatgaagcaggggaggtttttgactccagtgcacctaattagcaaataagtatcattcatctgtgctgtggtaagcactgcagtatgcataaatagaaggtgtgatacctgcctccaaagggcttaccatctactgagaaatccgactaatcagacaggaaagactcagataatgaaggcttgcataagagcctgaatctgataaggtaatgaacaaaagacagcctctacaggtttttatagatagaaatgagatgataaaatcaaatttaaacaatgtatcttaactcccttccggcctttcatttccattccatgaatgctaccctggcttaggctttcatgactttgcctatttgcagtgaccttgtattcagcactctgccatctctcccactacttcctcccaagccatcctgaacacaggccacatgtttgattttctaatcgtacacaagggaacgtctctgctcaaaagccaaaaatgactcttctttggccaccaaataatctgaactttttggtgtgaaactcaaggccctgccagaaacaatattaatctccttccagactgtctcccatttcctaatattaaccccttgctctgttgaaattgaagccattttccaaagccacctctgtgatgtccttatgtaattcccgccctcttcttgtcctcccctgcaaccctatctccatagaaaagcagtcagaaaaaccaccctaggaattgatgcagtaatccaggagtgagatgaggatgggagggagagggtgagcatgtggggatgaggaggagggtgggacacagggagtagccacagaccttaatgactgatggcagatagggtgtgaaggagagaggtgagtcaaaggtaacttattttcggttttaggcaacaaatacaaatctttctcaataactactcatcccacatccttgtggctattggaggttgatatttatttcatactgcctgtataacctgggaccatatataattaatgatgattactctgtattctagatcacgaatatatatatctatataaatatatacaaatatataaatacaaatatatatatatatatatatatatttaccttaatgcaggcacaaccaaatactttacttttggagccagatgtctttaagatacactgtaaaccattaatagatacattgaataagaatctttatttcattcccagtgtggtttggagtataagacttaggaaagtgtctgtgaaacctacagtgagaaattccactgggtcttgacagctggagtgagcactcaaatgtgcccagcacttttctctagctcccttctctgcttgagctgtggtctgctttctccttctctgtagctcagatcatcttcctccacttctcagcccacatgtctaacgtggctgggaccagctcagagtgtttcaaatgtgtaggtgctcggagagagagagacccaaccctcttagactcaggtacacattctcagggaagaaaactggaaccagtagaaatatcagatccctatgttccctgacgagtgcttccttctctaagaagaaaaacctactaagaagacaaattacagctggaaggttgtttggtaagcgtggaatcacctatctaatctcccagcaagtcttaattgctctaccataaaaaaaaagcaacccaaatccatccttttcccagcttcactccctagtccaaagccaccatccacccttgtctaaacctctgcaggactgtctttgcttatttcttttcttttctttttctttttcttttttttaagcggagtctcactctgtcacccaggctggagtgcagtggcgcgatctcggctcactgcaagctctgcctcccgggttcacgccattctcctgcctcagcctcccgagtagctgggagtacaggcgcccgccaccatgcccagctaatttttttgtatttttagtagagatggggtttcactgtgttagccagaatggtctccatcttctgacctcgtaatccacccacctcagtctcccaaagtgctgggattacaggcgtgagccaccgcacctggccctgtcttttctaatttcttaactatcatttctatccccttagaattgattctccactcagcatgcagaattatccctttgaaaatcagattatattcctacctaaaccacccccaatagcttgtgacctcttagaatctagattccttaacatggcctcaagggcccacgtgacccagcccctgcctgtctctctacctcatctcctactgctcctgcttttgttccttccactctaatcacttgacctcctgacctcagtcatgctaataaactcatgcctcatttagatttattttcctagtggaagaaaatgcattgatctgtgaacacaaatacatggtttatctgttacagttctcattgcatgtcaacaaactgacattctgatgtgtacatccatctcttatgagtctgcttagtgtgaatctgccccctctggtagtactgacaagattgtgtttctcagcccacagagctaagacacagactcatgagacccagtctctgtctataccactagagttctactgcccctgaatggcattgcctgcacagacagctggccttcctcagcagacacacagcctttgtaccatataactcttcagacttgctatgatgtaccaatgtctttccttgaaatgctcttctgaaaatgataaatgctaaaactgattacaatgctattgaaagtggatgagcaagttgatctgctgagatgtgaaaacaaattctattttaatttttaatctaaaatattagaaagaattttgtttcctatactttgctatatttagtaaatatacactaatataagaattttgctttactaaaacagtagaaccctcagttagccaggcagtcatcatctgtcacataaaaggtgtcctgaggaggaatgggagtgcctcccctggggaagaggctgatggtggctctggctctcagtcagtcgctttccttatcttggtatttactgtcatttatctgggcttagctaaacagatttatagagaattaactctcacaaaatgggaacataatttaaaagatttctgcaaagaattggacaggaactcttgtcaaaattgtaagcagaagaaaagaaaaaaagaaagggacagagccgacatttctcatacttctggtacaagctcctcatcacattcattgtgttgtaaaaataatggtgatctagtaacatctgacaaggtcagccaaaatgatacatataagaatttagctctccacctaggagggctattagcaataaaatttccatctactataacttataattaactttgacctatatgtgtatttcccttgagattggccaatgattgattgaaactaccacaattaatgacagataaaatagcttttttattttaaaatttctattttgtgggtattatagaatgtattttatatattaatatacatataattatatactattataatcatatattaatattaacatataattgtgtgtgttcaaaaatttttaatggcacaatcaaaaaactttaaagaccactggattaaaagatggtatttagggcccagcacaatgactcaagtctgtagtctcagcactttgggaagctgaggtgaggggatcgcttgagcccaggagatcaagaccagccatgggcaatatggcaaaaccccatctctacaaaaaatacaaaaattagccagatgtgttgcaactgtagtcccagctattcaagaaactgaagtgggaagatcacttgagcctgcaaggtcgacgctgcagtgagccatgattgcaccactccagcctgggagacagagcaaggccttgcttcaaaaaataaaaataaaagatgacattaagaagaaatctgatctcattgtctttattatcaagtgattgaaggctataatcattatttaataatcttgtagataatgattgtacttgaaagtgggc
